(12) United States Patent
Wargo et al.

(10) Patent No.: US 11,395,838 B2
(45) Date of Patent: Jul. 26, 2022

(54) METHODS FOR ENHANCING IMMUNE CHECKPOINT BLOCKADE THERAPY BY MODULATING THE MICROBIOME

(71) Applicant: BOARD OF REGENTS, THE UNIVERSITY OF TEXAS SYSTEM, Austin, TX (US)

(72) Inventors: Jennifer Wargo, Houston, TX (US); Vancheswaran Gopalakrishnan, Houston, TX (US)

(73) Assignee: Board of Regents, The University of Texas System, Austin, TX (US)

( * ) Notice: Subject to any disclaimer, the term of this patent is extended or adjusted under 35 U.S.C. 154(b) by 175 days.

(21) Appl. No.: 16/337,820

(22) PCT Filed: Sep. 27, 2017

(86) PCT No.: PCT/US2017/053717
§ 371 (c)(1),
(2) Date: Mar. 28, 2019

(87) PCT Pub. No.: WO2018/064165
PCT Pub. Date: Apr. 5, 2018

(65) Prior Publication Data
US 2020/0129569 A1    Apr. 30, 2020

Related U.S. Application Data

(60) Provisional application No. 62/400,372, filed on Sep. 27, 2016, provisional application No. 62/508,885, filed on May 19, 2017, provisional application No. 62/557,566, filed on Sep. 12, 2017.

(51) Int. Cl.
*A61K 35/741* (2015.01)
*A61P 35/00* (2006.01)
*A61K 9/00* (2006.01)
*A61K 45/06* (2006.01)
*C12N 1/20* (2006.01)
*A61K 35/00* (2006.01)
*A61P 35/02* (2006.01)
*C12Q 1/04* (2006.01)

(52) U.S. Cl.
CPC .......... *A61K 35/741* (2013.01); *A61K 9/0053* (2013.01); *A61K 45/06* (2013.01); *A61P 35/00* (2018.01); *A61P 35/02* (2018.01); *C12N 1/20* (2013.01); *C12Q 1/04* (2013.01); *A61K 2035/115* (2013.01)

(58) Field of Classification Search
CPC .... A61K 35/741; A61K 9/0053; A61K 45/06; A61K 2035/115; A61P 35/02; A61P 35/00; C12N 1/20; C12Q 1/04
See application file for complete search history.

(56) References Cited

U.S. PATENT DOCUMENTS

| | | | |
|---|---|---|---|
| 2016/0193257 | A1 | 7/2016 | Honda et al. |
| 2018/0243351 | A1 | 8/2018 | Hlavka |
| 2018/0303934 | A1 | 10/2018 | Clube et al. |
| 2020/0129569 | A1 | 4/2020 | Wargo et al. |

FOREIGN PATENT DOCUMENTS

| | | |
|---|---|---|
| CN | 105296590 | 2/2016 |
| WO | WO 1995/001994 | 1/1995 |
| WO | WO 96/15660 | 5/1996 |
| WO | WO 1998/042752 | 10/1998 |
| WO | WO 2000/037504 | 6/2000 |
| WO | WO 2001/014424 | 3/2001 |
| WO | WO 2005/003168 | 1/2005 |
| WO | WO 2005/009465 | 2/2005 |
| WO | WO 2006/00317 | 1/2006 |
| WO | WO 2006/072625 | 7/2006 |
| WO | WO 2006/072626 | 7/2006 |
| WO | WO 2006/121168 | 11/2006 |
| WO | WO 2007/042573 | 4/2007 |
| WO | WO 2008/084106 | 7/2008 |
| WO | WO 2008/132601 | 11/2008 |
| WO | WO 2009/044273 | 4/2009 |
| WO | WO 2009/101611 | 8/2009 |
| WO | WO 2009/114335 | 9/2009 |
| WO | WO 2010/027827 | 3/2010 |
| WO | WO 2010/065939 | 6/2010 |
| WO | WO 2011/008369 | 1/2011 |
| WO | WO 2011/014438 | 2/2011 |
| WO | WO 2011/066342 | 6/2011 |
| WO | WO 2012/071411 | 5/2012 |
| WO | WO 2012/160448 | 11/2012 |

(Continued)

OTHER PUBLICATIONS

Patyar et al. Journal of Biomedical Science, 2010, vol. 17, Nol. 21, p. 1-9.*
Miquel et al., Current Opinion in Microbiology, 2013, vol. 16, p. 255-261.*
Maronpot et al., Toxicologic Pathology, 2004, vol. 32, Suppl. 1, p. 40-48.*
Wei et al. Cancer Letters, 2008, vol. 259, p. 16-27.*
Bultman, et al., "Microbial-Derived Butyrate: Oncometabolite or Tumor-Suppressive Metabolite?" Cell Host & Microbe, 16: 143-145, 2014.
Chaput, et al., "Baseline Gut Microbiota Predicts Clinical Response and Colitis in Metastatic Melanoma Patients Treated with Ipilimumab," *Annals of Oncolology*, 28(6): 1368-1379, 2017.

(Continued)

*Primary Examiner* — Kade Ariani
(74) *Attorney, Agent, or Firm* — Norton Rose Fulbright US LLP

(57) ABSTRACT

Provided herein are methods and compositions for the treatment of cancer by modulating the microbiome to enhance the efficacy of immune checkpoint blockade. The microbiome may be modulated by the administration of butyrate and/or butyrate-producing bacteria. Also provided herein are methods of determining a response to an immune checkpoint inhibitor by identifying if a subject has a favorable microbial profile.

19 Claims, 78 Drawing Sheets

Specification includes a Sequence Listing.

(56) References Cited

FOREIGN PATENT DOCUMENTS

| | | |
|---|---|---|
| WO | WO 2013/006490 | 1/2013 |
| WO | WO 2013/025779 | 2/2013 |
| WO | WO 2013/067492 | 5/2013 |
| WO | WO 2014/022021 | 2/2014 |
| WO | WO 2015/016718 | 2/2015 |
| WO | WO 2015/066625 | 5/2015 |
| WO | WO 2015/075688 | 5/2015 |
| WO | WO 2015/095241 | 6/2015 |
| WO | WO 2015/153639 | 10/2015 |
| WO | WO 2016/063263 | 4/2016 |
| WO | WO 2016/196605 | 12/2016 |
| WO | WO 2017/172894 | 10/2017 |
| WO | WO 2018/115519 | 6/2018 |
| WO | WO 2019/191390 | 10/2019 |

OTHER PUBLICATIONS

Chen, et al., "Analysis of Immune Signatures in Longitudinal Tumor Samples Yields Insight Into Biomarkers of Response and Mechanisms of Resistance to Immune Checkpoint Blockade," *Cancer Discovery*, 6: 827-837, 2016.
Frankel, et al., "Metagenomic Shotgun Sequencing and Unbiased Metabolomic Profiling Identify Specific Human Gut Microbiota and Metabolites Associated with Immune Checkpoint Therapy Efficacy in Melanoma Patients," *Neoplasia*, 19(10): 848-855, 2017.
Garrett, "Cancer and the Microbiota," *Science*, 348(6230): 80-86, 2015.
Gopalkrishnan, et al. "Gut Microbiome Modulates Response to Anti-PD-1 Immunotherapy in Melanoma Patients," *Science*, 359(6371): 97-103, 2018.
Gueimonde, et al., Antibiotic Resistance in Probiotic Bacteria, Frontiers in Microbiology, 4(202): 1-6, 2013.
International Search Report and Written Opinion Issued in Corresponding PCT Patent Application No. PCT/US2017/053717, dated Feb. 2, 2018.
International Search Report and Written Opinion Issued in Corresponding PCT Patent Application No. PCT/US2019/024519, dated Oct. 24, 2019.
International Search Report and Written Opinion Issued in Corresponding PCT Patent Application No. PCT/US2019/62659, dated Mar. 30, 2020.
Klieve, et al., "Ruminococcus Bromii, Identification and Isolation as a Dominant Community Member in the Rumen of Cattle Fed a Barley Diet," Journal of Applied Microbiology, 103: 2065-2073, 2007.
Matson, et al., "The Commensal Microbiome is Associated with Anti-PD-1 Efficacy in Metastatic Melanoma Patients," Science, 359(6371): 104-108, 2018.
Pitt, et al., "Fine-Tuning Cancer Immunotherapy: Optimizing the Gut Microbiome," Cancer Research, 76(16): 4602-4607, 2016.
Pitt, et al., "Resistance Mechanisms to Immune-Checkpoint Blockade in Cancer: Tumor-Intrinsic and -Extrinsic Factors," Immunity, 44(6), 1255-1269, 2016.
Poutahidis Theofilis, et al., "Gut Microbiota and the Paradox of Cancer Immunotherapy," *Frontiers in Immunology*, 5(Article 157): 1-5, 2014.
Routy, et al. "Gut Microbiome Influences Efficacy of PD-1-Based Immunotherapy Against Epithelial Tumors," *Science*, 359(6371), 91-97, 2018.
Sivan, et al., "Commensal Bifidobacterium Promotes Antitumor Immunity and Facilitates Ant-PD-L1 Efficacy," *Science*, 350: 1084-1089, 2015.
Smelt, et al., "Probiotics Can Generate FoxP23 T-Cell Responses in the Small Intestine an Simultaneously CD4 and CD8 T Cell Activation in the Large Intestine," PLOS One, 8(7):e68952, 1-12, 2013.
Taur, et al., "The Effects of Intestinal Tract Bacterial Diversity on Mortality Following Allogenic Hematopoietic Stem Cell Transplantation," *Blood*, 124: 1174-1182, 2014.
Tumeh, et al., "PD-1 Blockade Induces Responses by Inhibiting Adaptive Immune Resistance," *Nature*, 515: 568-571, 2014.
Vetizou, et al., "Anticancer Immunotherapy by CTLA-4 Blockade Relies on the Gut Microbiota," *Science*, 350(6264), 1079-1084, 2015.
Viaud, et al., "Gut Microbiome and Anticancer Immune Response: Really Hot Sh*t!" Cell Death and Differentiation, 22(2): 199-214, 2014.
Borody et al. "Fecal microbiota transplantation and emerging applications" *Nat. Rev. Gastroenterol. & Hepatol.* 2011, 9, 88-96.
Dubin et al., "Intestinal microbiome analyses identify melanoma patients at risk for checkpoint-blockade-induced colitis." *Nat Commun.* 2016, 7:10391, 8 pages.
Extended European Search Report Issued in Corresponding European Patent Application No. 17857329.1, dated Aug. 7, 2020.
International Search Report and Written Opinion Issued in Corresponding PCT Patent Application No. PCT/US2020/013808, dated Jun. 2, 2020.
Jenq et al., "Intestinal Blautia is Associated with Reduced Death from Graft-versus-Host Disease" *Biol. Blood Marrow Transplant.* 2015, 21, 1373-1383.
Litvak et al., "Dysbiotic Proteobacteria expansion: a microbial signature of epithelial dysfunction" *J. Curr. Opin. Microbiol.* 2017, 39, 1-6.
Moco, et al., "Metabolomics View on Gut Microbiome Modulation by Polyphenol-Rich Foods," Journal of Proteome Research, 11(10): 4781-4790, 2012.
Png et al., "Mucolytic Bacteria With Increased Prevalence in IBD Mucosa Augmentin VitroUtilization of Mucin by Other Bacteria" Am. J. Gastroenterol. 2010, 105, 2420-2428.
Roh et al., "Integrated molecular analysis of tumor biopsies on sequential CTLA-4 and PD-1 blockade reveals markers of response and resistance." *Sci Transl Med.* 2017, 9(379), 24 pages.
Segata et al., "Metagenomic biomarker discovery and explanation." *Genome Biol.* 2011, 12:R60, 18 pages.
Wang et al., "Bifidobacterium can mitigate intestinal immunopathology in the context of CTLA-4 blockade." *PNAS 2018*, 115(1), 157-161.
Wang et al., "P038 Fecal Microbiota Transplant (FMT) For Immuno-checkpoint Inhibitor-Induced Colitis (ICI-C) in a 50 Year Old Female With Bladder Cancer" Gastroenterology 2018, 154(1S), S19-S20.

\* cited by examiner

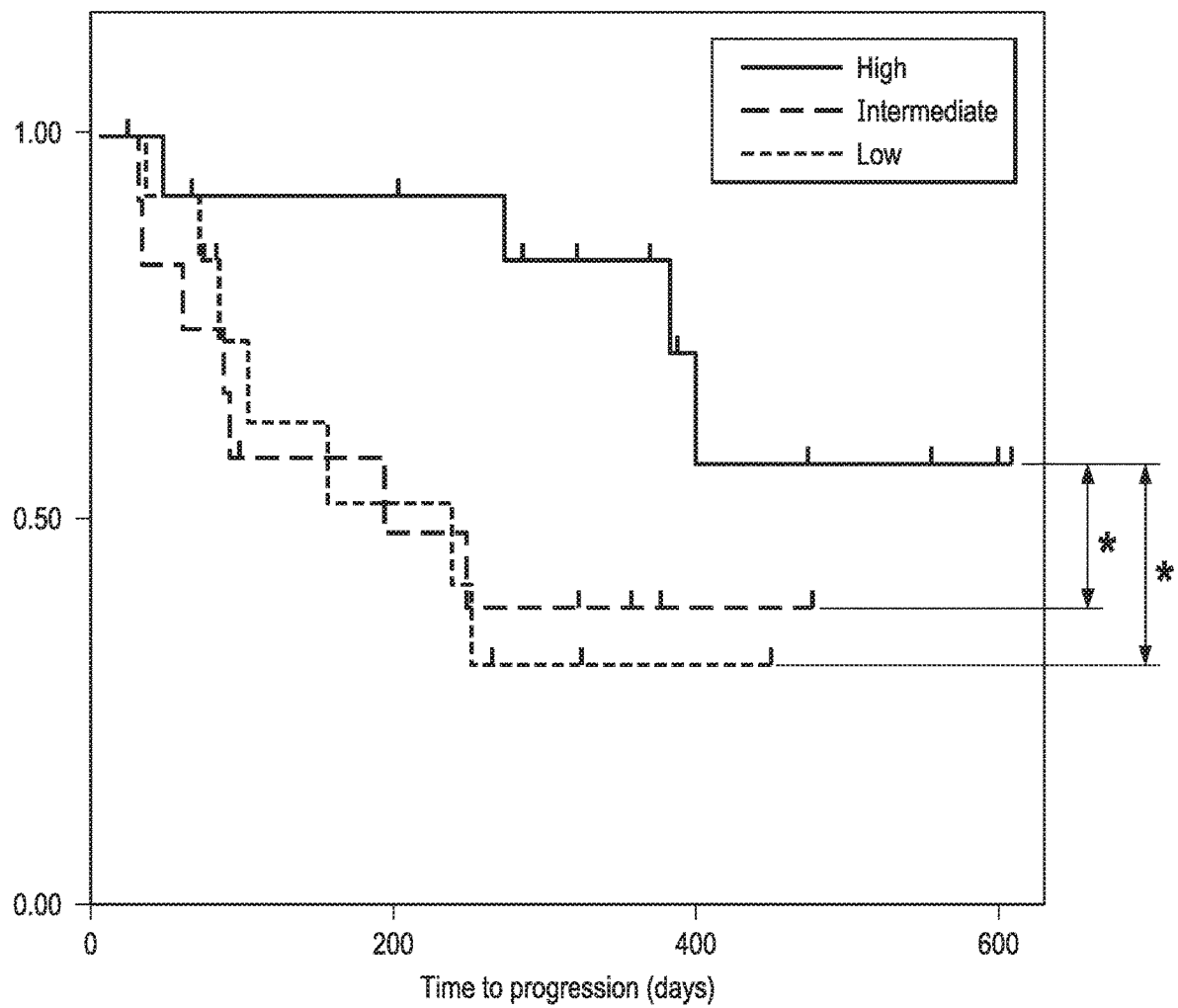

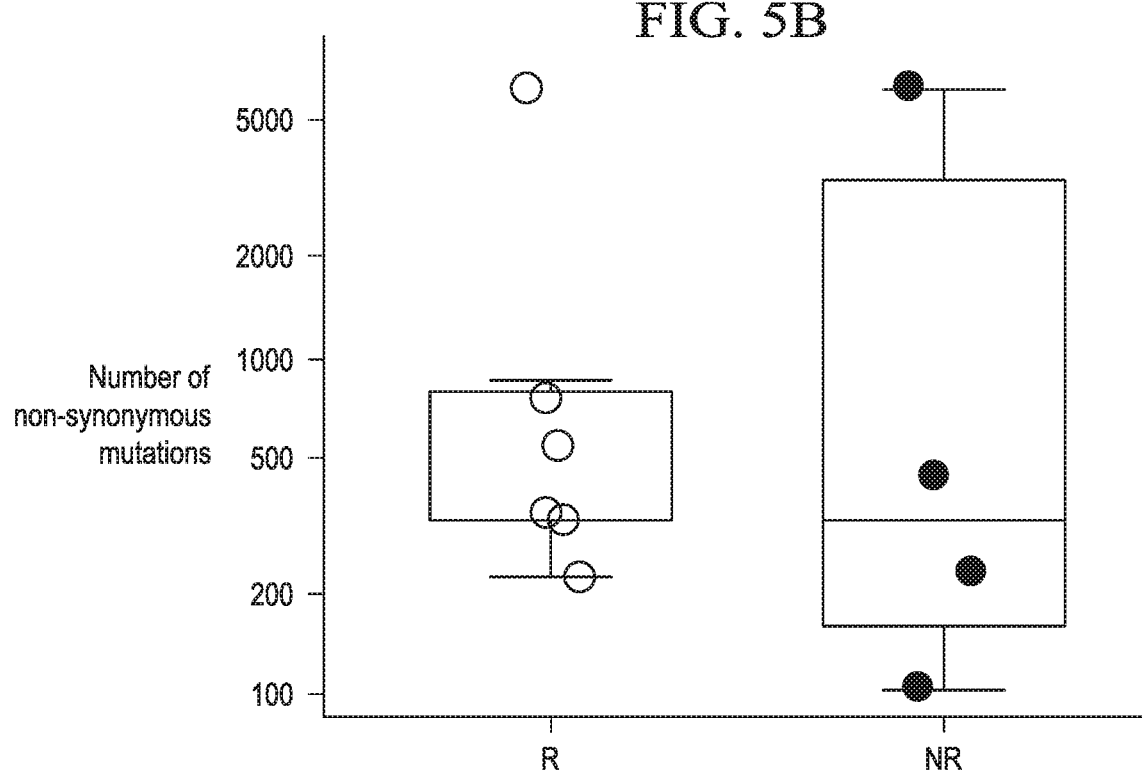

Days elapsed on therapy

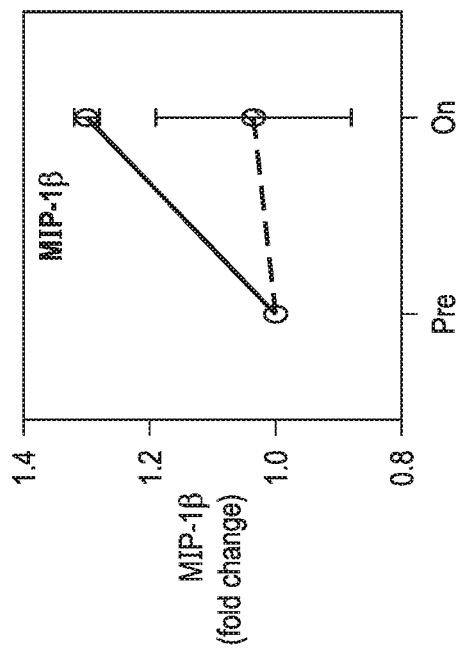
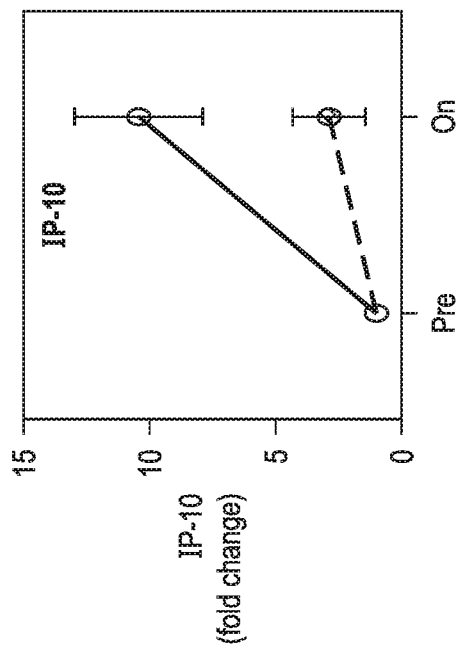
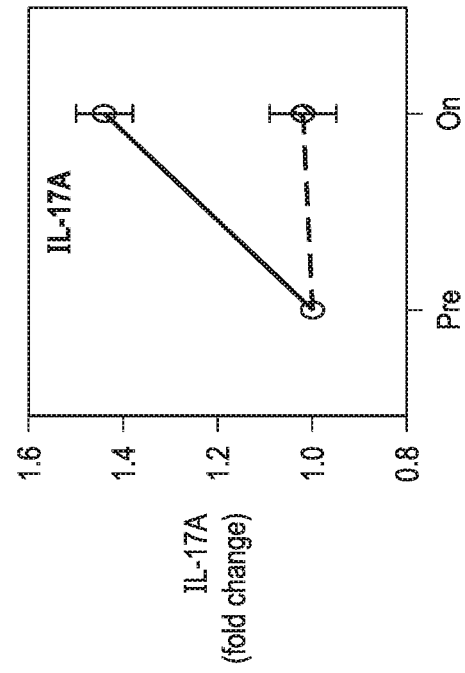

FIG. 30A
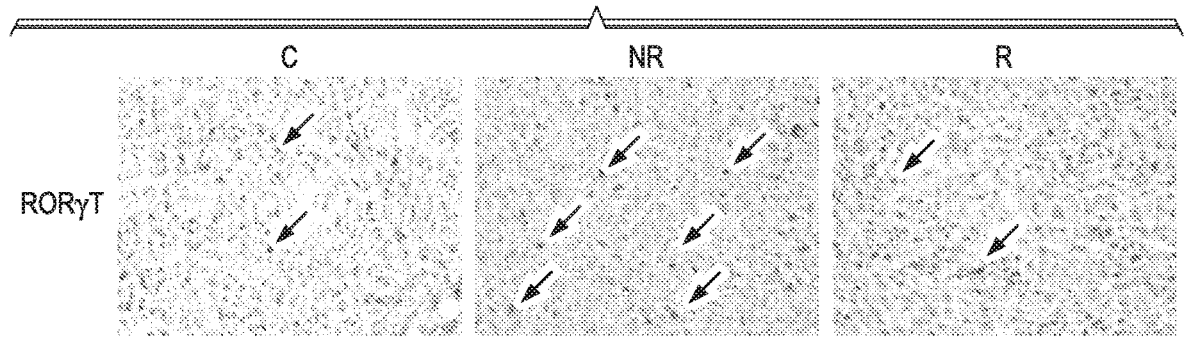
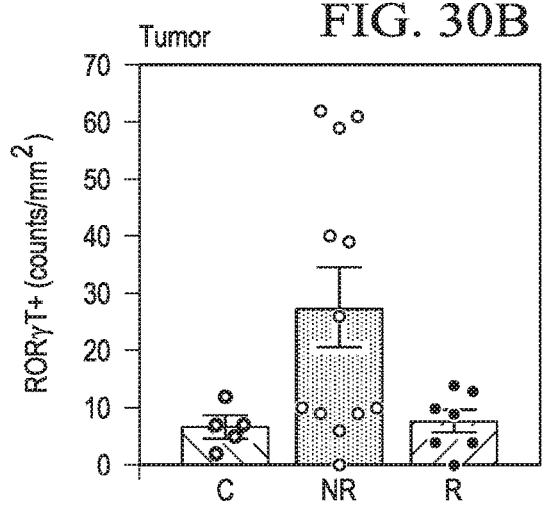
FIG. 30B
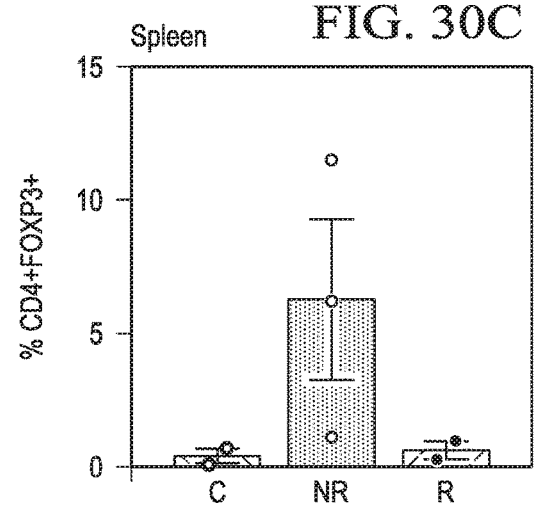
FIG. 30C
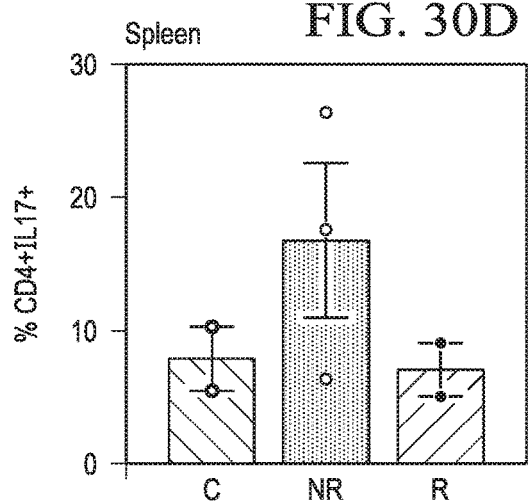
FIG. 30D

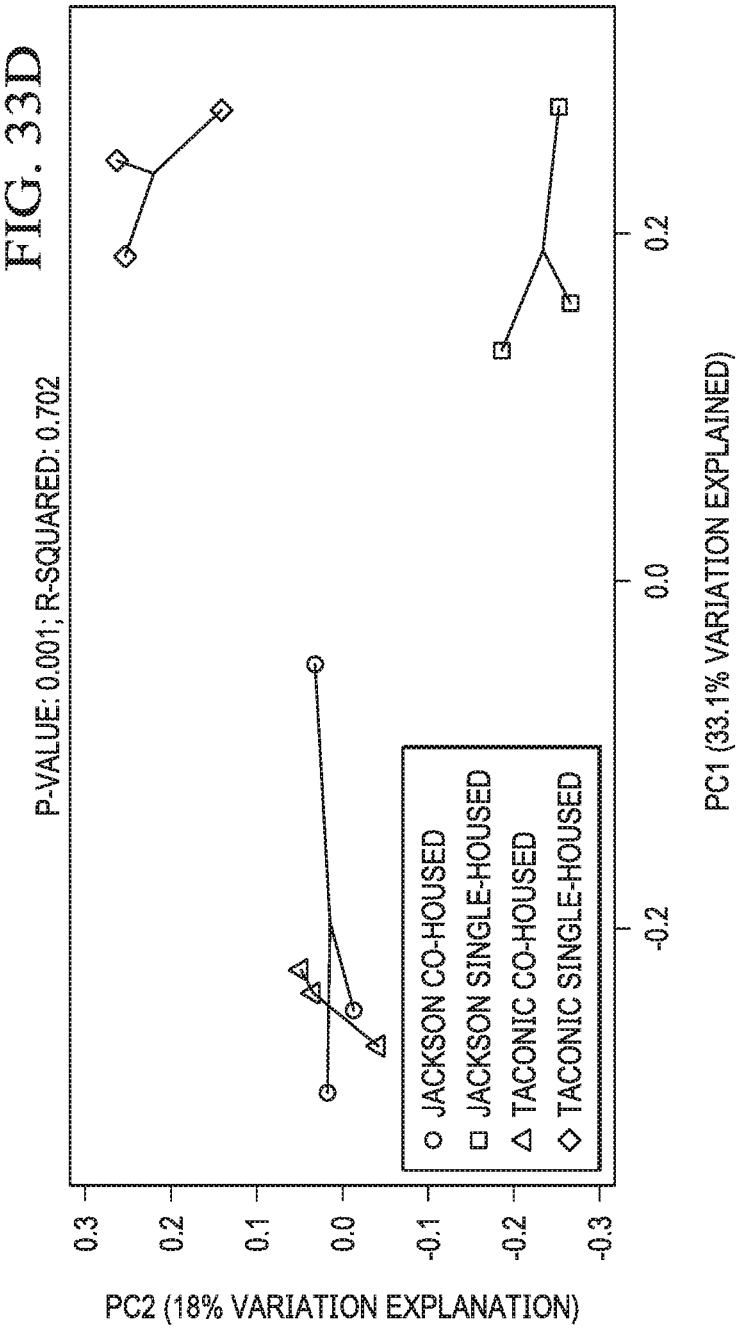

METHODS FOR ENHANCING IMMUNE CHECKPOINT BLOCKADE THERAPY BY MODULATING THE MICROBIOME

This application is a national phase application under 35 U.S.C. § 371 of International Application No. PCT/US2017/053717, filed Sep. 27, 2017 which claims the benefit of priority of U.S. Provisional Applications No. 62/400,372, filed Sep. 27, 2016; No. 62/508,885, filed May 19, 2017; and No. 62/557,566, filed Sep. 12, 2017, each of which is incorporated herein by reference in its entirety.

BACKGROUND OF THE INVENTION

1. Field of the Invention

The present invention relates generally to the fields of microbiology, immunology, and medicine. More particularly, it concerns the use of the microbiome to improve the efficacy of immune checkpoint blockade therapy

2. Description of Related Art

Within the past decade, major advances have been made in the treatment of melanoma through the use of targeted therapy and immunotherapy. In particular, the use of immune checkpoint inhibitors has shown tremendous promise, leading to the FDA approval of several agents blocking immuno-modulatory molecules on the surface of T lymphocytes (e.g., anti-CTLA-4 antibody Ipilimumab, and anti-PD-1 antibodies Nivolumab, Pembrolizumab). Importantly, treatment with immune checkpoint blockade may result in durable long-term complete responses, though overall response rates are modest (i.e., 15% with CTLA-4 blockade, and 30-40% with PD-1 blockade).

However, immune checkpoint inhibitors can be associated with substantial toxicity and only a subset of patients may benefit. Efforts are underway to better understand variation in responses to immune checkpoint blockade; however, it remains unclear what is contributing to this enhanced response in these patients, and there is a critical need to identify actionable strategies to improve responses to therapy in all patients.

There is an increasing appreciation of the role of the host microbiome in responses to cancer therapy, and studies suggest that bacteria present in the tumor and the gut may impact therapeutic responses. There is also a growing appreciation of the role of the gastrointestinal microbiome in shaping immune responses in health and disease. However, there is a significant translational knowledge gap, and there is an unmet need for therapeutic strategies to enhance responses to immune checkpoint blockade in melanoma, and other cancers.

SUMMARY OF THE INVENTION

In one embodiment, the present disclosure provides a composition comprising at least one isolated or purified population of bacteria belonging to of one or more of the families Ruminococcaceae, Clostridiaceae, Lachnospiraceae, Micrococcaceae, and/or Veilonellaceae. In other embodiments, the composition comprises at least two isolated or purified populations of bacteria belonging to one or more of the families Ruminococcaceae, Clostridiaceae, Lachnospiraceae, Micrococcaceae, and/or Veilonellaceae. In certain embodiments, the composition is a live bacterial product, live biotherapeutic product or a probiotic composition. In still other embodiments, the at least one isolated or purified population of bacteria or the at least two isolated or purified populations of bacteria are provided as bacterial spores. In another embodiment, the at least one population of bacteria belongs to Clostridiales Family XII and/or Clostridiales Family XIII In some aspects, the composition comprises at least two isolated or purified populations of bacteria belonging to the family Ruminococcaceae and/or of the family Clostridiaceae. In other embodiments, the composition comprises at least one population belonging to the family Ruminococcaceae and at least one population belonging to the family Clostridiaceae. In some aspects, the two populations of bacteria belonging to the family Ruminococcaceae are further defined as populations of bacteria belonging to the genus Ruminococcus. In certain aspects, the at least two isolated or purified populations of bacteria belonging to the family Ruminococcaceae are further defined as populations of bacteria belonging to the genus *Faecalibacterium*. In certain aspects, the population of bacteria belonging to the genus *Faecalibacterium* are further defined as a population of bacteria belonging to the species *Faecalibacterium prausnitzii*. In certain aspects, the population of bacteria belonging to the genus *Ruminococcus* are further defined as a population of bacteria belonging to the species *Ruminococcus bromii*. In some aspects, the at least two isolated or purified populations of bacteria belonging to the family Micrococcaceae are further defined as a population of bacteria belonging to the genus *Rothia*. In additional aspects, the composition further comprises a population of bacteria belonging to the species *Porphyromonas pasteri*, the species *Clostridium hungatei*, the species *Phascolarctobacterium faecium*, the genus Peptoniphilus, and/or the class Mollicutes. In certain aspects, the composition does not comprise populations of bacteria belonging to the order Bacteroidales.

Particular embodiments of the present disclosure provide a method of preventing cancer in a subject comprising administering a composition of the embodiments to the subject. For example, in some aspects, a method is provided for preventing cancer in a subject at risk for developing cancer (e.g., a melanoma) or treating cancer in a subject having a tumor comprising administering to the subject a composition comprising at least one isolated or purified population of bacteria belonging to one or more of the class Clostridia, class Mollicutes, order Clostridiales, family Ruminococcaceae and/or genus *Faecalibacterium*, wherein administration of the composition results in an increase of $CD8^+$ T lymphocytes in the tumor. In particular embodiments, the T lymphocytes are cytotoxic T lymphocytes. In still other embodiments, the method is a method of treating cancer in a subject comprising administerting a composition comprising at least one isolated or purified population of bacteria belonging to one or more of the class Clostridia, class Mollicutes, order Clostridiales, family Ruminococcaceae and/or genus *Faecalibacterium*, wherein administration of the composition results in an increase of effector $CD4^+$, $CD8^+$ T lymphocytes, monocytes and/or myeloid dendritic cell in the systemic circulation or the peripheral blood of the subject. In some embodiments, the method is a method of treating cancer in a subject comprising administrating a composition comprising at least one isolated or purified population of bacteria belonging one or more of the class Clostridia, class Mollicutes, order Clostridiales, family Ruminococcaceae and/or genus *Faecalibacterium* and/or *Ruminococcus*, wherein administration of the composition results in a decrease of B cells, regulatory T cells and/or myeloid derived suppressor cells in the systemic circulation or the peripheral blood of the subject. In other aspects, the method is a method of treating cancer in a subject having a tumor comprising administering a composition comprising at least one isolated or purified population of bacteria belonging to one or more of the class Clostridia, class Mollicutes, order Clostridiales, family Ruminococcaceae and/or genus *Faecalibacterium*, wherein administration of the composition to the subject results in an increase in CD3, CD8, PD1, FoxP3, Granzyme B and/or PD-L1 expression in a tumor immune infiltrate. In still other aspects, the method is a method of treating cancer in a subject having a tumor comprising administering a composition comprising at least one isolated or purified population of bacteria belonging to one or more of the class Clostridia, class Mollicutes, order Clostridiales, family Ruminococcaceae and/or genus *Faecalibacterium*, wherein administration of the composition to the subject results in an decrease in RORγT expression in a tumor immune infiltrate. Also described are methods of treating a tumor in a subject diagnosed with or suspected of having cancer comprising administering a composition comprising at least one isolated or purified population of bacteria belonging to one or more of the class Clostridia, class Mollicutes, order Clostridiales, family Ruminococcaceae and/or genus *Faecalibacterium*, wherein administration of the composition to the subject results in an increase in $CD45^+$, $CD3^+/CD20^+/CD56^+$, $CD68^+$ and/or $HLA-DR^+$ cells in the tumor. In some aspects, a composition of the embodiments is administered in a sufficient amount to increase the level of innate effector cells in the subject. In other aspects, administration of the composition to the subject results in an increase in the level of innate effector cells in the subject. For example, administration of the composition can increase innate effector cells such as $CD45^+CD11b^+Ly6G^+$ cells. In some aspects, a composition of the embodiments is administered in a sufficient amount to decrease the level of suppressive myeloid cells in the subject. In additional aspects, administration of the composition to the subject results in a decrease of the level of suppressive myeloid cells in the subject. For example, administration of the composition can decrease the level of suppressive myeloid cells such as $CD45^+CD11b^+CD11c^+$ cells. In particular embodiments, the composition comprises the bacteria *Faecalibacterium prausnitzii*.

Another embodiment provides a method of treating cancer in a subject comprising administering a therapeutically effective amount of an immune checkpoint inhibitor to said subject, wherein the subject has been determined to have a favorable microbial profile in the gut microbiome. In some aspects, a favorable microbial profile is further defined as having one or more of the bacterial populations of the probiotic or live bacterial product compositions of the embodiments. In a further embodiment, there is provided a method of predicting a response (e.g., predicting survival) to an immune checkpoint inhibitor in a patient having a cancer comprising detecting a microbial profile in a sample obtained from said patient, wherein if the microbial profile comprises one or more of the bacterial populations of the probiotic or live bacterial product compositions of the embodiments, the response is favorable. In particular embodiments, a patient is administered an immune checkpoint inhibitor if the patient is predicted to have a favorable response to the immune checkpoint inhibitor. In certain embodiments, the favorable microbial profile is a favorable gut microbial profile.

In some embodiments, the at least one isolated or purified population bacteria or the at least two isolated or purified populations of bacteria belong to one or more of the species, subspecies or bacterial strains selected from the group consisting of the species in Table 1 with an enrichment index (ei) greater than 0.5, 0.6, 0.7, 0.8 or 0.9. In particular embodiments, the at least one isolated or purified population bacteria or the at least two isolated or purified populations of bacteria are selected from the group consisting of the species in Table 1 with an "ei" equal to 1.

In certain aspects, the at least one isolated or purified population bacteria or the at least two isolated or purified populations of bacteria belong to the species, subspecies or bacterial strains identified by NCBI Taxonomy IDs selected from the group consisting of NCBI Taxonomy ID: 717959, 587, 758823, 649756, 44749, 671218, 1264, 1122135, 853, 484018, 46503, 54565, 290052, 216931, 575978, 433321, 1796646, 213810, 228924, 290054, 1509, 1462919, 29375, 337097, 1298596, 487174, 642492, 1735, 1297424, 742766, 46680, 132925, 411467, 1318465, 1852367, 1841857, 169679, 1175296, 259063, 172901, 39488, 57172, 28118, 166486, 28133, 1529, 694434, 1007096, 84030, 56774, 102148, 626947, 216933, 1348613, 1472417, 100176, 824, 1471761, 1297617, 288966, 1317125, 28197, 358743, 264639, 1265, 1335, 66219, 69473, 115117, 341220, 1732, 873513, 396504, 1796619, 45851, 2741, 105841, 86332, 1349822, 84037, 180311, 54291, 1217282, 762984, 1185412, 154046, 626278, 1543, 398512, 69825, 1841867, 1535, 1510, 84026, 1502, 1619234, 39497, 1544, 29343, 649762, 332095, 536633, 1033731, 574930, 742818, 177412, 1121308, 419208, 1673717, 55779, 28117, 626937, 180332, 1776382, 40519, 34062, 40518, 74426, 1216062, 293826, 850, 645466, 474960, 36835, 115544, 1515, 88431, 216932, 1417852, 39492, 1583, 420247, 118967, 169435, 37658, 138595, 31971, 100886, 1197717, 234908, 537007, 319644, 168384, 915173, 95159, 1816678, 626940, 501571, 1796620, 888727, 1147123, 376806, 1274356, 1267, 39495, 404403, 1348, 253314, 258515, 33033, 1118061, 357276, 214851, 320502, 217731, 246787, 29371, 649764, 901, 29374, 33043, 39778, 682400, 871665, 160404, 745368, 408, 1584, 333367, 47246, 1096246, 53342, 438033, 351091, 1796622, 1776384, 817, 48256, 720554, 500632, 36849, 301302, 879970, 655811, 264463, 1532, 285, 995, 242750, 29539, 1432052, 622312, 1796636, 1337051, 328814, 28446, 1492, 820, 39496, 52786, 1549, 1796618, 582, 46507, 109327, 1531, 1382, 33039, 311460, 230143, 216935, 539, 35519, 1681, 328813, 214853, 89014, 1121115, 1585974, 29466, 1363, 292800, 270498, 214856, 142877, 133926, 209880, 179628, 1121102, 105612, 1796615, 39777, 29353, 1579, 163665, 53443, 261299, 1302, 1150298, 938289, 358742, 471875, 938278, 1796613, 1118057, 1077144, 1737, 218205, 1121298, 684066, 433659, 52699, 204516, 706562, 253257, 328812, 1280, 147802, 58134, 1335613, 891, 585394, 1582, 235931, 308994, 1589, 1682, 1736, 28129, 178001, 551788, 2051, 856, 118562, 101070, 515619, 40215, 187979, 82979, 29363, 1776391, 1285191, 84112, 157688, 38304, 36850, 341694, 287, 75612, 818, 371674, 338188, 88164, 588581, 676965, 546271, 1236512, 178338, 862517, 157687, 158, 51048, 1583331, 529, 888745, 394340, 40545, 855, 553973, 938293, 93063, 708634, 179995, 1351, 476652, 1464038, 555088, 237576, 879566, 1852371, 742727, 1377, 35830, 997353, 218538, 83771, 1605, 28111, 131109, 46609, 690567, 46206, 155615, 51616, 40542, 203, 294, 1034346, 156456, 80866, 554406, 796942, 1002367, 29347, 796944, 61592, 487175, 1050201, 762948, 137732, 1211819, 1019, 272548, 1717, 384636, 216940, 2087, 45634, 466107, 1689, 47678, 575, 979627, 840, 1660, 1236517, 617123, 546, 28135, 82171, 483, 501496, 99656, 1379, 84032, 39483, 1107316, 584, 28124, 1033744, 657309, 536441, 76123, 1118060, 89152, 76122, 303, 1541, 507751, 515620, 38302, 53419, 726, 40324, 1796610, 988946, 1852370, 1017, 1168289, 76936, 94869, 1161098, 215580, 1125779, 327575, 549, 1450648 and 478. In specific aspects, the at least one isolated or purified population bacteria or the at least two isolated or purified populations of bacteria are closely related to the species, subspecies or bacterial strains identified by NCBI Taxonomy IDs listed above. For example, in some aspects, the at least one isolated or purified population of bacteria or the at least two isolated or purified populations of bacteria belong to species, subspecies or strains comprises a 16S ribosomal RNA (rRNA) nucleotide sequence that is at least 60%, 65%, 70%, 75%, 80%, 85%, 90%, 91%, 92%, 93%, 94%, 95%, 96%, 97%, 98%, 99% or 100% identical to the 16S rRNA nucleotide sequence of one of the bacteria listed above (i.e., the Set 1 bacteria from Table 1) or bacteria listed in Table 1 and having an ei greater that 0.5 or equal to 1.

In still other aspects, the at least one isolated or purified population bacteria or the at least two isolated or purified populations of bacteria belong to the species, subspecies or bacterial strains selected from the group consisting of *Bacteroides coagulans, Clostridium aldenense, Clostridium aldrichii, Clostridium alkalicellulosi, Clostridium amygdalinum, Clostridium asparagiforme, Clostridium cellulosi, Clostridium citroniae, Clostridium clariflavum* DSM 19732, *Clostridium clostridioforme, Clostridium colinum, Clostridium fimetarium, Clostridium hiranonis, Clostridium hungatei, Clostridium hylemonae* DSM 15053, *Clostridium indolis, Clostridium lactatifermentans, Clostridium leptum, Clostridium methylpentosum, Clostridium oroticum, Clostridium papyrosolvens* DSM 2782, *Clostridium populeti, Clostridium propionicum, Clostridium saccharolyticum, Clostridium scindens, Clostridium sporosphaeroides, Clostridium stercorarium, Clostridium straminisolvens, Clostridium sufflavum, Clostridium termitidis, Clostridium thermosuccinogenes, Clostridium viride, Clostridium xylanolyticum, Desulfotomaculum guttoideum, Eubacterium rectale* ATCC 33656, *Eubacterium dolichum, Eubacterium eligens* ATCC 27750, *Eubacterium hallii, Eubacterium infirmum, Eubacterium siraeum, Eubacterium tenue, Ruminococcus torques, Acetanaerobacterium elongatum, Acetatifactor muris, Acetivibrio cellulolyticus, Acetivibrio ethanolgignens, Acholeplasma brassicae* 0502, *Acholeplasma parvum, Acholeplasma vituli, Acinetobacter junii, Actinobacillus porcinus, Actinomyces bowdenii, Actinomyces dentalis, Actinomyces odontolyticus, Acutalibacter muris, Aerococcus viridans, Aeromicrobium fastidiosum, Alistipes finegoldii, Alistipes obesi, Alistipes onderdonkii, Alistipes putredinis, Alistipes shahii, Alistipes shahii* WAL 8301, *Alistipes timonensis* JC136, *Alkalibacter saccharofermentans, Alkaliphilus metalliredigens* QYMF, *Allisonella histaminiformans, Allobaculum stercoricanis* DSM 13633, *Alloprevotella cava, Alloprevotella tannerae, Anaerobacterium chartisolvens, Anaerobiospirillum thomasii, Anaerobium acetethylicum, Anaerococcus octavius* NCTC 9810, *Anaerococcus provenciensis, Anaerococcus vaginalis* ATCC 51170, *Anaerocolumna jejuensis, Anaerofilum agile, Anaerofustis stercorihominis, Anaeroglobus geminatus, Anaeromassilibacillus senegalensis, Anaeroplasma abactoclasticum, Anaerorhabdus furcosa, Anaerosporobacter mobilis, Anaerostipes butyraticus, Anaerostipes caccae, Anaerostipes hadrus, Anaerotruncus colihominis, Anaerovorax odorimutans, Anoxybacillus rupiensis, Aquabacterium limnoticum, Arcobacter butzleri, Arthrospira platensis, Asaccharobacter celatus, Atopobium parvulum, Bacteroides caccae, Bacteroides caecimuris, Bacteroides cellulosilyticus, Bacteroides clarus* YIT 12056, *Bacteroides dorei, Bacteroides eggerthii, Bacteroides finegoldii, Bacteroides fragilis, Bacteroides gallinarum, Bacteroides massiliensis, Bacteroides oleiciplenus* YIT 12058, *Bacteroides plebeius* DSM 17135, *Bacteroides rodentium* JCM 16496, *Bacteroides thetaiotaomicron, Bacteroides uniformis, Bacteroides xylanisolvens* XB1A, *Bacteroides xylanolyticus, Barnesiella intestinihominis, Beduini massiliensis, Bifidobacterium bifidum, Bifidobacterium dentium, Bifidobacterium longum* subsp. *infantis, Blautia caecimuris, Blautia coccoides, Blautia faecis, Blautia glucerasea, Blautia hansenii* DSM 20583, *Blautia hydrogenotrophica, Blautia luti, Blautia luti* DSM 14534, *Blautia wexlerae* DSM 19850, *Budvicia aquatica, Butyricicoccus pullicaecorum, Butyricimonas paravirosa, Butyrivibrio crossotus, Caldicoprobacter oshimai, Caloramator coolhaasii, Caloramator proteoclasticus, Caloramator quimbayensis, Campylobacter gracilis, Campylobacter rectus, Campylobacter ureolyticus* DSM 20703, *Capnocytophaga gingivalis, Capnocytophaga leadbetteri, Capnocytophaga sputigena, Casaltella massiliensis, Catabacter hongkongensis, Catenibacterium mitsuokai, Christensenella minuta, Christensenella timonensis, Chryseobacterium taklimakanense, Citrobacter freundii, Cloacibacillus porcorum, Clostridioides difficile* ATCC 9689=DSM 1296, *Clostridium amylolyticum, Clostridium bowmanii, Clostridium butyricum, Clostridium cadaveris, Clostridium colicanis, Clostridium gasigenes, Clostridium lentocellum* DSM 5427, *Clostridium oceanicum, Clostridium oryzae, Clostridium paraputrificum, Clostridium pascui, Clostridium perfringens, Clostridium quinii, Clostridium saccharobutylicum, Clostridium sporogenes, Clostridium ventriculi, Collinsella aerofaciens, Comamonas testosteroni, Coprobacter fastidiosus* NSB1, *Coprococcus eutactus, Corynebacterium diphtherias, Corynebacterium durum, Corynebacterium mycetoides, Corynebacterium pyruviciproducens* ATCC BAA-1742, *Corynebacterium tuberculostearicum, Culturomica massiliensis, Cuneatibacter caecimuris, Defluviitalea saccharophila, Delftia acidovorans, Desulfitobacterium chlororespirans, Desulfitobacterium metallireducens, Desulfosporosinus acididurans, Desulfotomaculum halophilum, Desulfotomaculum intricatum, Desulfotomaculum tongense, Desulfovibrio desulfuricans* subsp. *desulfuricans, Desulfovibrio idahonensis, Desulfovibrio litoralis, Desulfovibrio piger, Desulfovibrio simplex, Desulfovibrio zosterae, Desulfuromonas acetoxidans, Dethiobacter alkaliphilus* AHT 1, *Dethiosulfatibacter aminovorans, Dialister invisus, Dialister propionicifaciens, Dielma fastidiosa, Dietzia alimentaria* 72, *Dorea longicatena, Dysgonomonas gadei* ATCC BAA-286, *Dysgonomonas mossii, Eggerthella lenta, Eikenella corrodens, Eisenbergiella tayi, Emergencia timonensis, Enorma massiliensis phi, Enterococcus faecalis, Enterorhabdus muris, Ethanoligenens harbinense* YUAN-3, *Eubacterium coprostanoligenes, Eubacterium limosum, Eubacterium oxidoreducens, Eubacterium sulci* ATCC 35585, *Eubacterium uniforme, Eubacterium ventriosum, Eubacterium xylanophilum, Extibacter muris, Ezakiella peruensis, Faecalibacterium prausnitzii, Faecalicoccus acidiformans, Faecalitalea cylindroides, Filifactor villosus, Flavonifractor plautii, Flintibacter butyricus, Frisingicoccus caecimuris, Fucophilus fucoidanolyticus, Fusicatenibacter saccharivorans, Fusobacterium mortiferum, Fusobacterium nucleatum* subsp. *vincentii, Fusobacterium simiae, Fusobacterium varium, Garciella nitratireducens, Gemella haemolysans, Gemmiger formicilis, Gordonibacter urolithinfaciens, Gracilibacter thermotolerans* JW/YJL-S1, *Granulicatella elegans, Guggenheimella bovis, Haemophi-*

*lus haemolyticus, Helicobacter typhlonius, Hespellia stercorisuis, Holdemanella biformis, Holdemania massiliensis AP2, Howardella ureilytica, Hungatella effluvii, Hungatella hathewayi, Hydrogenoanaerobacterium saccharovorans, Ihubacter massiliensis, Intestinibacter bartlettii, Intestinimonas butyriciproducens, Irregularibacter muris, Kiloniella laminarias DSM 19542, Kroppenstedtia guangzhouensis, Lachnoanaerobaculum orale, Lachnoanaerobaculum umeaense, Lachnoclostridium phytofermentans, Lactobacillus acidophilus, Lactobacillus algidus, Lactobacillus animalis, Lactobacillus casei, Lactobacillus delbrueckii, Lactobacillus fornicalis, Lactobacillus iners, Lactobacillus pentosus, Lactobacillus rogosae, Lactococcus garvieae, Lactonifactor longoviformis, Leptotrichia buccalis, Leptotrichia hofstadii, Leptotrichia hongkongensis, Leptotrichia wadei, Leuconostoc inhae, Levyella massiliensis, Loriellopsis cavernicola, Lutispora thermophila, Marinilabilia salmonicolor JCM 21150, Marvinbryantia formatexigens, Mesoplasma photuris, Methanobrevibacter smithii ATCC 35061, Methanomassiliicoccus luminyensis B10, Methylobacterium extorquens, Mitsuokella jalaludinii, Mobilitalea sibirica, Mobiluncus curtisii, Mogibacterium pumilum, Mogibacterium timidum, Moorella glycerini, Moorella humiferrea, Moraxella nonliquefaciens, Moraxella osloensis, Morganella morganii, Moryella indoligenes, Muribaculum intestinale, Murimonas intestini, Natranaerovirga pectinivora, Neglecta timonensis, Neisseria cinerea, Neisseria oxalis, Nocardioides mesophilus, Novibacillus thermophilus, Ochrobactrum anthropi, Odoribacter splanchnicus, Olsenella profusa, Olsenella uli, Oribacterium asaccharolyticum ACB7, Oribacterium sinus, Oscillibacter ruminantium GHJ, Oscillibacter valericigenes, Oxobacter pfennigii, Pantoea agglomerans, Papillibacter cinnamivorans, Parabacteroides faecis, Parabacteroides goldsteinii, Parabacteroides gordonii, Parabacteroides merdae, Parasporobacterium paucivorans, Parasutterella excrementihominis, Parasutterella secunda, Parvimonas micro, Peptococcus niger, Peptoniphilus duerdenii ATCC BAA-1640, Peptoniphilus grossensis ph5, Peptoniphilus koenoeneniae, Peptoniphilus senegalensis JC140, Peptostreptococcus stomatis, Phascolarctobacterium succinatutens, Phocea massiliensis, Pontibacter indicus, Porphyromonas bennonis, Porphyromonas endodontalis, Porphyromonas pasteri, Prevotella bergensis, Prevotella buccae ATCC 33574, Prevotella denticola, Prevotella enoeca, Prevotella fusca JCM 17724, Prevotella loescheii, Prevotella nigrescens, Prevotella oris, Prevotella pallens ATCC 700821, Prevotella stercorea DSM 18206, Prevotellamassilia timonensis, Propionispira arcuata, Proteus mirabilis, Providencia rettgeri, Pseudobacteroides cellulosolvens ATCC 35603=DSM 2933, Pseudobutyrivibrio ruminis, Pseudoflavonifractor capillosus ATCC 29799, Pseudomonas aeruginosa, Pseudomonas fluorescens, Pseudomonas mandelii, Pseudomonas nitroreducens, Pseudomonas putida, Raoultella ornithinolytica, Raoultella planticola, Raoultibacter massiliensis, Robinsoniella peoriensis, Romboutsia timonensis, Roseburia faecis, Roseburia hominis A2-183, Roseburia intestinalis, Roseburia inulinivorans DSM 16841, Rothia dentocariosa ATCC 17931, Ruminiclostridium thermocellum, Ruminococcus albus, Ruminococcus bromii, Ruminococcus callidus, Ruminococcus champanellensis 18P13=JCM 17042, Ruminococcus faecis JCM 15917, Ruminococcus flavefaciens, Ruminococcus gauvreauii, Ruminococcus lactaris ATCC 29176, Rummeliibacillus pycnus, Saccharofermentans acetigenes, Scardovia wiggsiae, Schlegelella the rmodepolymerans, Sedimentibacter hongkongensis, Selenomonas sputigena ATCC 35185, Slackia exigua ATCC 700122, Slackia piriformis YIT 12062, Solitalea canadensis, Solobacterium moorei, Sphingomonas aquatilis, Spiroplasma alleghenense, Spiroplasma chinense, Spiroplasma chrysopicola, Spiroplasma culicicola, Spiroplasma lampyridicola, Sporobacter termitidis, Staphylococcus aureus, Stenotrophomonas maltophilia, Stomatobaculum longum, Streptococcus agalactiae ATCC 13813, Streptococcus cristatus, Streptococcus equinus, Streptococcus gordonii, Streptococcus lactarius, Streptococcus parauberis, Subdoligranulum variabile, Succinivibrio dextrinosolvens, Sutterella stercoricanis, Sutterella wadsworthensis, Syntrophococcus sucromutans, Syntrophomonas zehndri OL-4, Terrisporobacter mayombei, Thermoleophilum album, Treponema denticola, Treponema socranskii, Tyzzerella nexilis DSM 1787, Vallitalea guaymasensis, Vallitalea pronyensis, Vampirovibrio chlorellavorus, Veillonella atypica, Veillonella denticariosi, Veillonella dispar, Veillonella parvula, Victivallis vadensis, Vulcanibacillus modesticaldus* and *Weissella confusa*.

In certain aspects, the at least one isolated or purified population of bacteria or the at least two isolated or purified populations belong to species of bacteria selected from the species in Table 2 designated with a response status of responder (R). In still further aspects, the at least one isolated or purified population of bacteria or the at least two isolated or purified populations of bacteria belong to species, subspecies or strains comprising a 16S ribosomal RNA (rRNA) nucleotide sequence that is at least 60%, 65%, 70%, 75%, 80%, 85%, 90%, 91%, 92%, 93%, 94%, 95%, 96%, 97%, 98%, 99% or 100% identical to the 16S rRNA nucleotide sequence of bacteria selected from the species in Table 2 designated with a response status of responder (R). In particular aspects, the at least one isolated or purified population of bacteria or the at least two isolated or purified populations of bacteria comprises a 16S ribosomal RNA (rRNA) nucleotide sequence that is at least 60%, 65%, 70%, 75%, 80%, 85%, 90%, 91%, 92%, 93%, 94%, 95%, 96%, 97%, 98%, 99% or 100% identical to the 16S rRNA nucleotide sequence of bacteria selected from the group consisting of the species in Table 2 designated with a response status of responder (R) and having an unadjusted p-value less than 0.1, 0.09, 0.08, 0.07, 0.06, 0.05, 0.04, 0.03, 0.02, or 0.01.

In certain aspects, the at least one isolated or purified population of bacteria or the at least two isolated or purified populations of bacteria comprises a 16S ribosomal RNA (rRNA) nucleotide sequence that is at least 60%, 65%, 70%, 75%, 80%, 85%, 90%, 91%, 92%, 93%, 94%, 95%, 96%, 97%, 98%, 99% or 100% identical to the 16S rRNA nucleotide sequence of bacteria selected from the group consisting of the species in Table 1 designated with a response status of responder (R) and having an unadjusted p-value less than 0.1, 0.09, 0.08, 0.07, 0.06, 0.05, 0.04, 0.03, 0.02, or 0.01. In particular embodiments, the at least one isolated or purified population of bacteria or the at least two isolated or purified populations of bacteria are a species, subspecies or bacterial strains comprising a 16S rRNA gene sequence at least 60%, 65%, 70%, 75%, 80%, 85%, 90%, 91%, 92%, 93%, 94%, 95%, 96%, 97%, 98%, 99% or 100% identical to the sequence of SEQ ID NO: 1-876.

In some aspects, the at least one isolated or purified population of bacteria or the at least two isolated or purified populations belong to species of bacteria selected from the species in Table 2 designated with a response status of responder (R). In particular aspects, the at least one isolated or purified population bacteria or the at least two isolated or purified populations of bacteria belong to species of bacteria selected from the group consisting of the species in Table 2 designated with a response status of responder (R) and having an unadjusted p-value less than 0.1, 0.09, 0.08, 0.07, 0.06, 0.05, 0.04, 0.03, 0.02, or 0.01. In still other aspects, the at least one isolated or purified population of bacteria or the at least two isolated or purified populations of bacteria belong to species, subspecies or strains comprising nucleotide sequences with at least 60%, 65%, 70%, 75%, 80%, 90%, 95%, 96%, 97%, 98%, 99% or 100% percent identity to the co-abundance gene group (CAG) sequences (see, Table 2A) selected from the group consisting of SEQ ID NO: 877-926, SEQ ID NO: 927-976, SEQ ID NO: 977-1026, SEQ ID NO: 1027-1076, SEQ ID NO: 1077-1126, SEQ ID NO: 1127-1176, SEQ ID NO: 1177-1226, SEQ ID NO: 1227-1276, SEQ ID NO: 1277-1326, SEQ ID NO: 1327-1376, SEQ ID NO: 1377-1426, SEQ ID NO: 1427-1476, SEQ ID NO: 1477-1526, SEQ ID NO: 1527-1576, SEQ ID NO: 1577-1626, SEQ ID NO: 1627-1676, SEQ ID NO: 1677-1726, SEQ ID NO: 1727-1776, SEQ ID NO: 1777-1826, SEQ ID NO: 1827-1876, SEQ ID NO: 1877-1926, SEQ ID NO: 1927-1976, SEQ ID NO: 1977-2026, SEQ ID NO: 2027-2076, SEQ ID NO: 2077-2126, SEQ ID NO: 2127-2176, SEQ ID NO: 2177-2226, SEQ ID NO: 2227-2276, SEQ ID NO: 2277-2326, SEQ ID NO: 2327-2376, SEQ ID NO: 2377-2426, SEQ ID NO: 2427-2476, SEQ ID NO: 2477-2526, SEQ ID NO: 2527-2576, SEQ ID NO: 2577-2626 and SEQ ID NO: 2627-2676.

| CAG ID | Sequence Identifiers |
|---|---|
| CAG00327 | SEQ ID NO: 877-926 |
| CAG00659 | SEQ ID NO: 927-976 |
| CAG00492 | SEQ ID NO: 977-1026 |
| CAG00518 | SEQ ID NO: 1027-1076 |
| CAG01146 | SEQ ID NO: 1077-1126 |
| CAG00079 | SEQ ID NO: 1127-1176 |
| CAG00393 | SEQ ID NO: 1177-1226 |
| CAG00766 | SEQ ID NO: 1227-1276 |
| CAG00095 | SEQ ID NO: 1277-1326 |
| CAG00010_1 | SEQ ID NO: 1327-1376 |
| CAG00342 | SEQ ID NO: 1377-1426 |
| CAG00303 | SEQ ID NO: 1427-1476 |
| CAG00337 | SEQ ID NO: 1477-1526 |
| CAG00381 | SEQ ID NO: 1527-1576 |
| CAG00559 | SEQ ID NO: 1577-1626 |
| CAG00570 | SEQ ID NO: 1627-1676 |
| CAG00635 | SEQ ID NO: 1677-1726 |
| CAG00636 | SEQ ID NO: 1727-1776 |
| CAG00660 | SEQ ID NO: 1777-1826 |
| CAG00669 | SEQ ID NO: 1827-1876 |
| CAG00708 | SEQ ID NO: 1877-1926 |
| CAG00773 | SEQ ID NO: 1927-1976 |
| CAG00807 | SEQ ID NO: 1977-2026 |
| CAG00880 | SEQ ID NO: 2027-2076 |
| CAG00907 | SEQ ID NO: 2077-2126 |
| CAG01086 | SEQ ID NO: 2127-2176 |
| CAG01215 | SEQ ID NO: 2177-2226 |
| CAG01277 | SEQ ID NO: 2227-2276 |
| CAG01308 | SEQ ID NO: 2277-2326 |
| CAG00577 | SEQ ID NO: 2327-2376 |
| CAG00506 | SEQ ID NO: 2377-2426 |
| CAG00852 | SEQ ID NO: 2427-2476 |
| CAG01046 | SEQ ID NO: 2477-2526 |
| CAG00320 | SEQ ID NO: 2527-2576 |
| CAG00619 | SEQ ID NO: 2577-2626 |
| CAG01366 | SEQ ID NO: 2627-2676 |

In certain aspects, the at least one isolated or purified population of bacteria or the two populations of bacteria are selected from the group consisting of species, subspecies or strains comprising nucleotide sequences with at least 29% identity to SEQ ID NO: 877-926, at least 16.5% identity to SEQ ID NO: 927-976, at least 48.5% identity to SEQ ID NO: 977-1026, at least 28% identity to SEQ ID NO: 1027-1076, at least 93.5% identity to SEQ ID NO: 1077-1126, at least 99.5% identity to SEQ ID NO: 1127-1176, at least 99.5% identity to SEQ ID NO: 1177-1226, at least 99% identity to SEQ ID NO: 1227-1276, 100% identity to SEQ ID NO: 1277-1326, at least 21.5% identity to SEQ ID NO: 1327-1376, 100% identity to SEQ ID NO: 1377-1426, at least 97% identity to SEQ ID NO: 1427-1476, at least 55.5% identity to SEQ ID NO: 1477-1526, 100% identity to SEQ ID NO: 1527-1576, at least 34% identity to SEQ ID NO: 1577-1626, at least 14% identity to SEQ ID NO: 1627-1676, 100% identity to SEQ ID NO: 1677-1726, at least 93% identity to SEQ ID NO: 1727-1776, 100% identity to SEQ ID NO: 1777-1826, at least 45% identity to SEQ ID NO: 1827-1876, at least 99% identity to SEQ ID NO: 1877-1926, at least 74% identity to SEQ ID NO: 1927-1976, 100% identity to SEQ ID NO: 1977-2026, 100% identity to SEQ ID NO: 2027-2076, at least 20% identity to SEQ ID NO: 2077-2126, at least 84% identity to SEQ ID NO: 2127-2176, at least 35.5% identity to SEQ ID NO: 2177-2226, at least 32.5% identity to SEQ ID NO: 2227-2276, at least 70% identity to SEQ ID NO: 2277-2326, 100% identity to SEQ ID NO: 2327-2376, at least 70.5% identity to SEQ ID NO: 2377-2426, at least 99.5% identity to SEQ ID NO: 2427-2476, at least 68.5% identity to SEQ ID NO: 2477-2526, 100% identity to SEQ ID NO: 2527-2576, at least 97.5% identity to SEQ ID NO: 2577-2626 or 100% identity to SEQ ID NO: 2627-2676.

In certain aspects, the at least one isolated or purified population of bacteria or the two populations of bacteria are selected from the group consisting of species, subspecies or strains comprising nucleotide sequences with at least 29% identity to genes of *Faecalibacterium* sp. CAG:74 corresponding to SEQ ID NO: 877-926, at least 16.5% identity to genes of Clostridiales bacterium NK3B98 corresponding to SEQ ID NO: 927-976, at least 48.5% identity to genes of *Subdoligranulum* sp. 4_3_54 A2FAA corresponding to SEQ ID NO: 977-1026, at least 28% identity to genes of *Faecalibacterium* sp. CAG:74 corresponding to genes of corresponding to SEQ ID NO: 1027-1076, at least 93.5% identity to genes of *Oscillibacter* sp. CAG:155 corresponding to SEQ ID NO: 1077-1126, at least 99.5% identity to genes of *Clostridium* sp. CAG:7 corresponding to SEQ ID NO: 1127-1176, at least 99.5% identity to genes of *Eubacterium* sp. CAG:86 corresponding to SEQ ID NO: 1177-1226, at least 99% identity to genes of *Firmicutes* bacterium CAG:176 corresponding to SEQ ID NO: 1227-1276, 100% identity to genes of *Akkermansia* sp. CAG:344 corresponding to SEQ ID NO: 1277-1326, at least 21.5% identity to genes of *Faecalibacterium* sp. CAG:74 corresponding to SEQ ID NO: 1327-1376, 100% identity to genes of *Bifidobacterium pseudocatenulatum* DSM 20438=JCM 1200=LMG 10505 corresponding to SEQ ID NO: 1377-1426, at least 97% identity to genes of *Clostridium* sp. JCC corresponding to SEQ ID NO: 1427-1476, at least 55.5% identity to genes of *Faecalibacterium prausnitzii* SL3/3 corresponding to SEQ ID NO: 1477-1526, 100% identity to genes of *Clostridium* sp. CAG:242 corresponding to SEQ ID NO: 1527-1576, at least 34% identity to genes of *Clostridium* sp. CAG:226 corresponding to SEQ ID NO: 1577-1626, at least 14% identity to genes of *Ruminococcus* sp. CAG:382 corresponding to SEQ ID NO: 1627-1676, 100% identity to genes of *Bifidobacterium bifidum* S17 corresponding to SEQ ID NO: 1677-1726, at least 93% identity to genes of *Roseburia* sp. CAG:309 corresponding to SEQ ID NO: 1727-1776, 100% identity to genes of *Alistipes timonensis* JC136 corresponding to SEQ ID NO: 1777-1826, at least 45% identity to genes of *Firmicutes* bacterium CAG:103 corresponding to SEQ ID NO: 1827-1876, at least 99% identity to genes of *Alistipes senegalensis* JC50 corresponding to SEQ ID NO: 1877-1926, at least 74% identity to genes of *Firmicutes* bacterium CAG:176 corresponding to SEQ ID NO: 1927-1976, 100% identity to genes of *Holdemanella biformis* DSM 3989 corresponding to SEQ ID NO: 1977-2026, 100% identity to genes of *Subdoligranulum* sp. CAG:314 corresponding to SEQ ID NO: 2027-2076, at least 20% identity to genes of *Clostridium* sp. CAG:226 corresponding to SEQ ID NO: 2077-2126, at least 84% identity to genes of *Firmicutes* bacterium CAG:124 corresponding to SEQ ID NO: 2127-2176, at least 35.5% identity to genes of Intestinimonas butyriciproducens corresponding to SEQ ID NO: 2177-2226, at least 32.5% identity to genes of *Clostridium* sp. CAG:226 corresponding to SEQ ID NO: 2227-2276, at least 70% identity to genes of *Firmicutes* bacterium CAG:124 corresponding to SEQ ID NO: 2277-2326, 100% identity to genes of *Faecalibacterium prausnitzii* L2-6 corresponding to SEQ ID NO: 2327-2376, at least 70.5% identity to genes of Ruminococcaceae bacterium D16 corresponding to SEQ ID NO: 2377-2426, at least 99.5% identity to genes of *Clostridium spiroforme* DSM 1552 corresponding to SEQ ID NO: 2427-2476, at least 68.5% identity to genes of Intestinimonas butyriciproducens corresponding to SEQ ID NO: 2477-2526, 100% identity to genes of *Phascolarctobacterium* sp. CAG:207 corresponding to SEQ ID NO: 2527-2576, at least 97.5% identity to genes of *Faecalibacterium prausnitzii* L2-6 corresponding to SEQ ID NO: 2577-2626 of or 100% identity to genes of *Streptococcus parasanguinis* ATCC 15912 corresponding to SEQ ID NO: 2627-2676.

In some aspects, the bacteria are lyophilized or freeze dried. In particular aspects, the composition is formulated for oral delivery. For example, the composition formulated for oral delivery is a tablet or capsule. In particular aspects, the tablet or capsule comprises an acid-resistant enteric coating. In certain aspects the composition comprising the at least one isolated or purified population of bacteria or the at least two isolated or purified populationss of bacteria is formulated for administration rectally, via colonoscopy, sigmoidoscopy by nasogastric tube, or enema. In some aspects, the composition is lyophilized or is frozen. In certain aspects, the composition is capable of being re-formulated for final delivery as comprising a liquid, a suspension, a gel, a geltab, a semisolid, a tablet, a sachet, a lozenge, a capsule, or as an enteral formulation. In some aspects, the composition is formulated for multiple administrations. In some aspects, the at least one isolated or purified population of bacteria or the at least two isolated or purified populations of bacteria comprises an antibiotic resistance gene. In some aspects, the at least one isolated or purified population of bacteria or the at least two isolated or purified populations of bacteria is a short-chain fatty acid-producing population of bacteria. In certain aspects, the short-chain fatty acid-producing population of bacteria is a butyrate-producing population of bacteria. In particular aspects, at least one immune checkpoint inhibitor is administered intravenously and the butyrate-producing population of bacteria is administered orally.

Embodiments of the present disclosure provide a method of treating cancer in a subject comprising administering a therapeutically effective amount of a short-chain fatty acid, such as butyrate, and/or a short-chain fatty acid-producing bacterial population, such as a butyrate-producing bacterial population, to said subject, wherein the subject has been administered an immune checkpoint inhibitor. In some aspects, the method further comprises administering at least one immune checkpoint inhibitor. In certain aspects, more than one checkpoint inhibitor is administered. In some aspects, the method further comprises administering a prebiotic or probiotic.

In some aspects, the short-chain fatty acid-producing bacterial population comprises bacteria comprising an antibiotic resistance gene. In some aspects, the butyrate-producing bacterial population comprises bacteria comprising an antibiotic resistance gene. In some embodiments, the method further comprises a step of administering such short-chain fatty acid-producing antibiotic resistant bacterial population, for example, such butyrate-producing antibiotic resistant bacterial population, to a subject having cancer. In some embodiments, the method further comprises administering the antibiotic to which the short-chain fatty acid-producing antibiotic resistant bacterial population, such as the butyrate-producing antibiotic resistant bacterial population, are resistant to the subject, wherein the antibiotic resistance gene confers resistance to the antibiotic.

In some aspects, the butyrate-producing bacterial population comprises one or more bacterial species of the order Clostridiales. In certain aspects, the one or more bacterial species are from the family Ruminococcaceae, Christensenellaceae, Clostridiaceae or Coriobacteriaceae. In particular aspects, the one or more bacterial species are selected from the group consisting of *Faecalibacterium prausnitzii, Ruminococcus albus, Ruminococcus bromii, Ruminococcus callidus, Ruminococcus flavefaciens, Ruminococcus champanellensis, Ruminococcus faecis, Ruminococcus gauvreauii, Ruminococcus gnavus, Ruminococcus hansenii, Ruminococcus hydrogenotrophicus, Ruminococcus lactaris, Ruminococcus luti, Ruminococcus obeum, Ruminococcus palustris, Ruminococcus pasteurii, Ruminococcus productus, Ruminococcus schinkii, Ruminococcus torques, Subdoligranulum variabile, Butyrivibrio fibrisolvens, Roseburia intestinalis, Anaerostipes caccae, Blautia obeum, Eubacterium nodatum,* and *Eubacterium oxidoreducens.* In one specific aspect, the one or more bacterial species is *Faecalibacterium prausnitzii*. In particular aspects, the butyrate-producing bacterial population does not comprise bacterial species of the family Prevotellaceae or the order Bacteriodales.

In certain aspects, administering the butyrate comprises administering a butyrate prodrug or salt. In particular aspects, administering butyrate comprises administering sodium butyrate, arginine butyrate, ethylbutyryl lactate, tributyrin, 4-phenyl butyrate, pivaloyloxymethyl butyrate (AN-9) or butylidenedi-butyrate (AN-10).

In some aspects, the butyrate or butyrate-producing bacterial population, are administered orally, rectally, via colonoscopy, sigmoidoscopy, enema or by direct injection. In particular aspects, the at least one immune checkpoint inhibitor is administered intravenously, and the butyrate and/or the butyrate-producing bacterial population is administered orally.

In some aspects, the at least one checkpoint inhibitor is selected from an inhibitor of CTLA-4, PD-1, PD-L1, PD-L2, LAG-3, BTLA, B7H3, B7H4, TIM3, KIR, or A2aR. In certain aspects, the at least one immune checkpoint inhibitor is a human programmed cell death 1 (PD-1) axis-binding antagonist. In some aspects, the PD-1 axis-binding antagonist is selected from the group consisting of a PD-1 binding antagonist, a PDL1-binding antagonist and a PDL2-binding antagonist. In certain aspects, the PD-1 axis-binding antagonist is a PD-1-binding antagonist. In some aspects, the PD-1-binding antagonist inhibits the binding of PD-1 to PDL1 and/or PDL2. In particular aspects, the PD-1-binding antagonist is a monoclonal antibody or antigen binding fragment thereof. In specific aspects, the PD-1-binding antagonist is nivolumab, pembrolizumab, pidillizumab, KEYTRUDA®, AMP-514, REGN2810, CT-011, BMS 936559, MPDL328OA or AMP-224. In some aspects, the at least one immune checkpoint inhibitor is an anti-CTLA-4 antibody. In particular aspects, the anti-CTLA-4 antibody is tremelimumab, YERVOY®, or ipilimumab. In certain aspects, the at least one immune checkpoint inhibitor is an anti-killer-cell immunoglobulin-like receptor (KIR) antibody. In some aspects, the anti-MR antibody is lirilumab.

In certain aspects, the cancer is a skin cancer, such as basal-cell skin cancer, squamous-cell skin cancer or melanoma. In other aspects the skin cancer is a skin cancer selected from the group consisting of dermatofibrosarcoma protuberans, Merkel cell carcinoma, Kaposi's sarcoma, keratoacanthoma, spindle cell tumors, sebaceous carcinomas, microcystic adnexal carcinoma, Paget's disease of the breast, atypical fibroxanthoma, leiomyosarcoma, and angiosarcoma. In particular aspects, the melanoma is metastatic melanoma. In other aspects, the melanoma is Lentigo Maligna, Lentigo Maligna Melanoma, Superficial Spreading Melanoma, Nodular Melanoma, Acral Lentiginous Melanoma or Desmoplastic Melanoma.

In certain aspects, the method further comprises administering at least one additional anticancer treatment. In some aspects, the at least one additional anticancer treatment is surgical therapy, chemotherapy, radiation therapy, hormonal therapy, immunotherapy, small molecule therapy, receptor kinase inhibitor therapy, anti-angiogenic therapy, cytokine therapy, cryotherapy or a biological therapy. In some aspects, the biological therapy is a monoclonal antibody, siRNA, miRNA, antisense oligonucleotide, ribozyme or gene therapy.

In some aspects, the at least one immune checkpoint inhibitor and/or at least one additional anticancer treatment is administered intratumorally, intraarterially, intravenously, intravascularly, intrapleuraly, intraperitoneally, intratracheally, intrathecally, intramuscularly, endoscopically, intralesionally, percutaneously, subcutaneously, regionally, stereotactically, orally or by direct injection or perfusion. In particular aspects, the at least one immune checkpoint inhibitor is administered intravenously, and the butyrate and/or the butyrate-producing bacterial population is administered orally.

Another embodiment provides a method of treating cancer in a subject comprising administering a therapeutically effective amount of an immune checkpoint inhibitor to said subject, wherein the subject has been determined to have a favorable microbial profile in the gut microbiome. In some aspects, a favorable microbial profile is further defined as having: (a) high alpha-diversity of the gut microbiome; (b) a high abundance of short-chain fatty acid-producing bacteria, such as butyrate-producing bacteria, in the gut microbiome; (c) one or more (e.g., 2, 3, 4, 5, 6, 7, 8, 9, 10 or more) bacteria selected from the group consisting of the species in Table 1 with an enrichment index (ei) greater than 0.5, 0.6, 0.7, 0.8 or 0.9 or equal to 1 in the gut microbiome; (d) one or more (e.g., 2, 3, 4, 5, 6, 7, 8, 9, 10 or more) of the bacteria species in Table 2 designated with a response status of responder (R) in the gut microbiome; and/or (e) clusters centered around R-centroid by beta-diversity (by e.g., weighted unifrac distances).

In some aspects, a favorable microbial profile is further defined as the presence or high abundance of bacteria of the phylum Firmicutes, class Clostridia, order Clostridiales, family Ruminococcaceae, genus *Ruminococcus*, genus *Faecalibacterium*, genus *Hydrogenoanaerobacterium*, phylum Actinobacteria, class Coriobacteriia, order Coriobacteriales, family Coriobacteriaceae, domain Archaea, phylum Cyanobacteria, phylum Euryarchaeota, or family Christensenellaceae. In certain aspects, a favorable microbial profile is further defined as the absence or low abundance of bacteria of the species *Escherichia coli*, species *Anerotruncus colihominis*, genus *Dialister*, family Veillonellaceae, phylum Bacteroidetes, class Bacteroidia, order Bacteroidales or family Prevotellaceae. In particular aspects, a favorable microbial profiles is defined as the presence or high abundance of bacteria of the class Clostridiales and the absence or low abundance of bacteria of the order Bacteroidales. In some aspects, a favorable microbial profile is further defined as a high abundance of short-chain fatty acid-producing bacteria, such as butyrate-producing bacteria. In certain aspects, the butyrate-producing bacteria comprises one or more species is from the genus *Ruminococcus* or *Faecalibacterium*.

In some aspects, the subject was determined to comprise a favorable microbial profile or favorable gut microbiome by analyzing the microbiome in a patient sample. In certain aspects, the patient sample is a fecal sample or buccal sample. In some aspects, analyzing comprises performing 16S ribosomal sequencing and/or metagenomics whole genome sequencing.

In a further embodiment, there is provided a method of predicting a response (e.g., patient survival) to an immune checkpoint inhibitor in a patient having a cancer comprising detecting a microbial profile in a sample obtained from said patient, wherein if the microbial profile comprises: (a) high alpha-diversity; (b) a high abundance of short-chain fatty acid-producing bacteria, such as butyrate-producing bacteria; (c) one or more (e.g., 2, 3, 4, 5, 6, 7, 8, 9, 10 or more) bacteria selected from the group consisting of the species in Table 1 with an enrichment index (ei) greater than 0.5, 0.6, 0.7, 0.8 or 0.9 or equal to 1; (d) one or more (e.g., 2, 3, 4, 5, 6, 7, 8, 9, 10 or more) of the bacteria species in Table 2 designated with a response status of responder (R); (e) a low abundance of Bacteriodales; and/or (f) distinct clusters by beta-diversity weighted unifrac distances, then the patient is predicted to have a favorable response to the immune checkpoint inhibitor. In particular embodiments, a patient is administered an immune checkpoint inhibitor if the patient is predicted to have a favorable response to the immune checkpoint inhibitor. In certain embodiments, a patient is administered a second immune checkpoint inhibitor. In certain embodiments the favorable microbial profile is a favorable gut microbial profile.

In certain aspects, the cancer is a skin cancer, such as basal-cell skin cancer, squamous-cell skin cancer or melanoma. In other aspects the skin cancer is a skin cancer selected from the group consisting of dermatofibrosarcoma protuberans, Merkel cell carcinoma, Kaposi's sarcoma, keratoacanthoma, spindle cell tumors, sebaceous carcinomas, microcystic adnexal carcinoma, Paget's disease of the breast, atypical fibroxanthoma, leiomyosarcoma, and angiosarcoma. In other aspects, the melanoma is Lentigo Maligna, Lentigo Maligna Melanoma, Superficial Spreading Melanoma, Nodular Melanoma, Acral Lentiginous Melanoma or Desmoplastic Melanoma. In particular aspects, the immune checkpoint inhibitor is an anti-PD1 monoclonal antibody or an anti-CTLA4 monoclonal antibody.

In some aspects, the short-chain fatty acid-producing bacteria, such as butyrate-producing bacterial population, comprises one or more bacterial species of the order Clostridiales. In certain aspects, the one or more species is from the family Ruminococcaceae, Christensenellaceae, Clostridiaceae or Coriobacteriaceae. In particular aspects, the one or more species are selected from the group consisting of *Faecalibacterium prausnitzii, Ruminococcus albus, Ruminococcus bromii, Ruminococcus callidus, Ruminococcus flavefaciens, Ruminococcus champanellensis, Ruminococcus faecis, Ruminococcus gauvreauii, Ruminococcus gnavus, Ruminococcus hansenii, Ruminococcus hydrogenotrophicus, Ruminococcus lactaris, Ruminococcus luti, Ruminococcus obeum, Ruminococcus palustris, Ruminococcus pasteurii, Ruminococcus productus, Ruminococcus schinkii, Ruminococcus torques, Subdoligranulum variabile, Butyrivibrio fibrisolvens, Roseburia intestinalis, Anaerostipes caccae, Blautia obeum, Eubacterium nodatum,* and *Eubacterium oxidoreducens*. In certain aspects, the one or more species is *Faecalibacterium prausnitzii*.

In additional aspects, the method further comprises administering an immune checkpoint inhibitor to a subject predicted to have a favorable response to the immune checkpoint inhibitor. In some aspects, the immune checkpoint inhibitor is an anti-PD1 monoclonal antibody or an anti-CTLA4 monoclonal antibody.

In some aspects, the method further comprises administering at least one additional anticancer treatment. In certain aspects, the at least one additional anticancer treatment is surgical therapy, chemotherapy, radiation therapy, hormonal therapy, immunotherapy, small molecule therapy, receptor kinase inhibitor therapy, anti-angiogenic therapy, cytokine therapy, cryotherapy or a biological therapy. In particular aspects, the at least one additional anticancer treatment is a short-chain fatty acid, such as butyrate, and/or a short-chain fatty acid-producing bacterial population, such as a butyrate-producing bacterial population. In specific aspects, the at least one anticancer treatment is a composition of the embodiments. In some aspects, the method further comprises administering a prebiotic or probiotic.

In another embodiment, there is provided a method of predicting a response to an immune checkpoint inhibitor in a patient having a cancer comprising detecting a microbial profile in a sample obtained from said patient, wherein if the microbial profile comprises: (a) a low abundance of short-chain fatty acid-producing bacteria, such as butyrate-producing bacteria; (b) one or more of the bacteria species in Table 2 designated with a response status of non responder (NR); (c) low alpha diversity; and/or (d) a high amount of the order Bacteriodales, then the patient is predicted to not have a favorable response to the immune checkpoint inhibitor. In further aspects, the method further comprises administering to the patient a probiotic or live bacterial product composition of the embodiments if the patient is predicted to not have a favorable response to the immune checkpoint inhibitor. In still further aspects, a patient predicted to not have a favorable response to an immune checkpoint inhibitor is administered an immune checkpoint inhibitor after administration of a prebiotic or live bacterial product composition of the embodiments.

In additional aspects, the method further comprises administering at least one non-immune checkpoint inhibitor additional anticancer treatment to a subject predicted to not have a favorable response to the immune checkpoint inhibitor.

In further aspects, the method comprises administering at least one anticancer treatment to the subject. In some aspects, the at least one anticancer treatment is surgical therapy, chemotherapy, radiation therapy, hormonal therapy, immunotherapy, small molecule therapy, receptor kinase inhibitor therapy, anti-angiogenic therapy, cytokine therapy, cryotherapy, an immune checkpoint inhibitor, a second immune checkpoint inhibitor or a biological therapy. In particular aspects, the at least one additional anticancer treatment is a short-chain fatty acid, such as butyrate and/or a short-chain fatty acid-producing bacterial population, such as a butyrate-producing bacterial population. In some aspects, the anti-cancer therapy is a prebiotic or probiotic. In specific aspects, the probiotic is a probiotic composition of the embodiments.

In certain aspects, the cancer is a skin cancer, such as basal-cell skin cancer, squamous-cell skin cancer or melanoma. In other aspects the skin cancer is a skin cancer selected from the group consisting of dermatofibrosarcoma protuberans, Merkel cell carcinoma, Kaposi's sarcoma, keratoacanthoma, spindle cell tumors, sebaceous carcinomas, microcystic adnexal carcinoma, Paget's disease of the breast, atypical fibroxanthoma, leiomyosarcoma, and angiosarcoma. In other aspects, the melanoma is Lentigo Maligna, Lentigo Maligna Melanoma, Superficial Spreading Melanoma, Nodular Melanoma, Acral Lentiginous Melanoma or Desmoplastic Melanoma.

In some aspects, if the microbial profile comprises one or more of the bacteria species in Table 2 designated with a response status of non responder (NR) or a high amount of the order Bacteriodales, then the patient is predicted to not have a favorable response to the immune checkpoint inhibitor. In some aspects, if the microbial profile comprises 1, 2, 3, 4, 5, 6, 7, 8, 9, 10 or more of the bacteria species in Table 2 designated with a response status of non responder (NR), then the patient is predicted to not have a favorable response to the immune checkpoint inhibitor. In further aspects, the method comprises administering to the patient a probiotic or live bacterial product composition of the embodiments.

Other objects, features and advantages of the present invention will become apparent from the following detailed description. It should be understood, however, that the detailed description and the specific examples, while indicating preferred embodiments of the invention, are given by way of illustration only, since various changes and modifications within the spirit and scope of the invention will become apparent to those skilled in the art from this detailed description.

BRIEF DESCRIPTION OF THE DRAWINGS

The following drawings form part of the present specification and are included to further demonstrate certain aspects of the present invention. The invention may be better understood by reference to one or more of these drawings in combination with the detailed description of specific embodiments presented herein.

FIGS. 1A-G: Increased diversity of the gut microbiome is associated with enhanced responses to PD-1 blockade in patients with metastatic melanoma. (A) Schema of sample collection and analyses. (B) Stacked bar plot of phylogenetic composition of common bacterial taxa (>0.1% abundance) at the order level in oral (n=109, top) and fecal (n=53, bottom) samples by 16S rRNA sequencing. (C) Bipartite network diagram of matched oral and fecal samples from 48 anti-PD-1-treated patients. Edges connect species level OTUs to sample nodes in which they are found. (D) Inverse Simpson diversity scores of the gut microbiome in R (n=30) and NR (n=13) to anti-PD-1 therapy by Mann-Whitney (MW) test. (E) Phylogenetic composition of 39 fecal samples at the family level (>0.1% abundance) at baseline. High (>11.63, n=13), intermediate (7.46-11.63, n=13) and low (<7.46, n=13) diversity groups were determined using tertiles of Inverse Simpson scores. (F) Kaplan-Meier (KM)

Figure 1A:
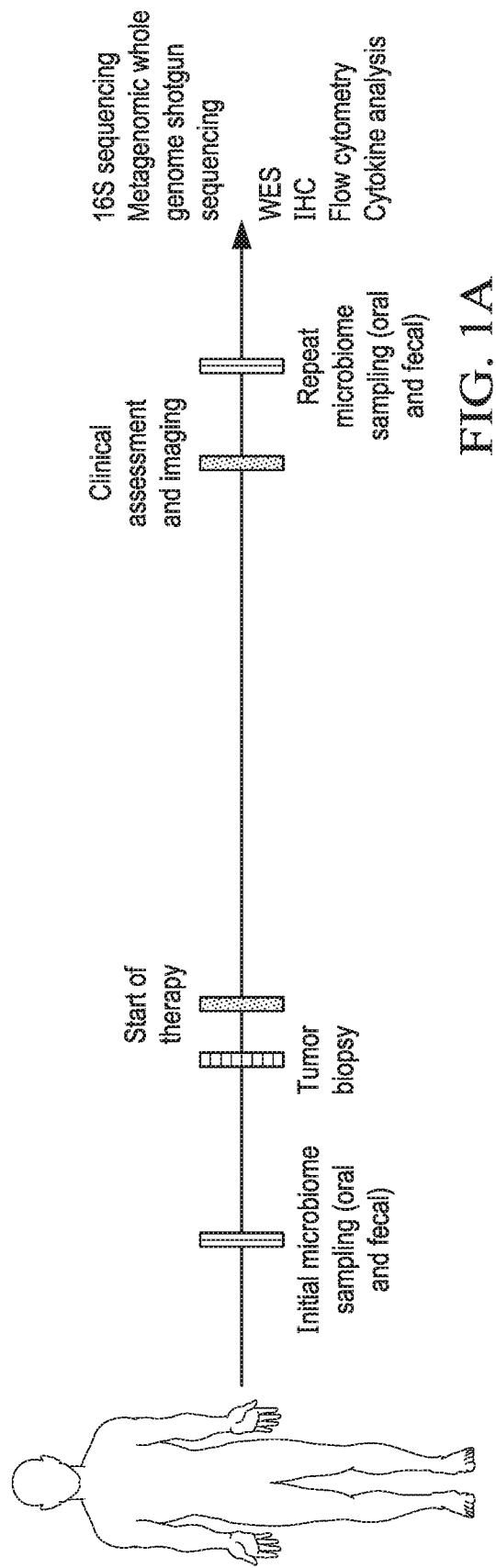

plot of progression-free survival (PFS) by fecal diversity; high (median PFS undefined), intermediate (median PFS=232 days), and low (median PFS=188 days). High vs intermediate diversity (HR=3.60, 95% C.I.=1.02-12.74) and high vs low (Low HR=3.57, 95% C.I.=1.02-12.52) by univariate Cox model. *p<0.05, **p<0.01. (G) Principal coordinate analysis of fecal samples (n=43) by response using Weighted UniFrac distances.

FIGS. 2A-F: Compositional differences in the gut microbiome are associated with responses to PD-1 blockade. (A) Heatmap of OTU abundances in R (n=30) and NR (n=13). Columns denote patients and rows denote bacterial species grouped according to their enrichment in R versus NR into 3 sets. (B) Phylogenetic composition of OTUs within each set at the order level. (C) Taxonomic cladogram from LEfSe showing differences in fecal taxa. Dot size is proportional to the abundance of the taxon. (D) LDA scores computed for differentially-abundant taxa in the fecal microbiomes of R and NR, as indicated. Length indicates effect size associated with a taxon. p=0.05 for the Kruskal-Wallis test; LDA score >3. (E) Differentially-abundant gut bacteria in R vs NR by MW test (FDR-adjusted) within all taxonomic levels. (F) Pairwise comparisons of abundances of bacterial species identified by metagenomic WGS in 25 fecal samples: R (n=14), NR (n=11). *p<0.05, **p<0.01.

FIGS. 3A-F: Abundance of crOTUs within the gut microbiome is predictive of response to PD-1 blockade. (A) Unsupervised hierarchical clustering by complete linkage of crOTU abundances in 43 fecal samples. (B) Association of crOTU clusters with response to anti-PD-1 by Fisher's exact test. crOTU Cluster 1 (n=14: R=14, NR=0); Cluster 2 (n=29: R=16, NR=13). (C) KM plot of PFS by crOTU cluster. crOTU cluster 1 (median PFS undefined), crOTU cluster 2 (median PFS=242 days). (D) Differentially-abundant fecal taxa in crOTU cluster 1 vs crOTU cluster 2, by MW test (FDR-adjusted) within all taxonomic levels. (E) PFS in patients with high (n=19, median PFS undefined) or low (n=20, median PFS=242 days) abundance of $F.$ $prausnitzii$ (top) or high (n=20, median PFS=188 days) or low (n=19, median PFS=393 days) abundance of Bacteroidales (bottom). (F) Unsupervised hierarchical clustering of pathway class abundances inferred from MetaCyc pathways predicted in 28 fecal samples from 25 patients (R=14, NR=11). Regular type: biosynthetic pathways, Bold type: degradative pathways. *p<0.05.

FIGS. 4A-G: A favorable gut microbiome is associated with systemic anti-tumor immunity. (A) Quantification by IHC of the CD8$^+$ infiltrate at pre-treatment in counts/mm$^2$ in R (n=15) and NR (n=6) by one-sided MW test. *p=0.04. (B) Pairwise Spearman rank correlation heatmap of significantly different taxa in fecal samples (n=15) at baseline and CD3, CD8, PD-1, FoxP3, GzmB and RORγT density in counts/mm$^2$ and PD-L1 by H-score in matched tumors. (C) Univariate linear regression between CD8$^+$ counts/mm$^2$ in the tumor versus $Faecalibacterium$ (open circles and dashed line; r$^2$=0.42, p=0.0067) and Bacteroidales (solid circles and solid line; r$^2$=0.056, p=0.38) abundance in the gut. (D) Pairwise Spearman rank correlation heatmap between significantly different fecal taxa and frequency of CD4$^+$ effector T cells, CD8$^+$ T cells, myeloid dendritic cells, monocytes, B cells, Tregs, and MDSCs by flow cytometry in peripheral blood at baseline. (E) Multiplex IHC showing representative images and (F) frequency of immune cells, lymphoid cells, myeloid cells, and MHC II in patients having high $Faecalibacterium$ or high Bacteroidales in the gut. (G) Proposed mechanism of action of the gut microbiome on tumor immunity in favorable and unfavorable conditions.

Figure 5A:
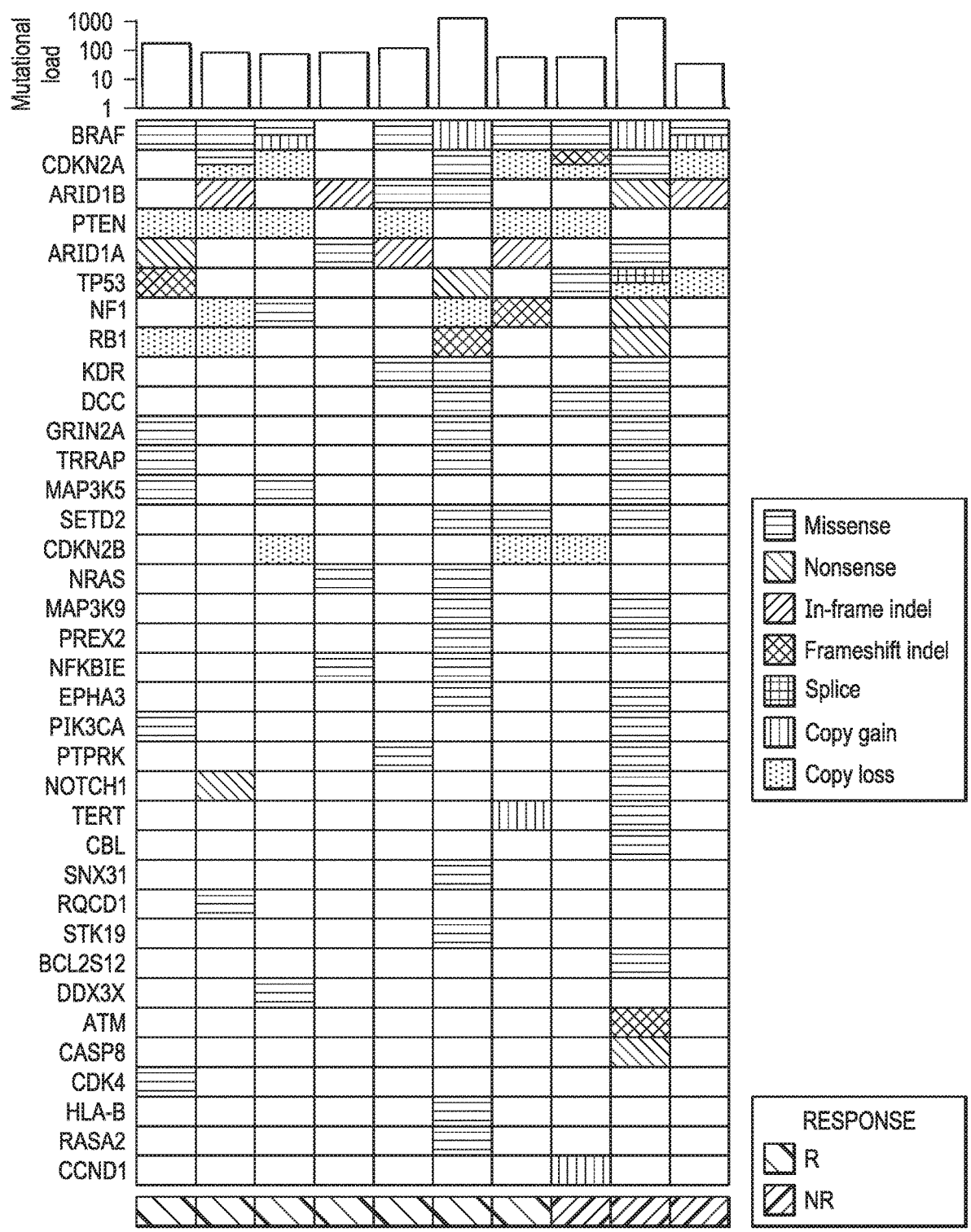

FIGS. 5A-B. No differences are observed in the mutational landscape of R and NR to PD-1 blockade. (A) Number of mutations per megabase and landscape of driver mutations in tumors of patients with matched fecal microbiome samples (n=7R vs 3NR). (B) Total non-synonymous mutational burden in available tumors (n=8R vs 4NR, p=0.683), by two-sided Mann-Whitney (MW) test.

Figure 6:
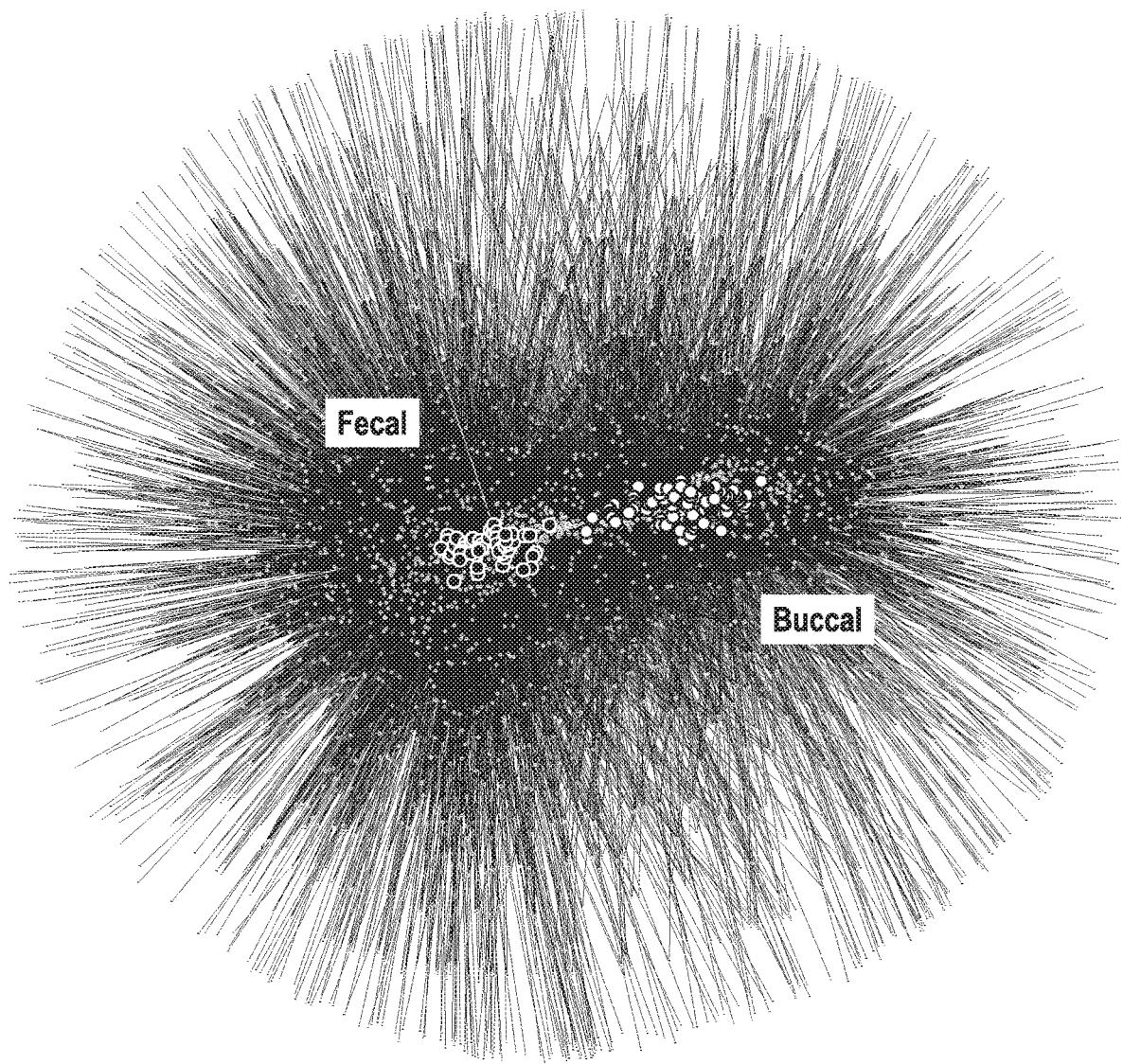

FIG. 6: Differences in community structure between the oral and fecal microbiomes. Bipartite network diagram of bacterial 16S rRNA derived operational taxonomic units (OTU) from 109 buccal and 53 fecal samples. Edges connect species-level OTUs (diamonds) to sample nodes from oral (open circles) and fecal (filled circles) in which they are found.

Figure 7A:
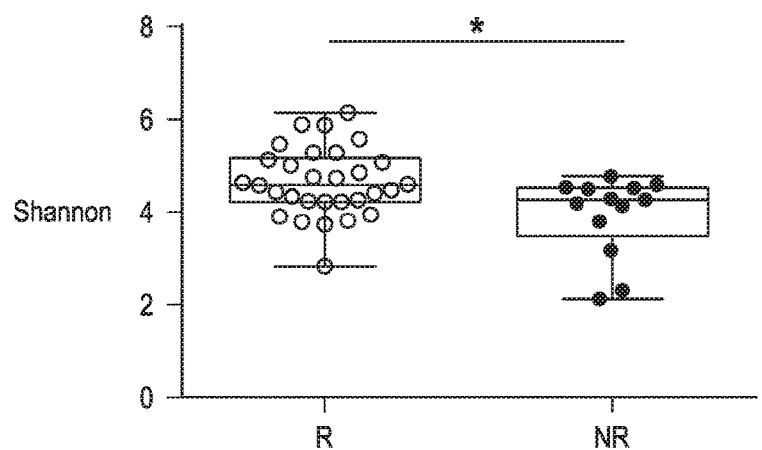
Figure 7B:
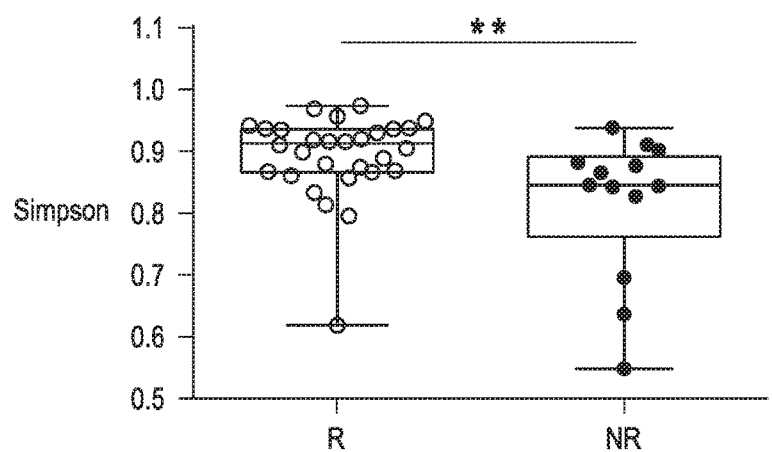
Figure 7C:
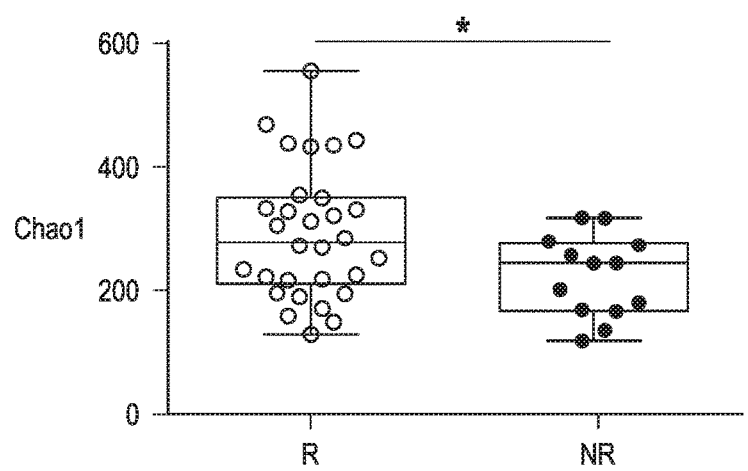
Figure 8A:
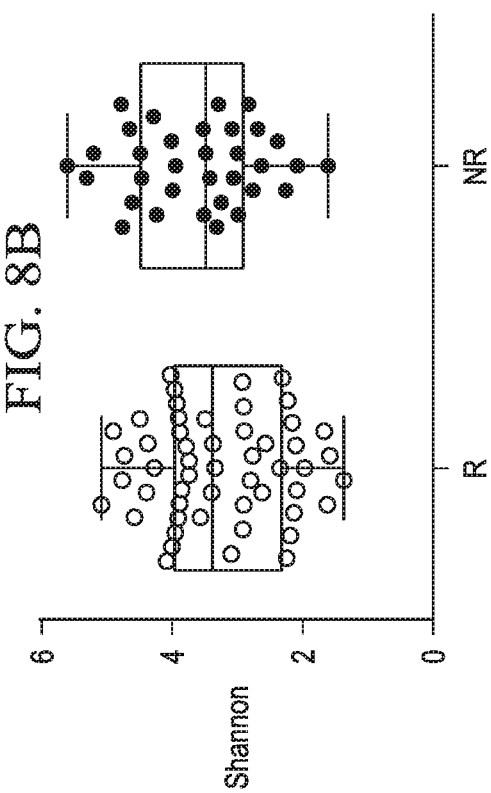
Figure 8B:
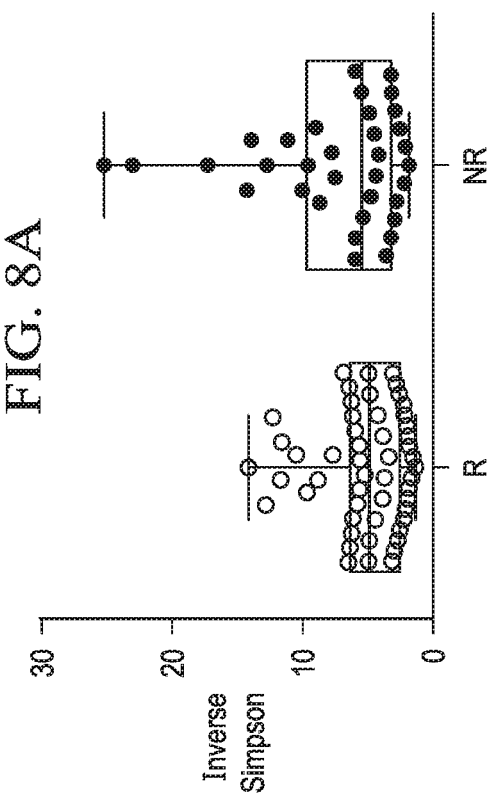
Figure 8C:
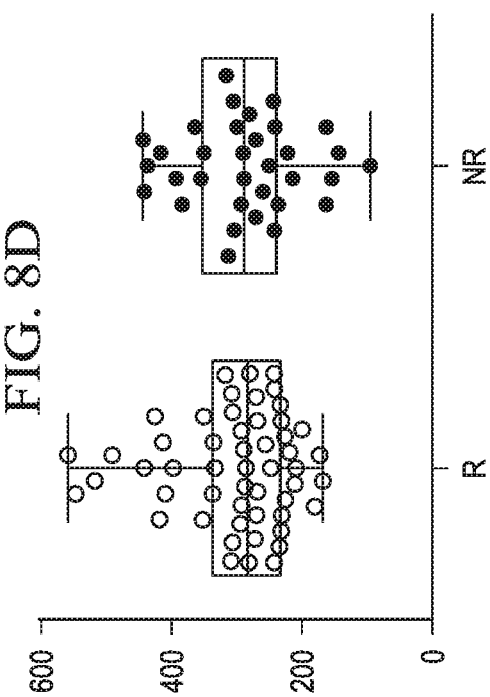
Figure 8D:
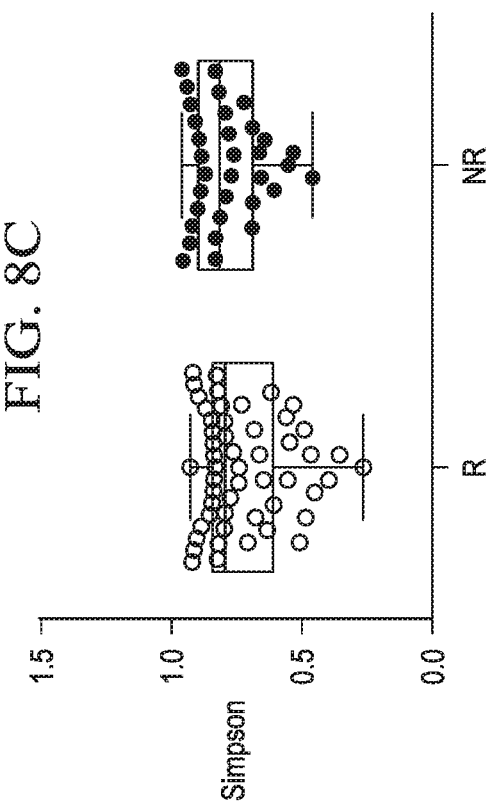

FIGS. 7A-C: Diversity of the fecal microbiome is increased in R to anti-PD-1 therapy. Comparison of alpha-diversity scores in R (n=30, open cirles) and NR (n=13, filled cirles) using the (A) Shannon, (B) Simpson and (C) Chao1 indices by two-sided MW test. *p<0.05, **p<0.01.

FIGS. 8A-D: No differences are observed in the diversity of the oral microbiome between R and NR to anti-PD-1 therapy. Comparison of alpha-diversity scores in R (n=54, open cirles) and NR (n=32, filled cirles) using the (A) Inverse Simpson (p=0.107), (B) Shannon (p=0.139), (C) Simpson (p=0.136) and (D) Chao1 (p=0.826) indices, by two-sided MW test.

Figure 9A:
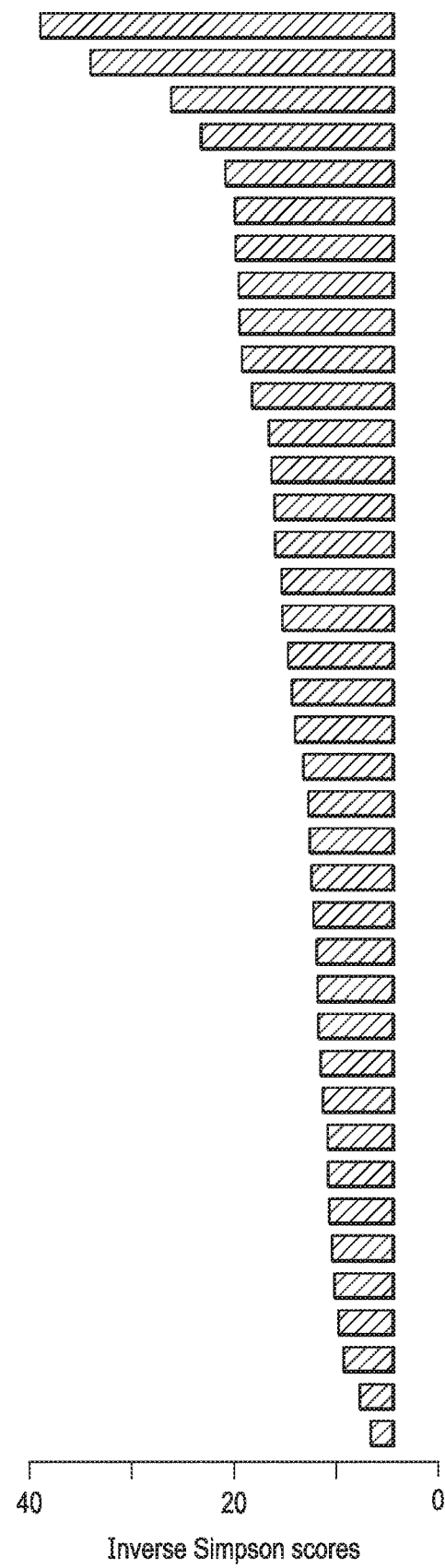
Figure 9B:
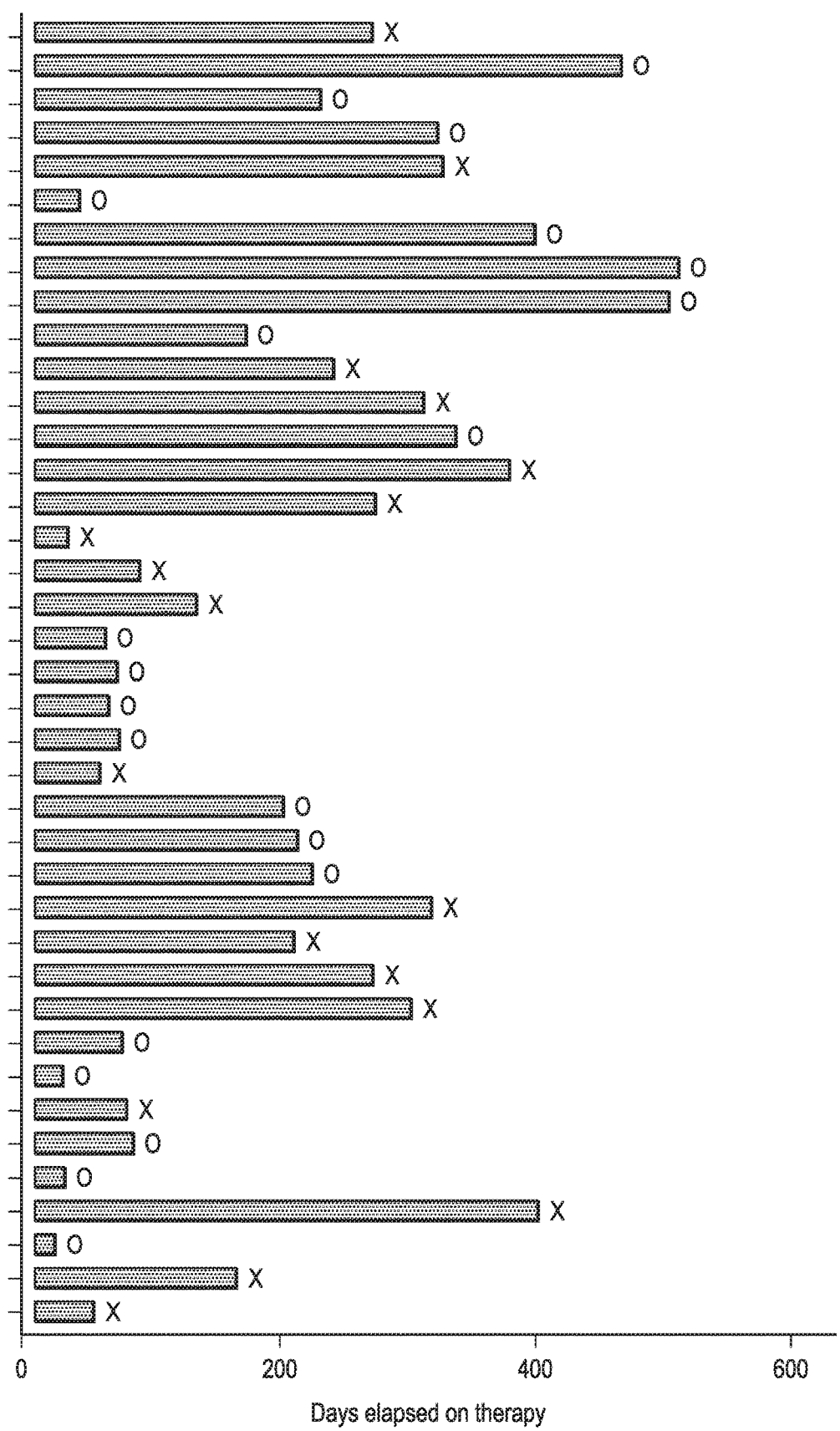
Figure 10A:
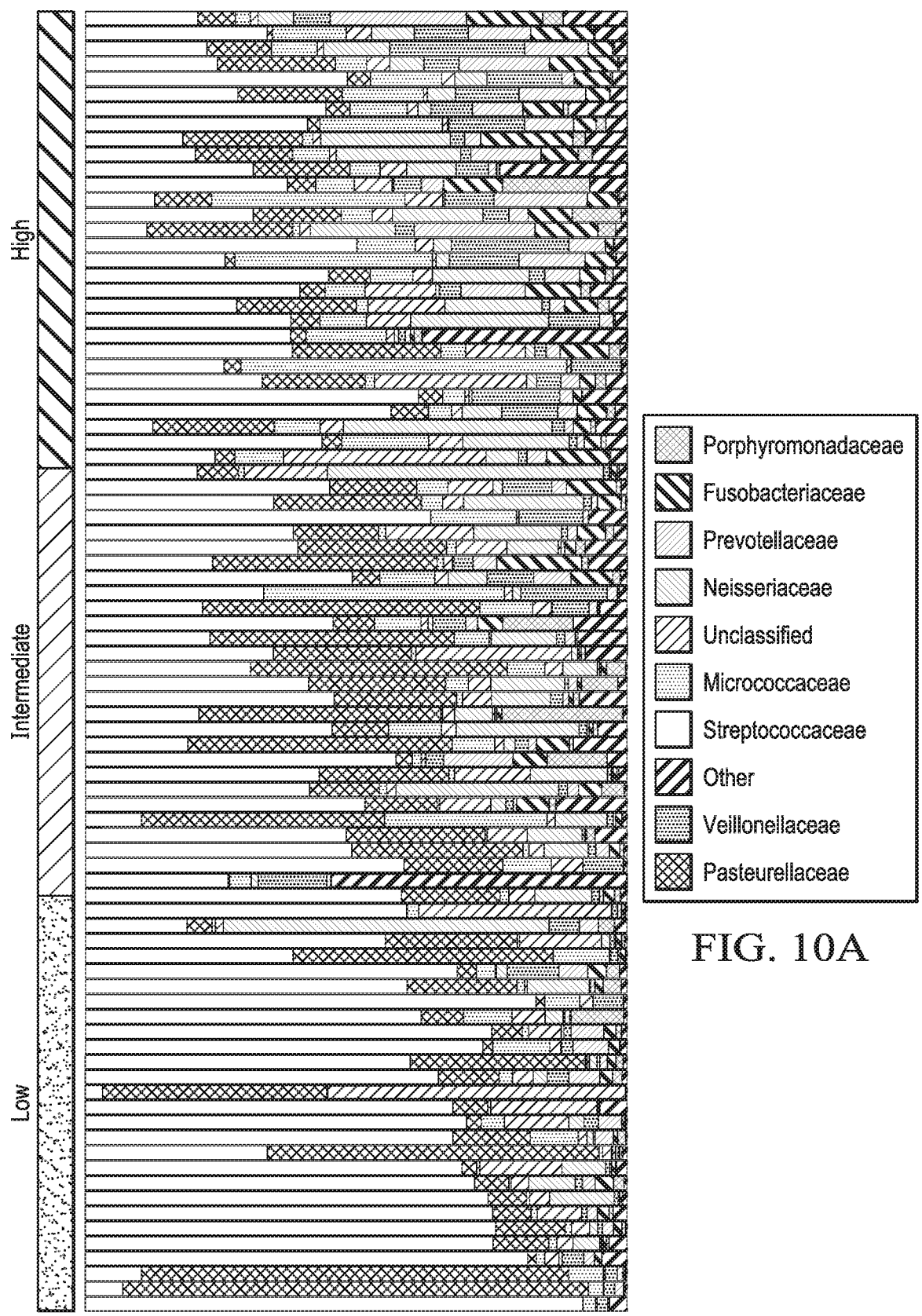
Figure 10B:
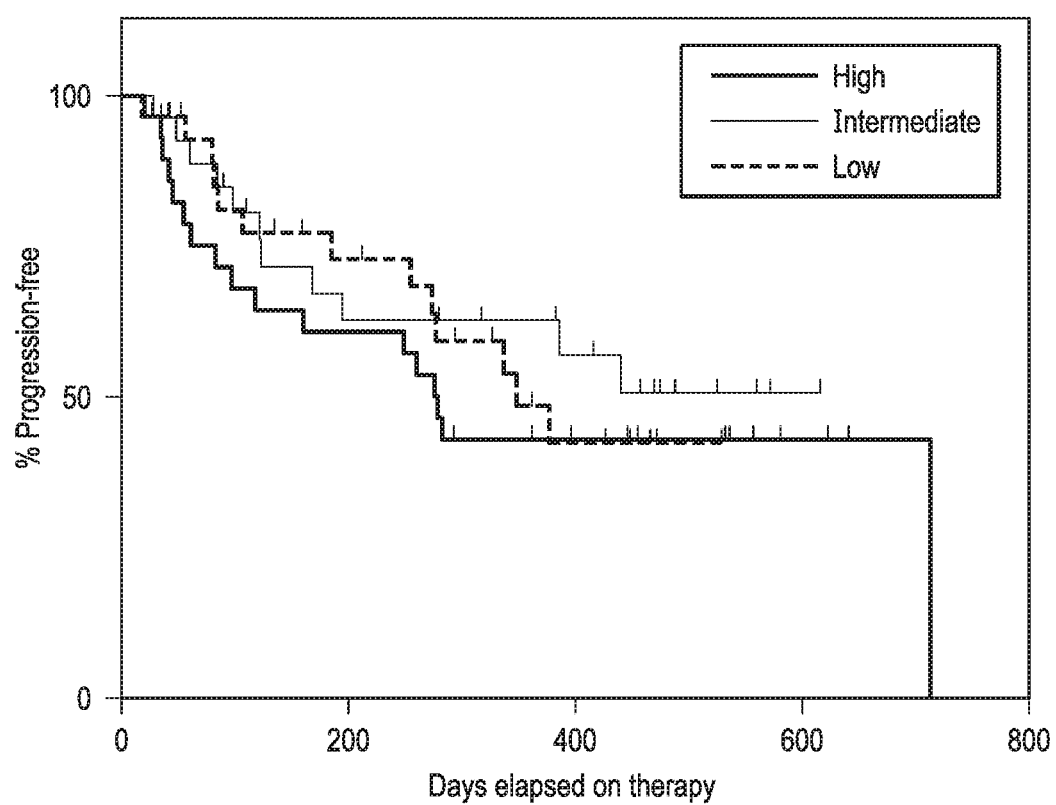
Figure 10C:
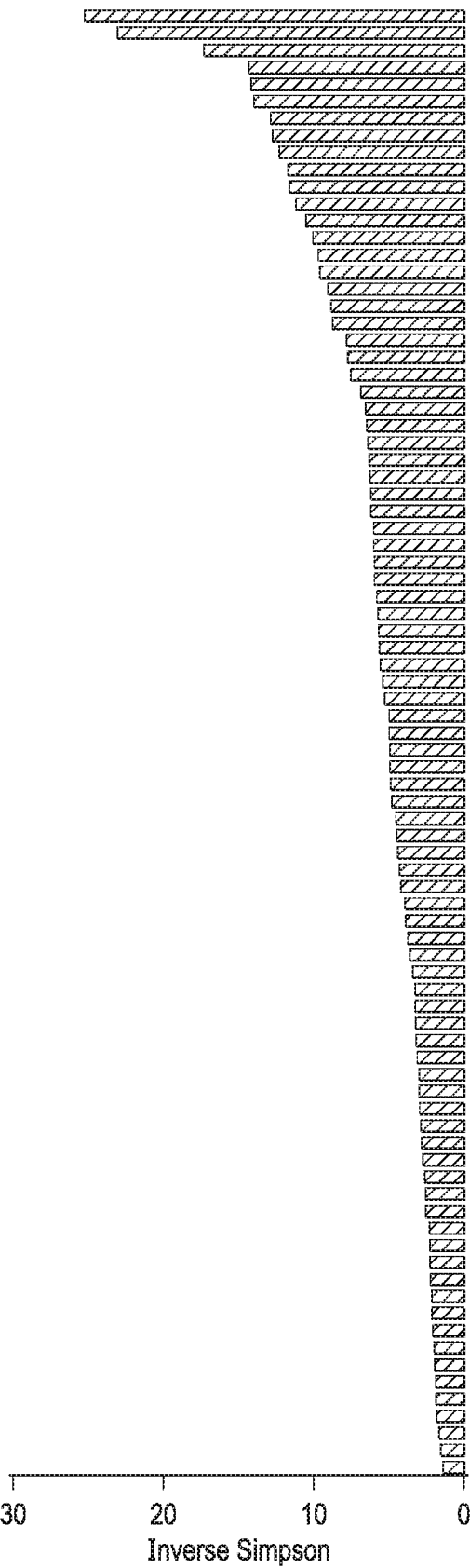
Figure 10D:
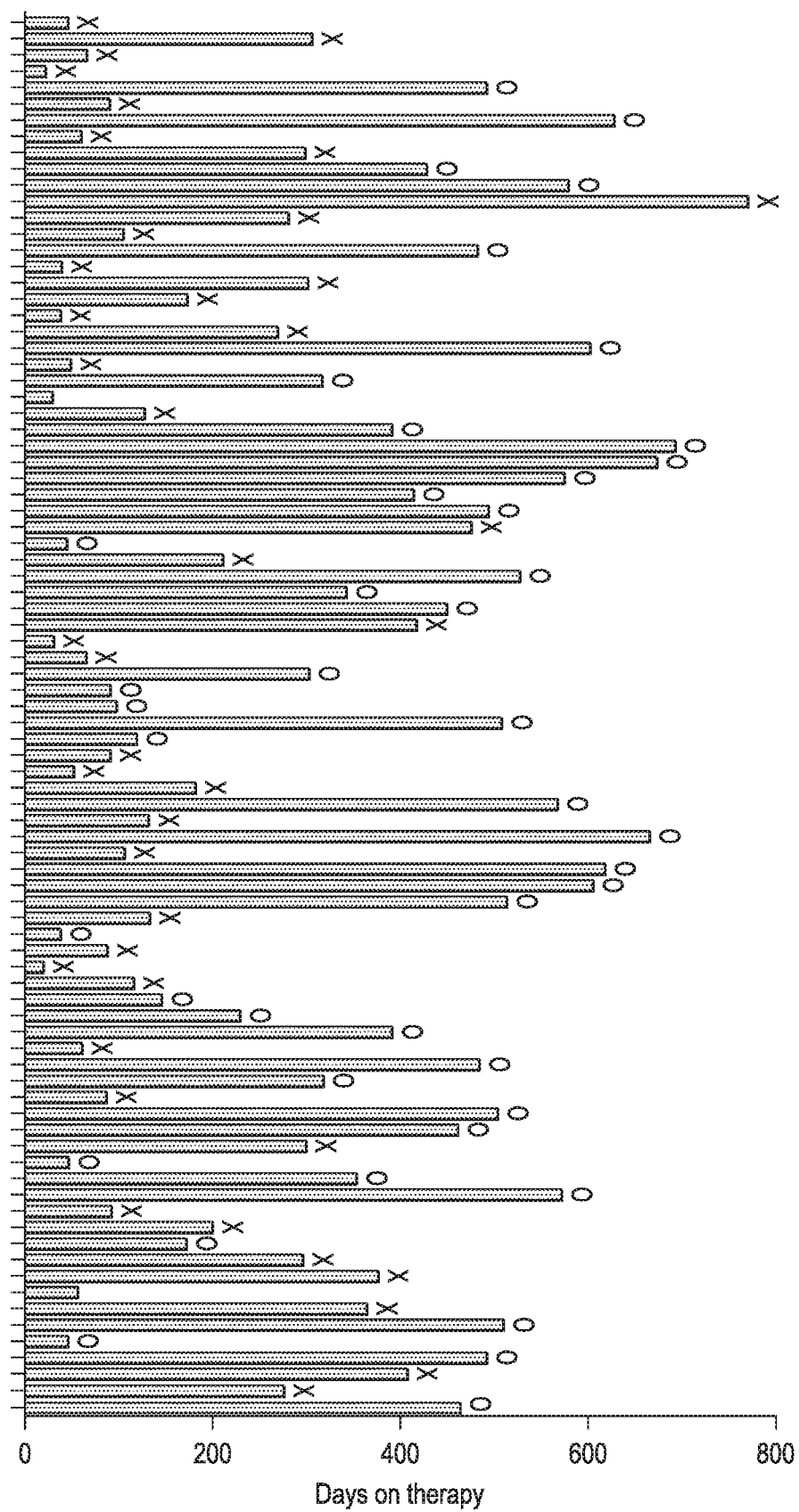
Figure 11A:
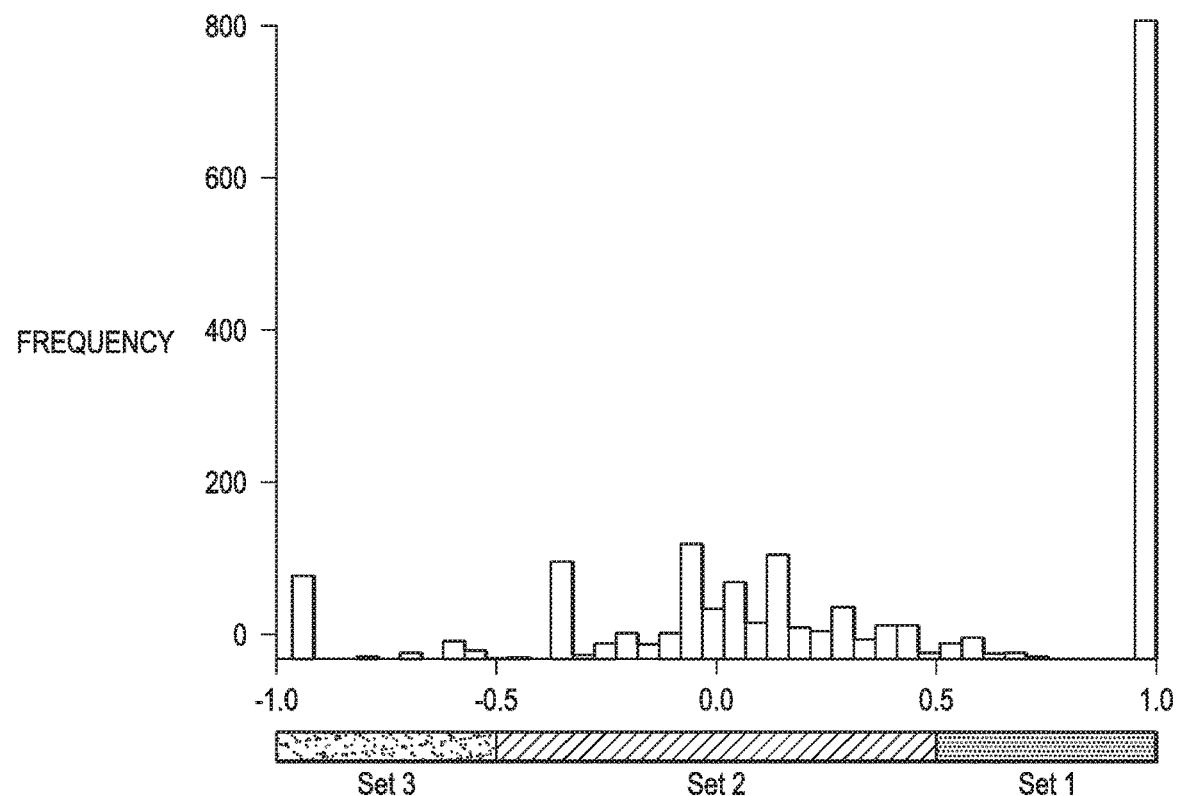
Figure 11B:
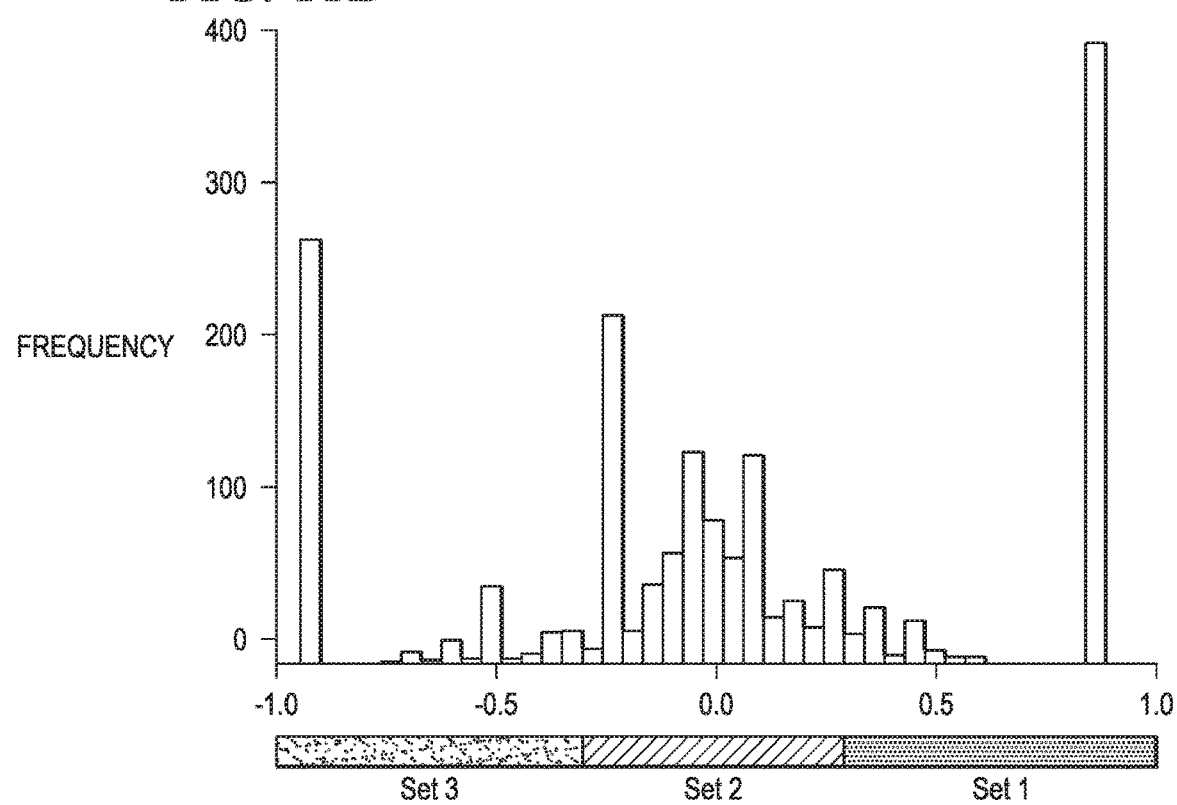
Figure 11C:
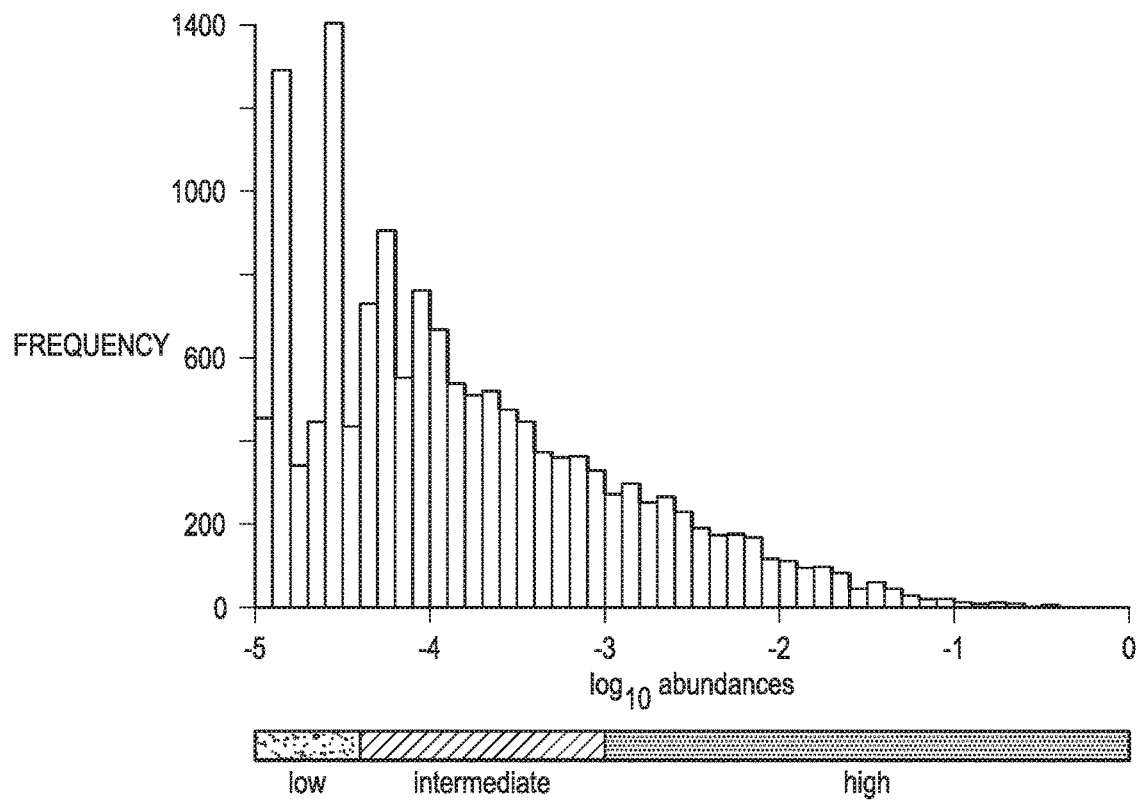
Figure 11D:
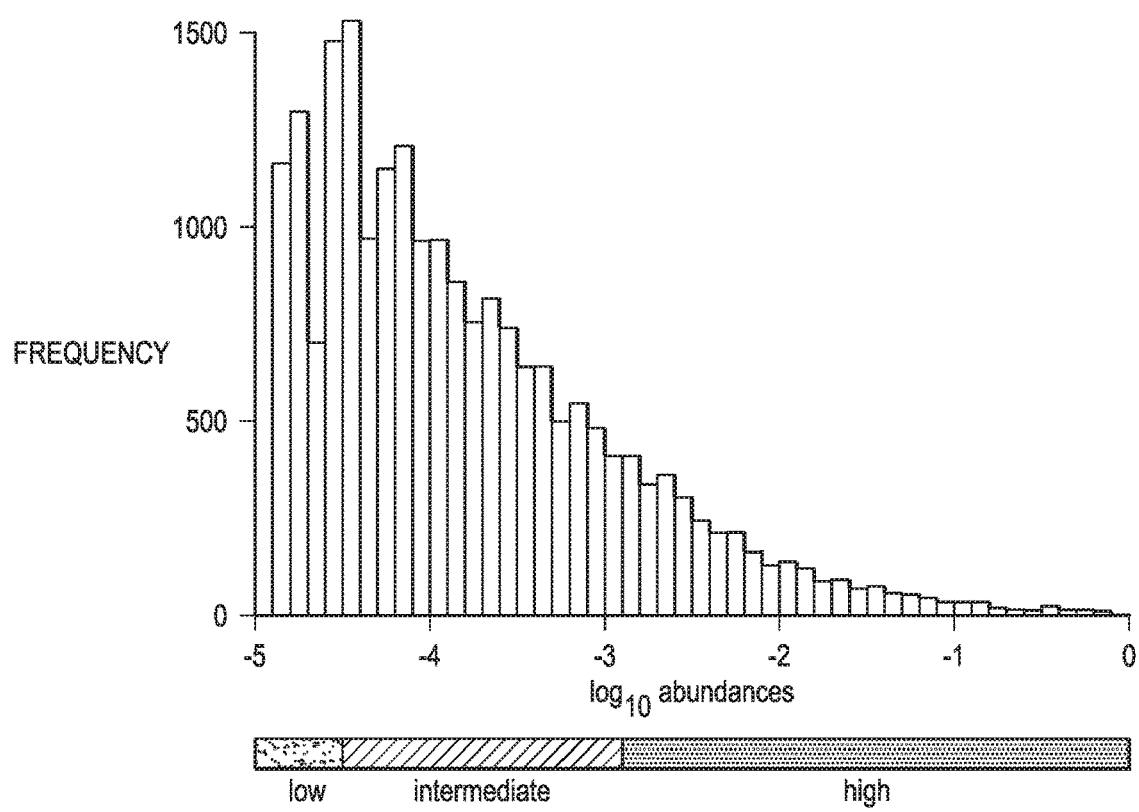

FIGS. 9A-B: High diversity of the fecal microbiome is associated with longer PFS. Gut microbiota at baseline and subsequent treatment course by subject (n=39). (A) Horizontal bars represent alpha diversity scores measured by Inverse Simpson index in each patient. (B) Timeline plots showing days elapsed on therapy. x=progressed, o=not progressed at last follow-up.

FIGS. 10A-D: Diversity of the oral microbiome is not associated with PFS. Oral microbiota and subsequent treatment course by patient (n=86). (A) Stacked bars represent the phylogenetic composition of each sample at the family level at baseline. All patients were classified into high (>6.17), intermediate (3.26-6.17) and low (<3.26) diversity groups, as indicated, based on tertiles of Inverse Simpson scores. (B) Kaplan-Meier plot of progression-free survival by oral diversity tertiles: high (n=29, median PFS=279 days), intermediate (n=28, median PFS undefined), low (n=29, median PFS=348 days), as indicated. High vs intermediate, p=0.34; high vs low, p=0.54 by log-rank test. (C) Horizontal bars represent alpha-diversity scores measured by Inverse Simpson index. (D) Timeline plots showing days elapsed on therapy. x=progressed, o=not progressed at last follow-up.

FIGS. 11A-D: Thresholds for enrichment index (ei) scores and relative abundances for OTUs in 86 oral and 43 fecal microbiome samples. Distribution of enrichment scores for bacterial OTUs at the species level in (A) fecal and (B) oral microbiome samples by Set. The boundaries for each set are indicated. Distribution of log$_{10}$ relative abundance of species in (C) fecal and (D) oral microbiome samples. The range for each abundance category is indicated.

Figure 12A:
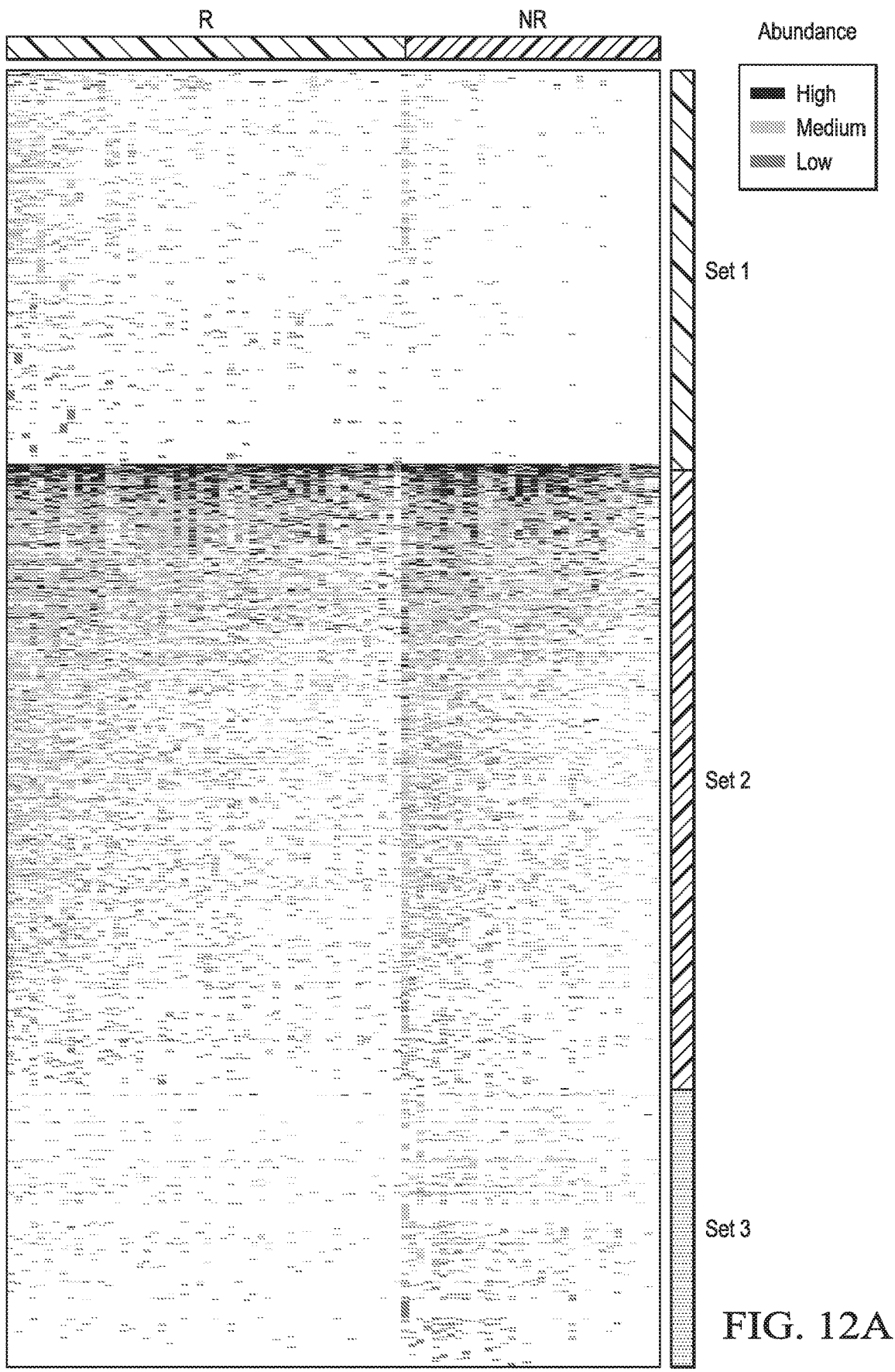
Figure 12B:
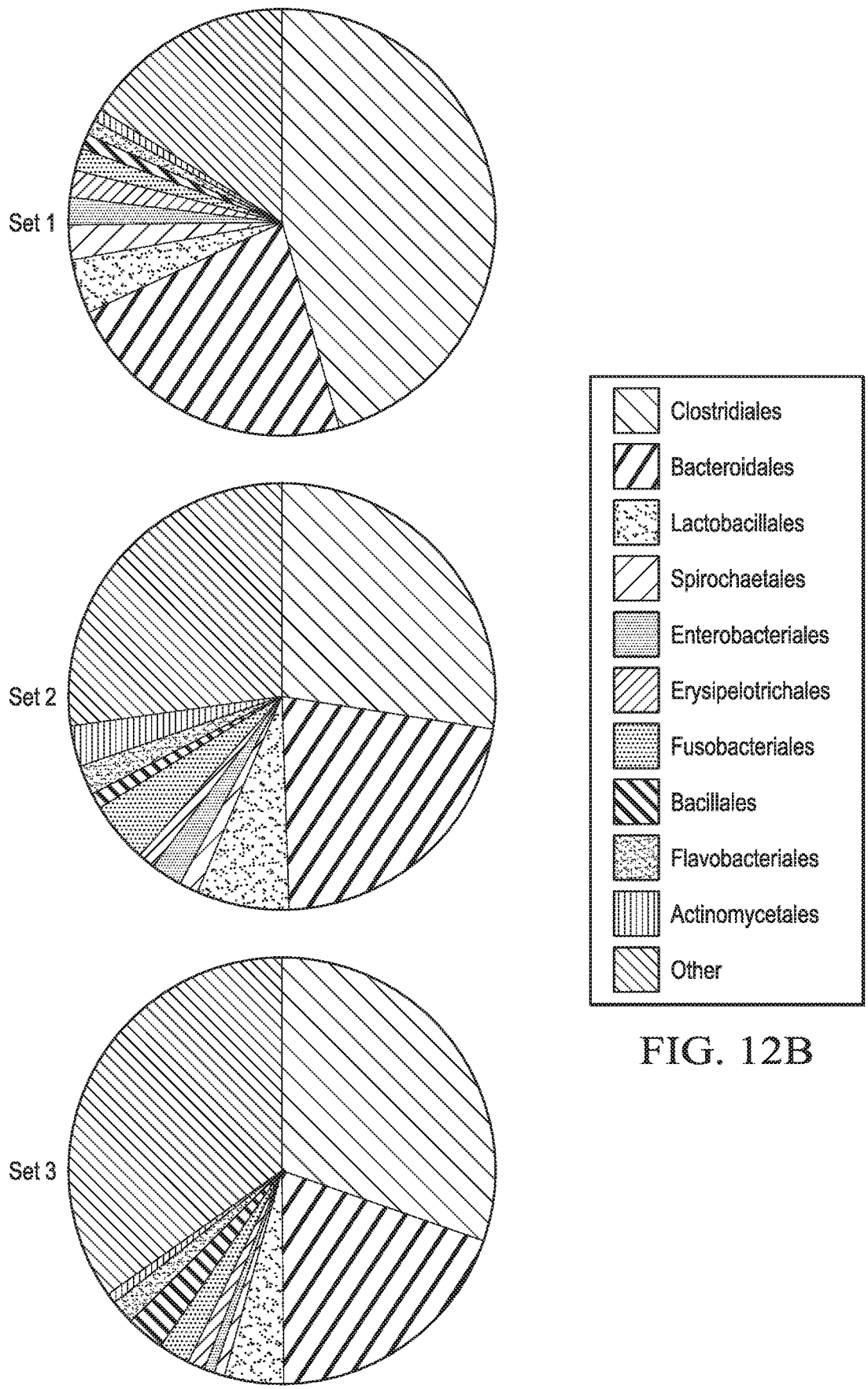

FIGS. 12A-B: No significant differences in oral microbiome OTUs between R and NR to anti-PD-1 therapy by enrichment index (ei) score. (A) Heatmap of species abundance in R (n=52) and NR (n=34), as indicated, by set of bacterial OTUs based on ei scores. Each column denotes a patient and each row denotes a bacterial OTU. High, intermediate, and low are indicated. (B) Phylogenetic composition of bacterial OTUs within each set at the order level.

Figure 13A:
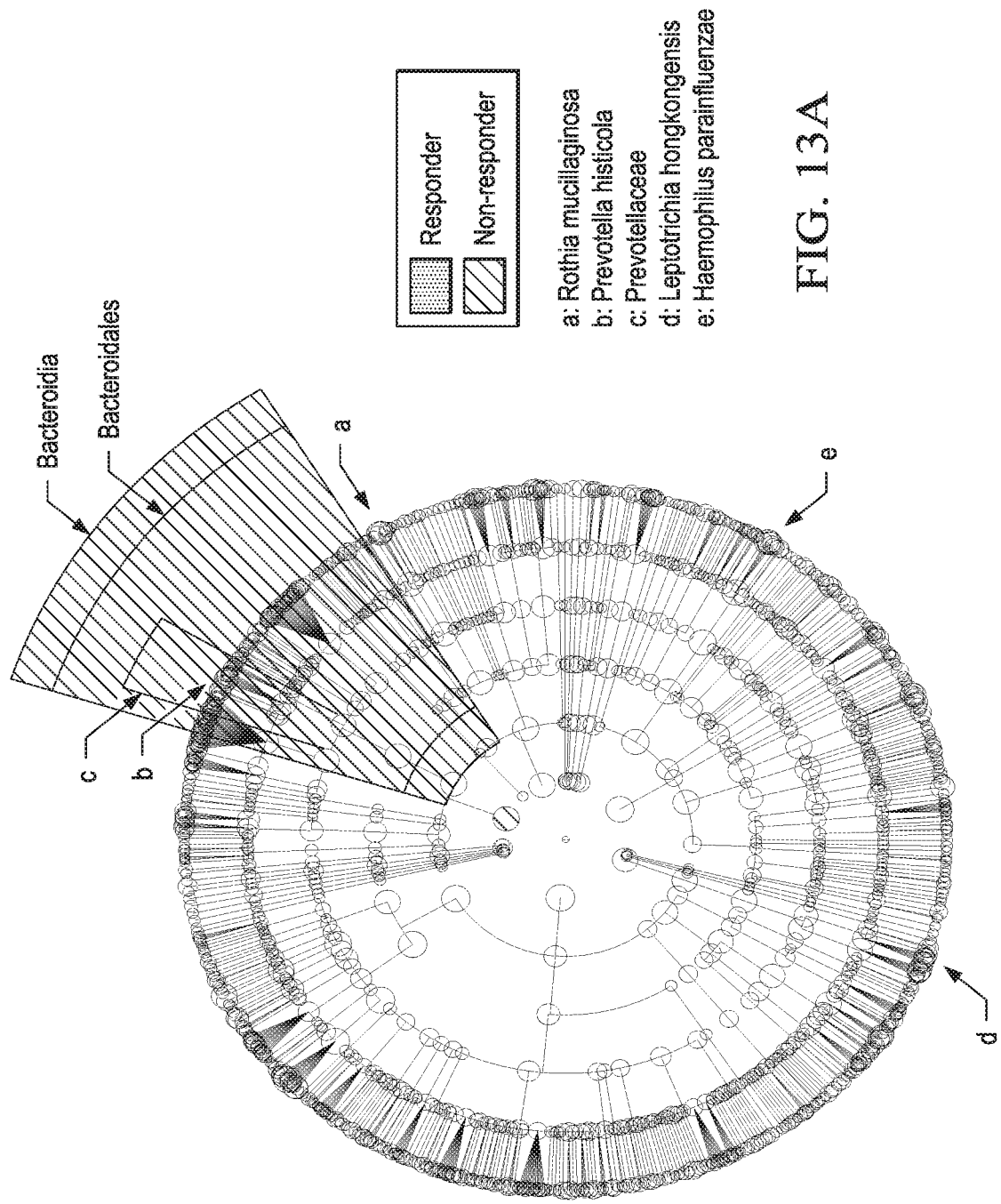
Figure 13B:
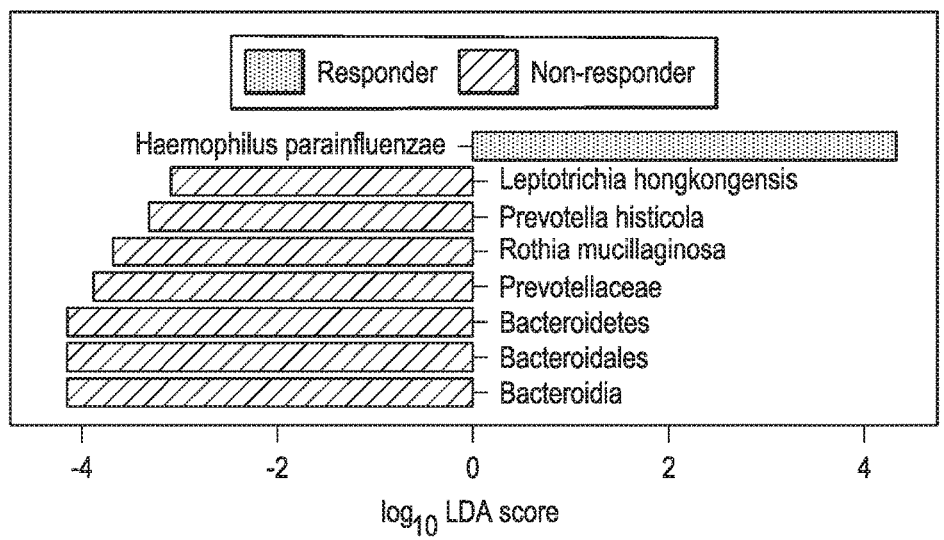

FIGS. 13A-B: High-dimensional class comparisons using LEfSe reveal increased abundance of Bacteroidales in the oral microbiome of NR to anti-PD-1 therapy. (A) Taxonomic Cladogram from LEfSe showing differences in the oral taxa. Taxa enriched in R and NR, respectively, are indicated with size of the dot proportional to abundance of the taxon. (B) Histogram of LDA scores computed for differentially abundant taxa between the oral microbiomes of R and NR, where the length of the bar indicates the effect size associated with a taxon. p=0.05 for Kruskal-Wallis test; LDA score >3.

Figure 14A:
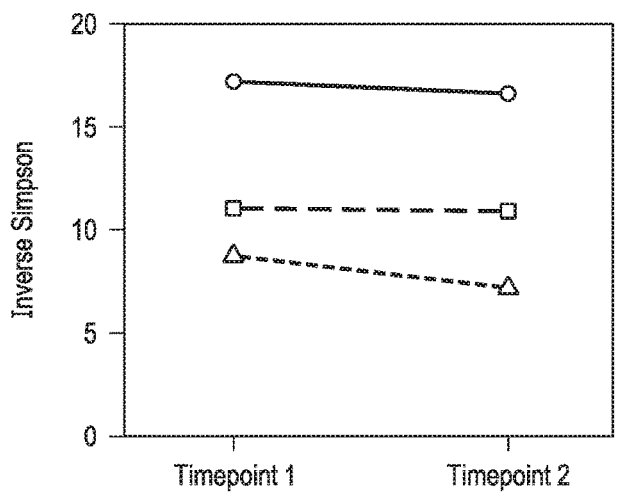
Figure 14B:
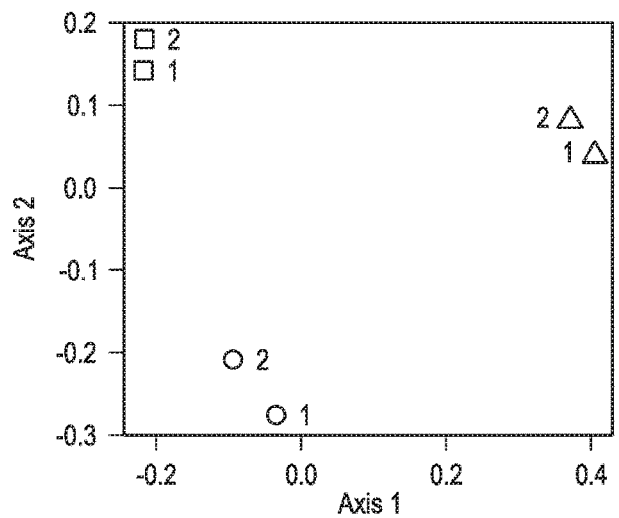
Figure 14C:
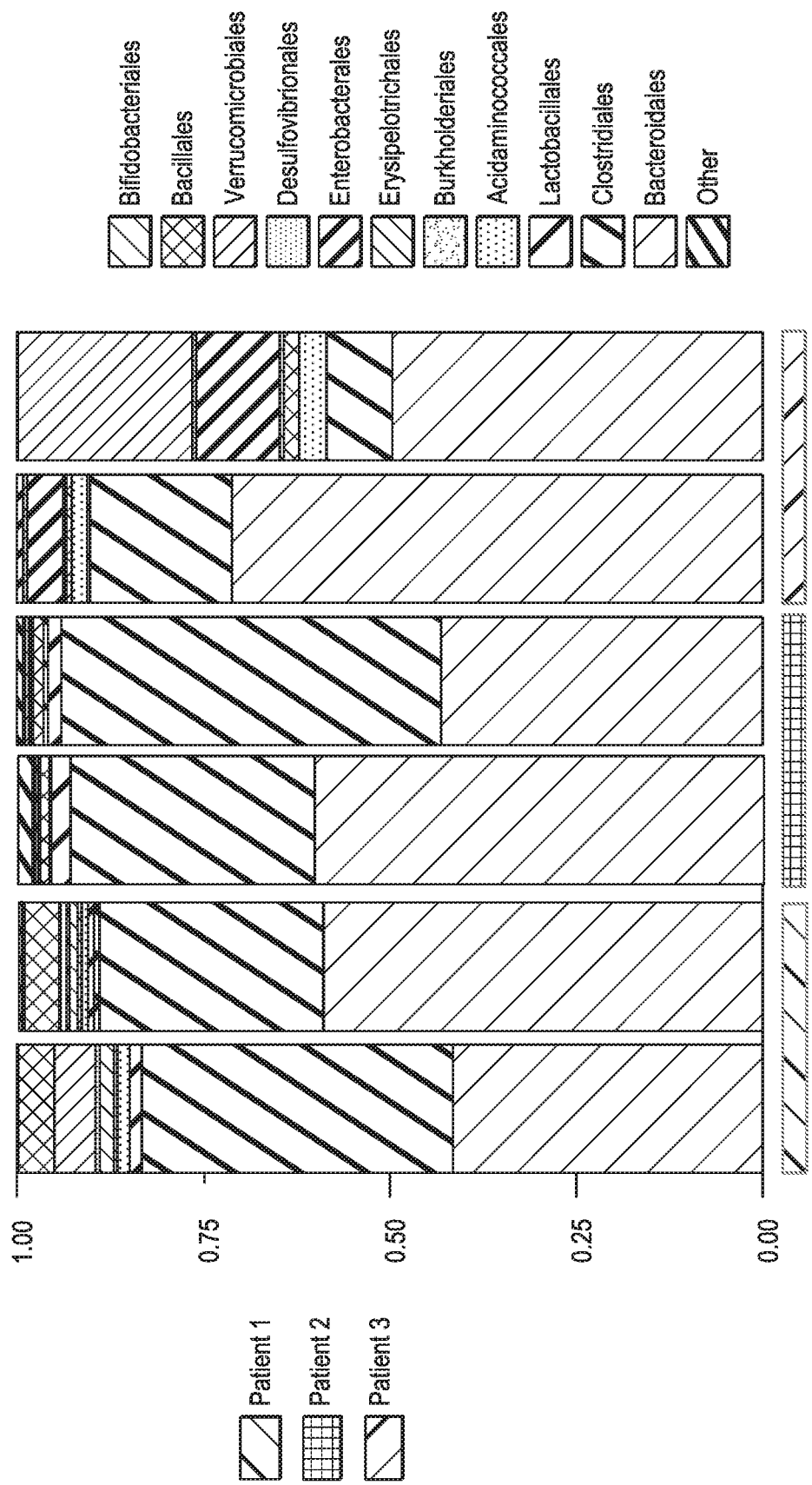

FIGS. 14A-C: The diversity and composition of the gut microbiome is stable over time. (A) Alpha-diversity of the gut microbiome by Inverse Simpson over time in 3 patients (R) with longitudinal collections. (B) Principal component analysis using unweighted UniFrac distances. (C) Stacked bars showing the composition of the gut microbiome in patients over time at the order level.

Figure 15A:
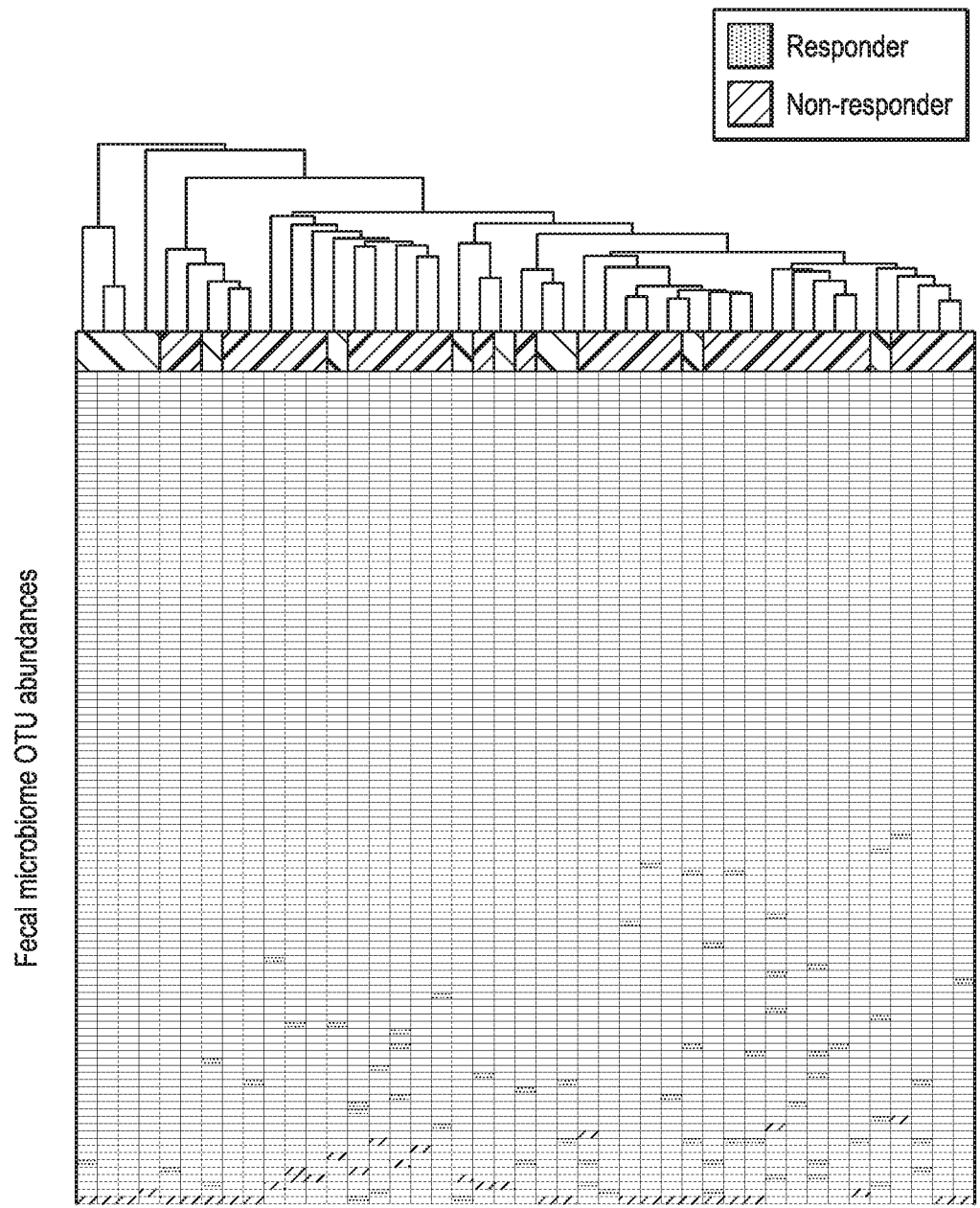
Figure 15B:
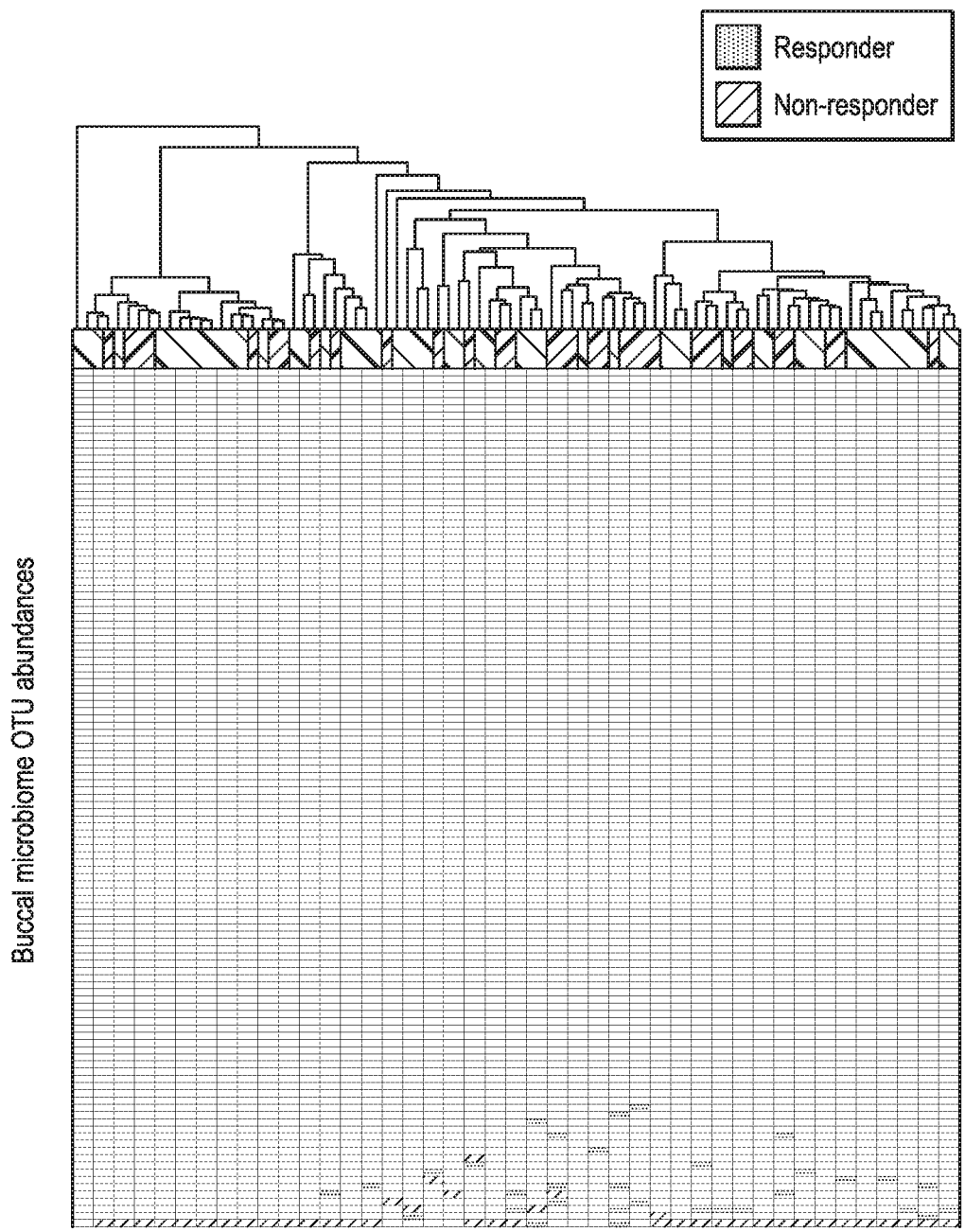

FIGS. 15A-B: Clustering by relative OTU abundances shows no association with response to anti-PD-1 therapy. Unsupervised hierarchical by complete linkage using Euclidean distances based on OTU abundance in (A) 43 fecal and (B) 86 oral microbiome samples. Each column represent a unique microbiome sample whereas each row represents a unique OTU.

Figure 16A:
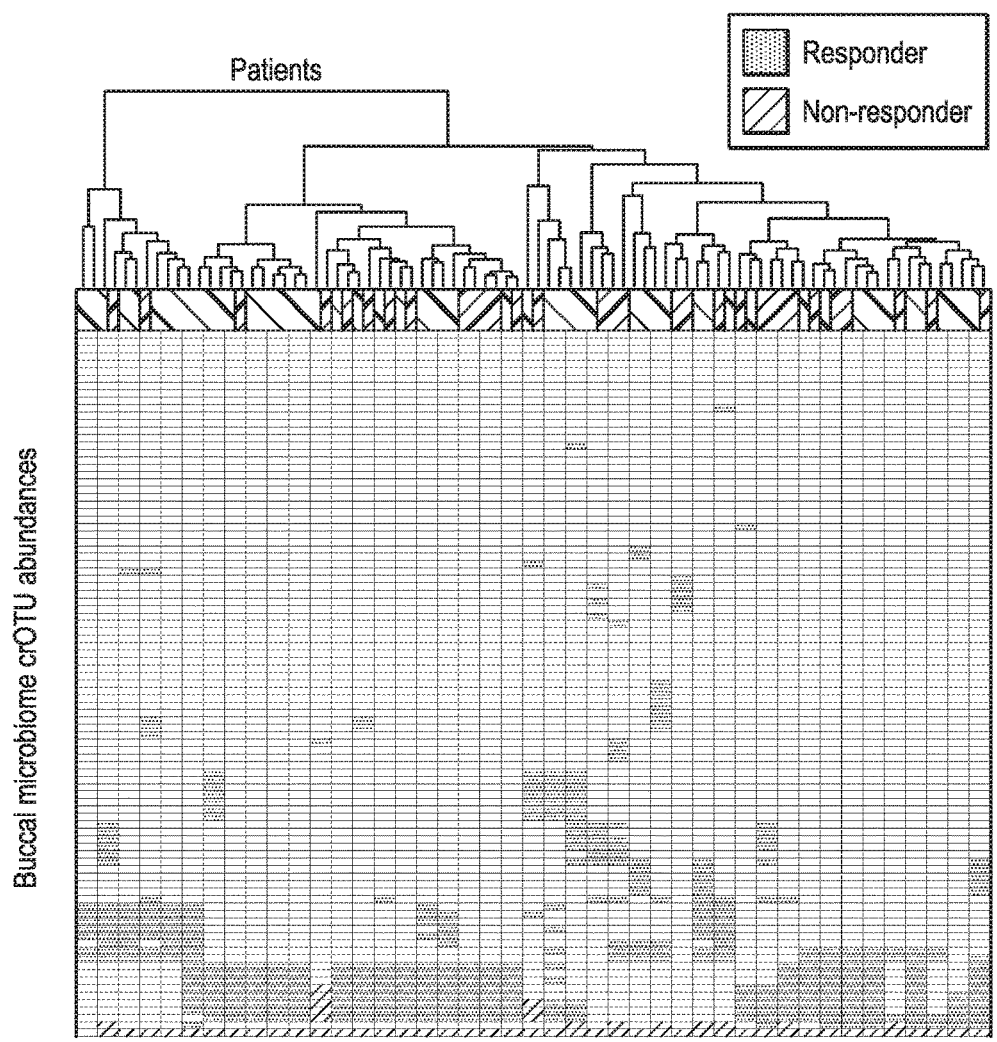
Figure 16B:
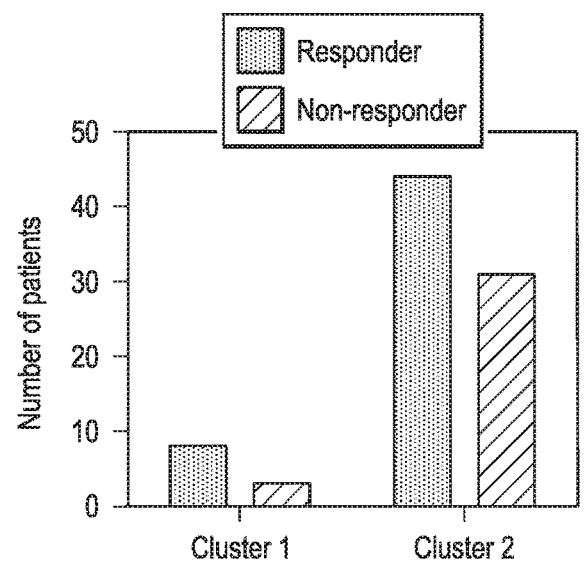

FIGS. 16A-B: Clusters based on oral microbiome crOTU abundances are not associated with response to PD-1 blockade. (A) Unsupervised hierarchical clustering by complete linkage of 86 oral microbiome samples based on crOTU abundances. (B) Comparison of clusters by response showing crOTU cluster 1 (n=11, R=9 and NR=2) and Cluster 2 (n=75, R=45 and NR=30). p=0.20 by two-sided Fisher's exact test.

Figure 17:
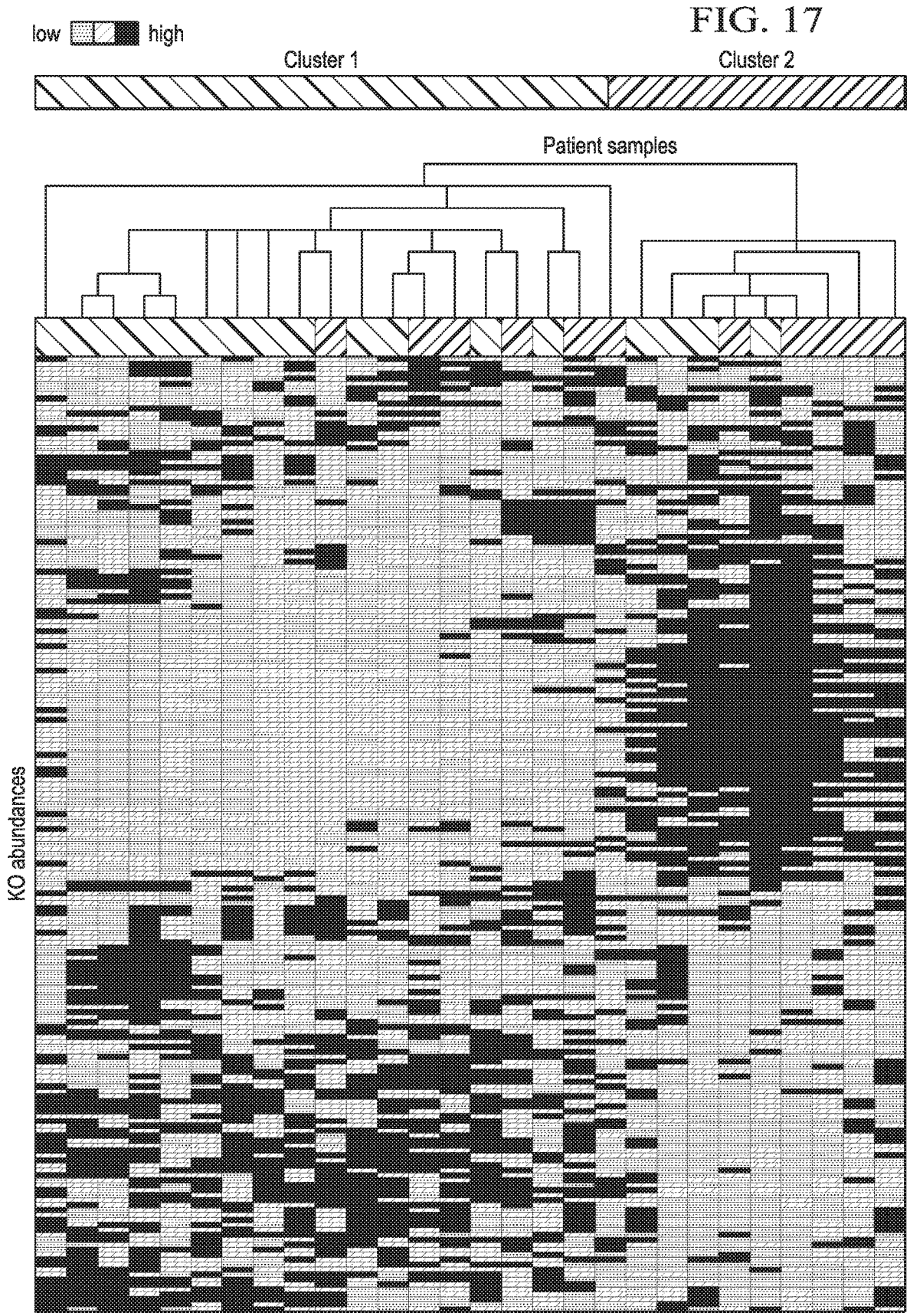
Figure 18A:
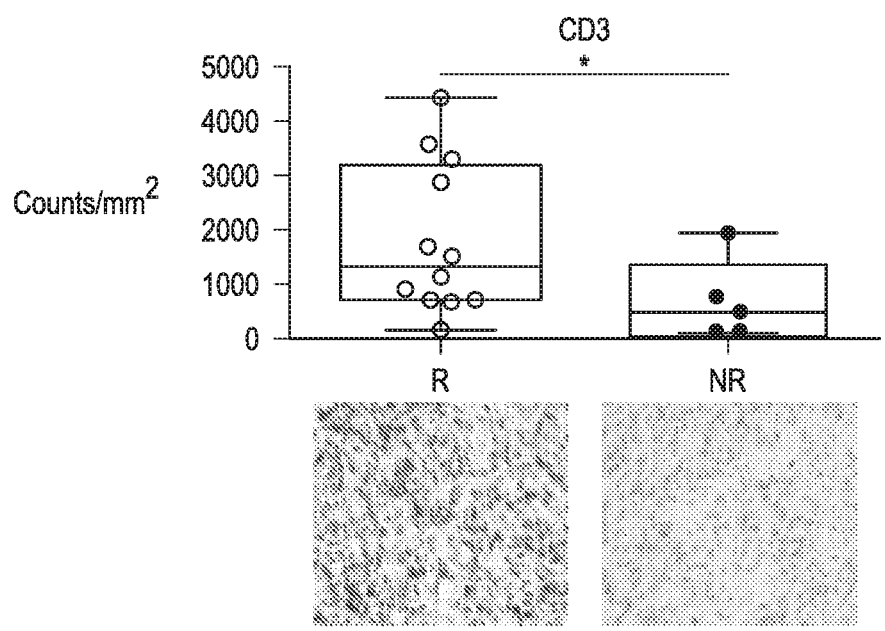
Figure 18B:
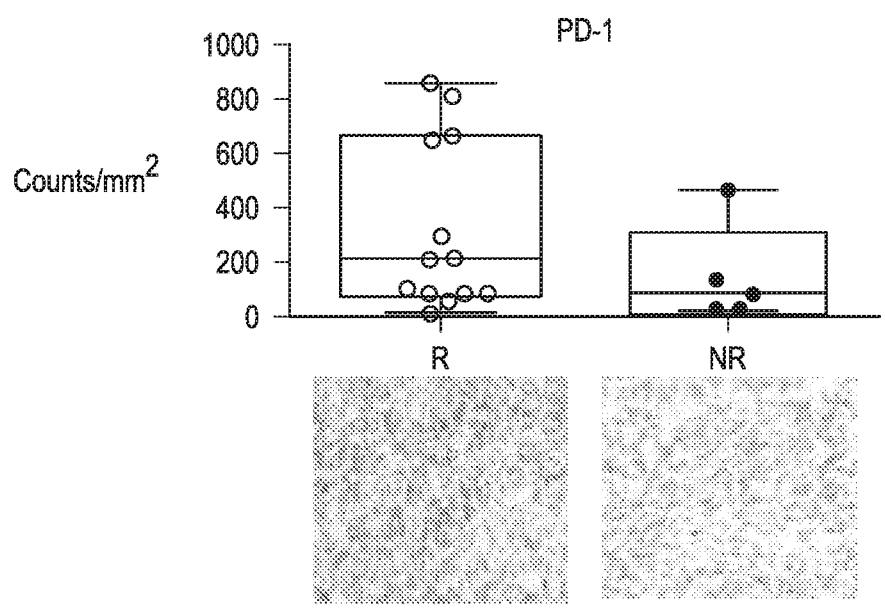
Figure 18C:
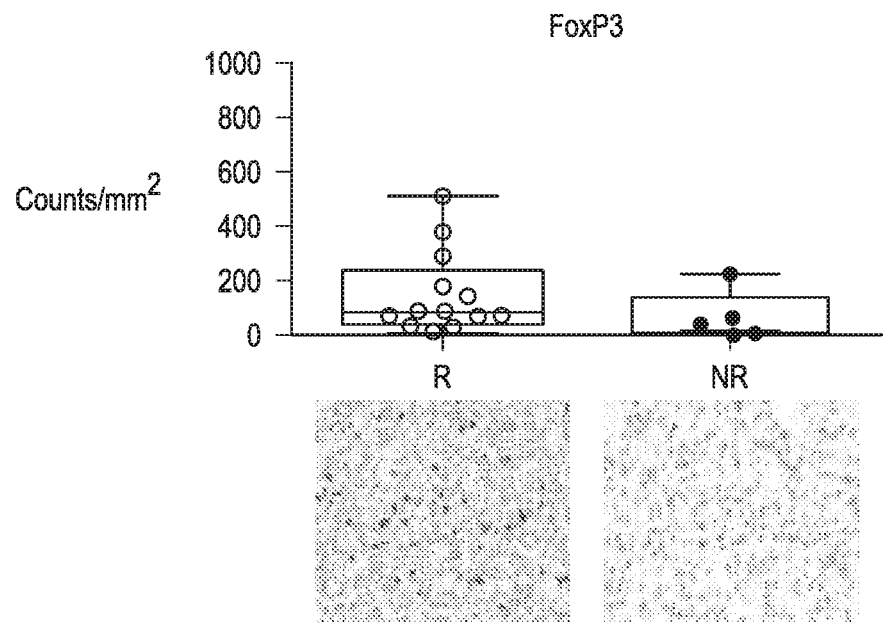
Figure 18D:
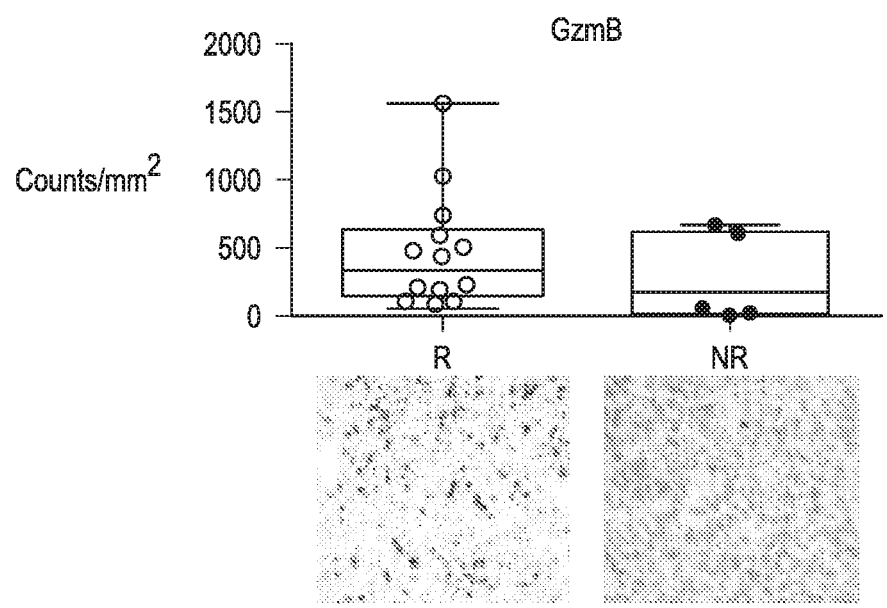
Figure 18E:
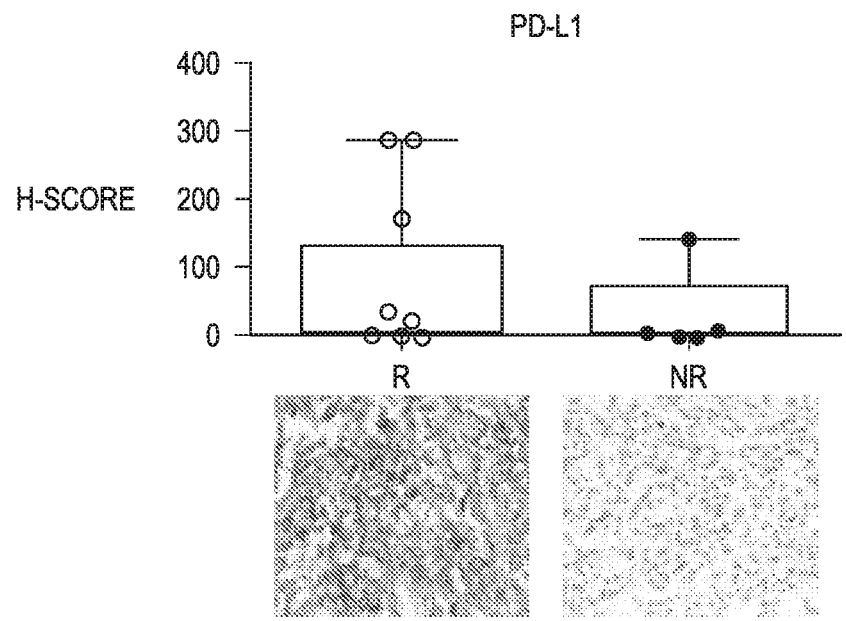
Figure 18F:
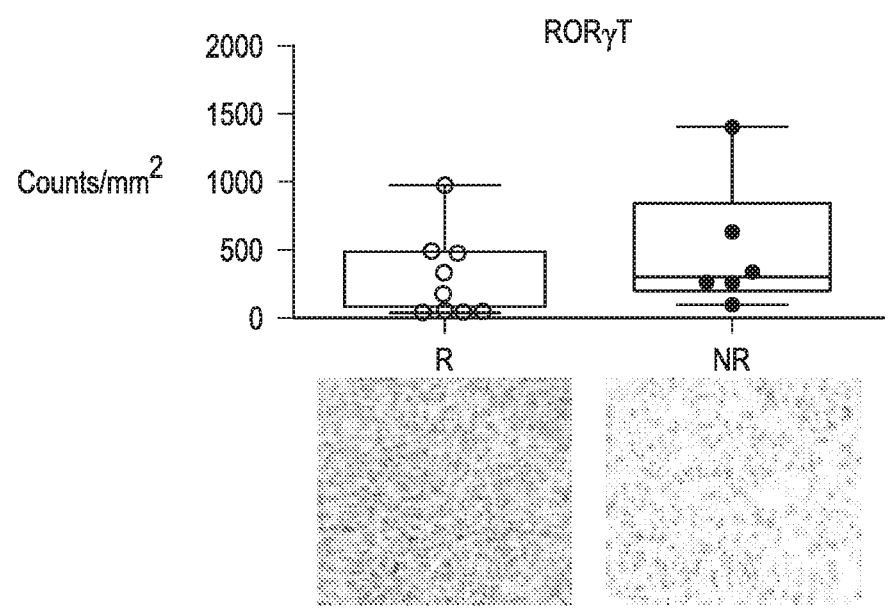

FIG. 17: Metabolic profiles based on KEGG-orthologs differ in the gut microbiome of R vs NR to PD-1 blockade. Unsupervised hierarchical clustering of common functional pathways (found in at least 20 samples) in 28 fecal samples obtained from 25 patients (n=14R and 11NR) according to KEGGortholog relative abundances.

FIGS. 18A-F: Responders to PD-1 blockade present an enriched tumor immune infiltrate at baseline. Immunohistochemical quantification and representative images at 40× magnification of (A) CD3, (B) PD-1, (C) FoxP3, (D) GzmB, (E) PD-L1 and (F) RORγT as counts/mm2 or H-Score in responders (R) and non-responders (NR) to anti-PD-1.

Figure 19:
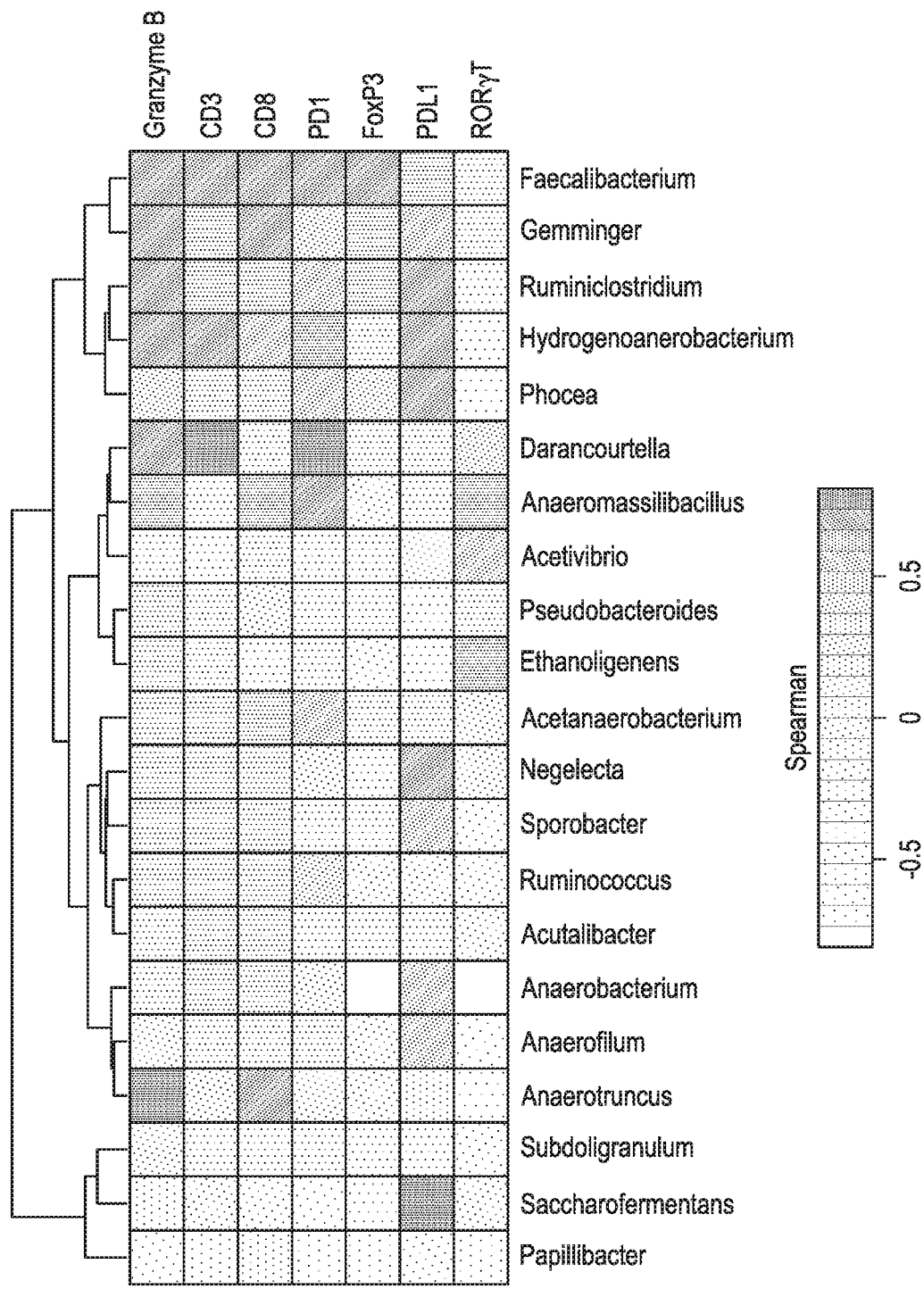
Figure 20A:
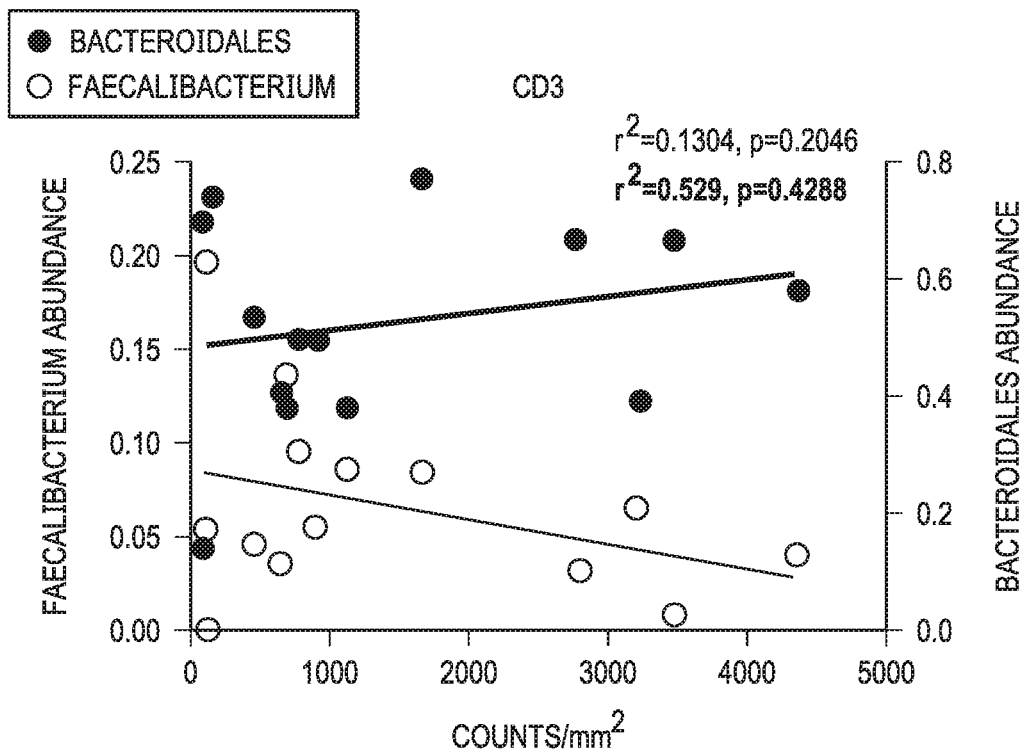
Figure 20B:
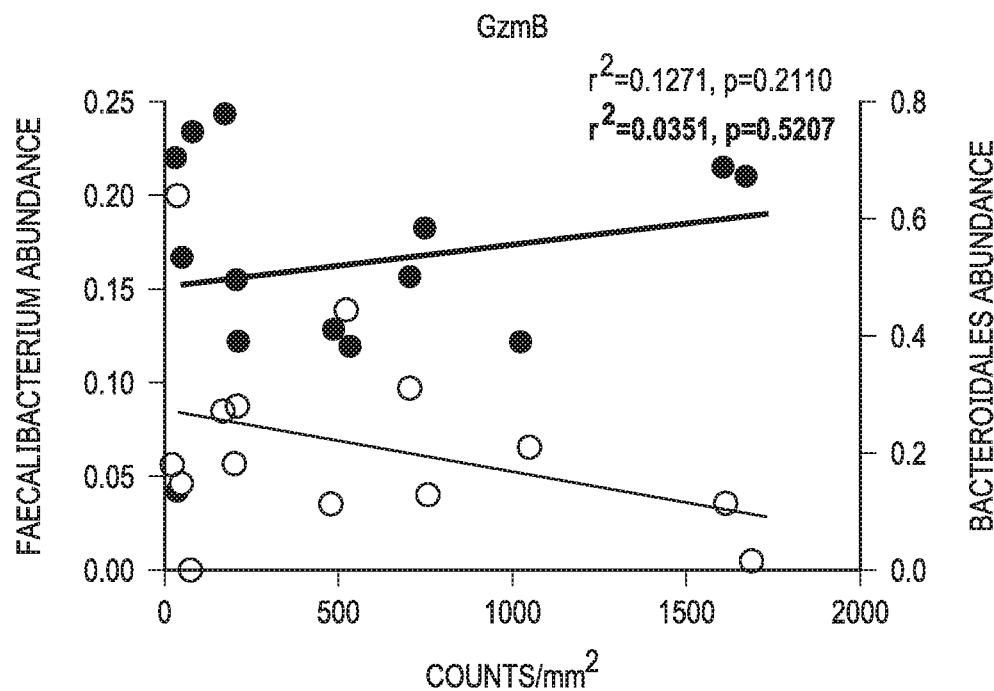
Figure 20C:
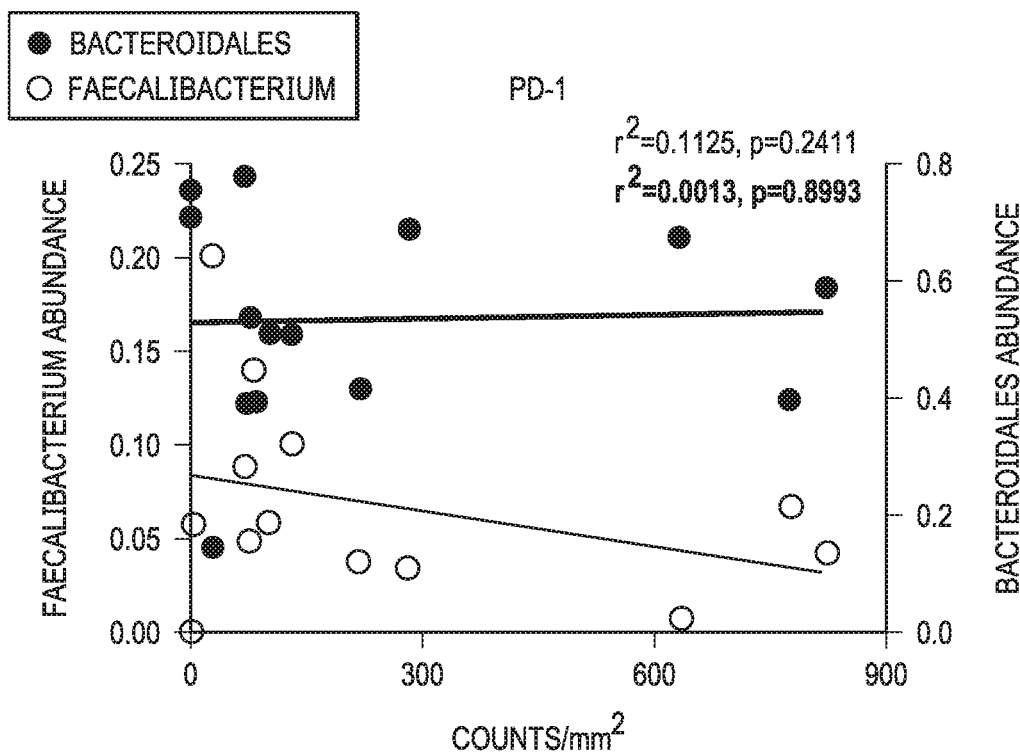
Figure 20D:
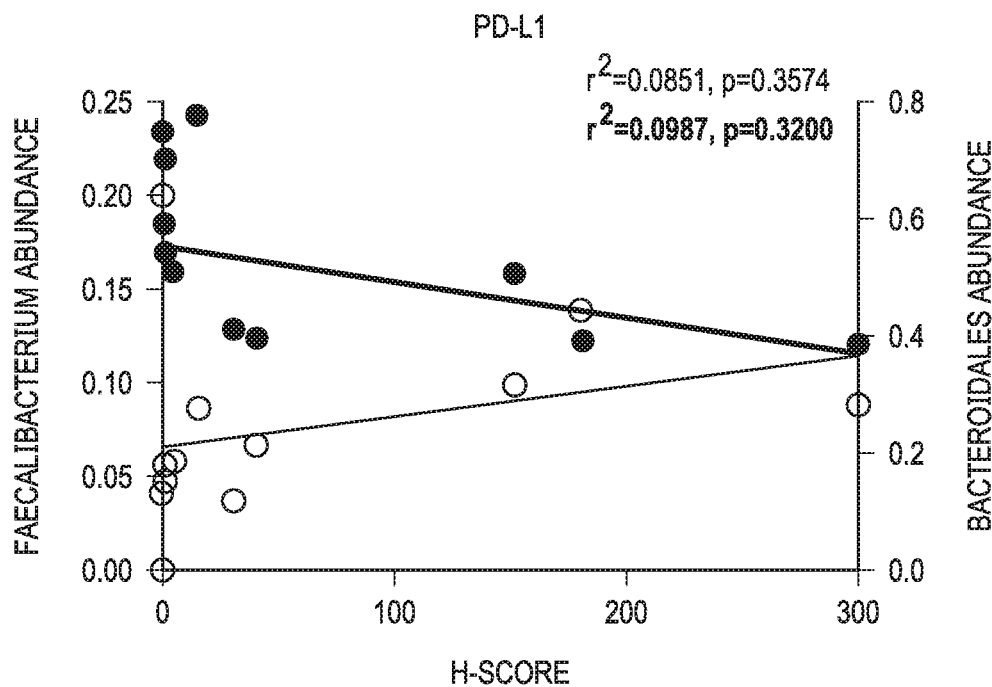
Figure 20E:
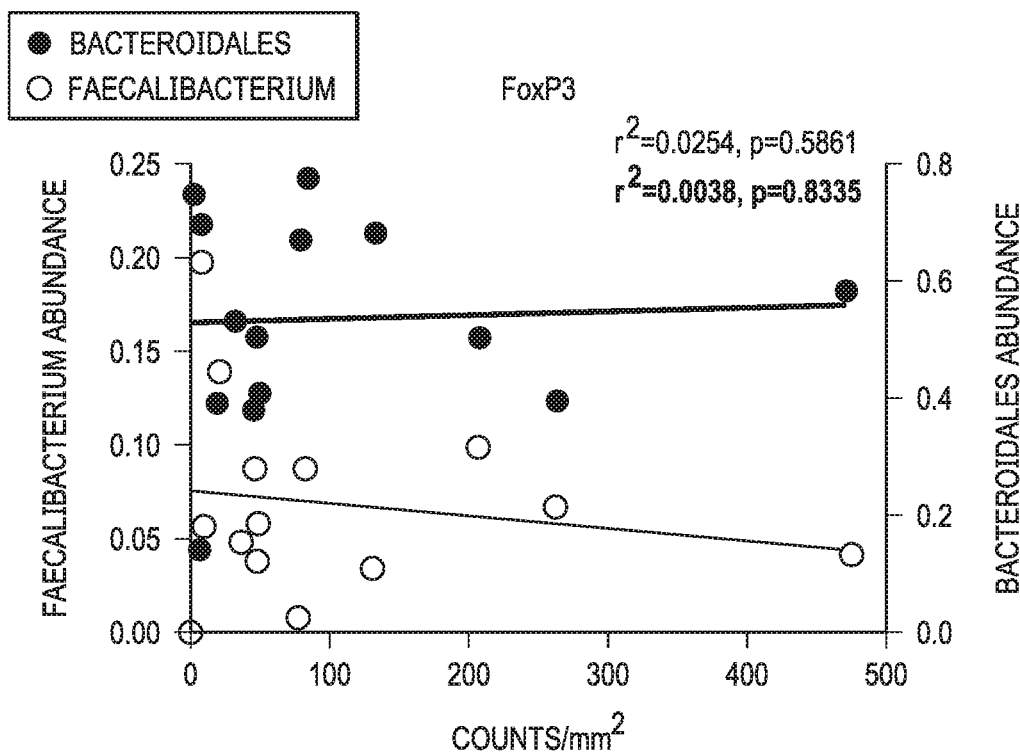
Figure 20F:
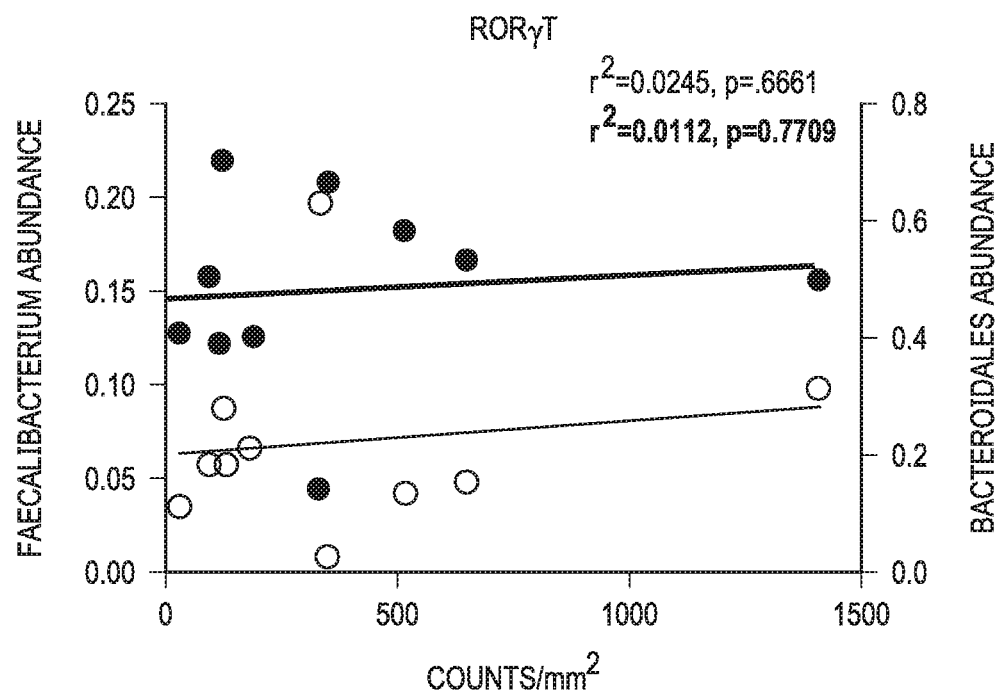

FIG. 19: Patients with a high abundance of *Faecalibacterium* present a favorable antitumor immune infiltrate prior to anti-PD-1 therapy. Spearman rank correlation heatmap of GzmB, CD3, CD8, PD-1, FoxP3, RORγT by counts/mm2, PD-L1 by H-Score by IHC and abundance of all genera within the Ruminococcaceae family in the fecal microbiome (n=15). Positive correlation, negative correlation and no correlation are indicated.

FIGS. 20A-F: *Faecalibacterium* and Bacteroidales abundance in the fecal microbiome have distinct associations with the tumor immune infiltrate prior to PD-1 blockade. Linear regression between *Faecalibacterium* abundance, Bacteroidales abundance, and density by counts/mm2 or H-score of (A) CD3, (B) GzmB, (C) PD-1, (D) PD-L1, (E) FoxP3, and (F) RORγT by IHC in tumors of patients treated with anti-PD-1 at baseline. Lines show regression for *Faecalibacterium* (thin line, normal type values) and Bacteroidales (thick line, bold type values) with the associated $r_2$ and p-values.

Figure 21:
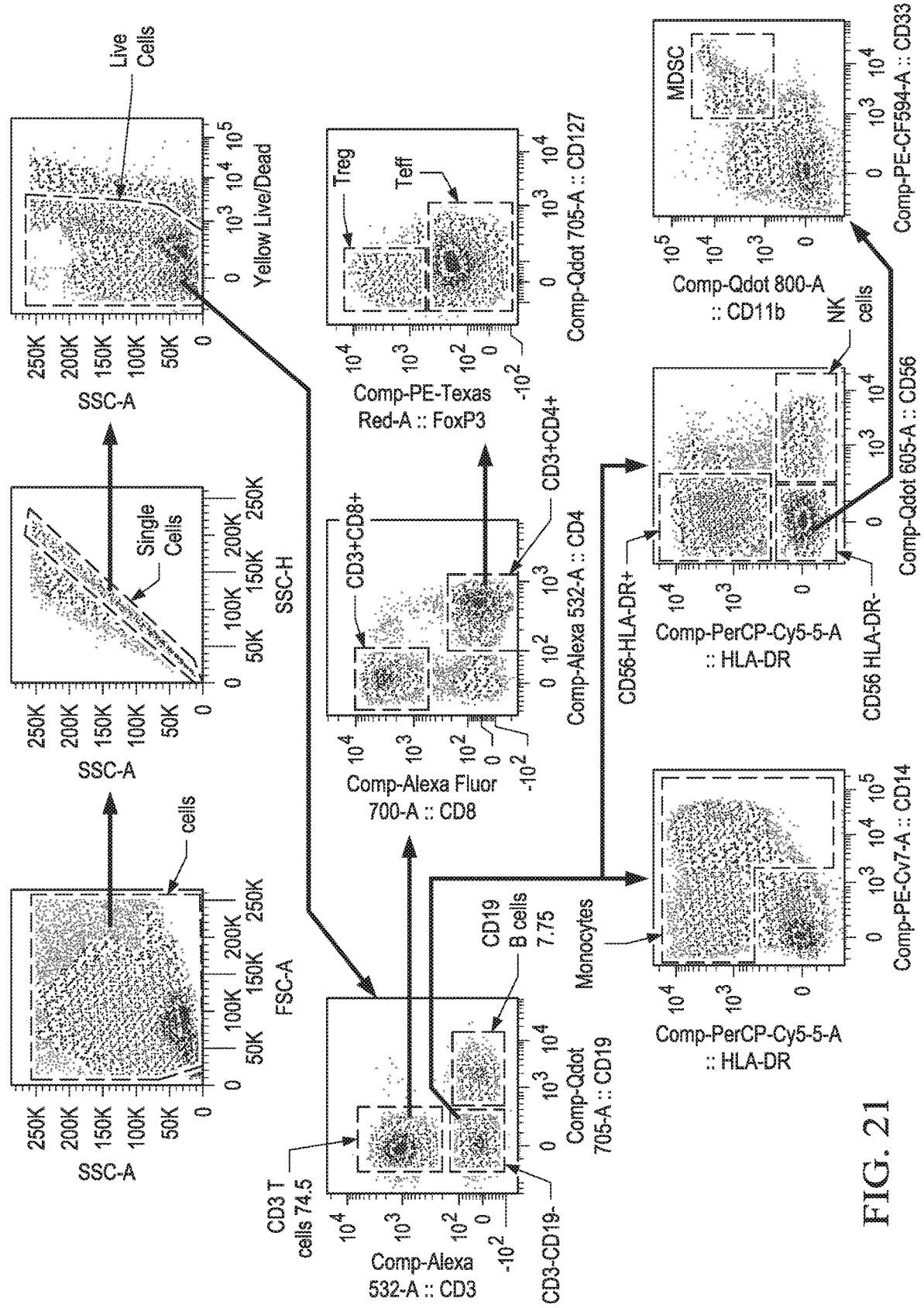
Figure 22A:
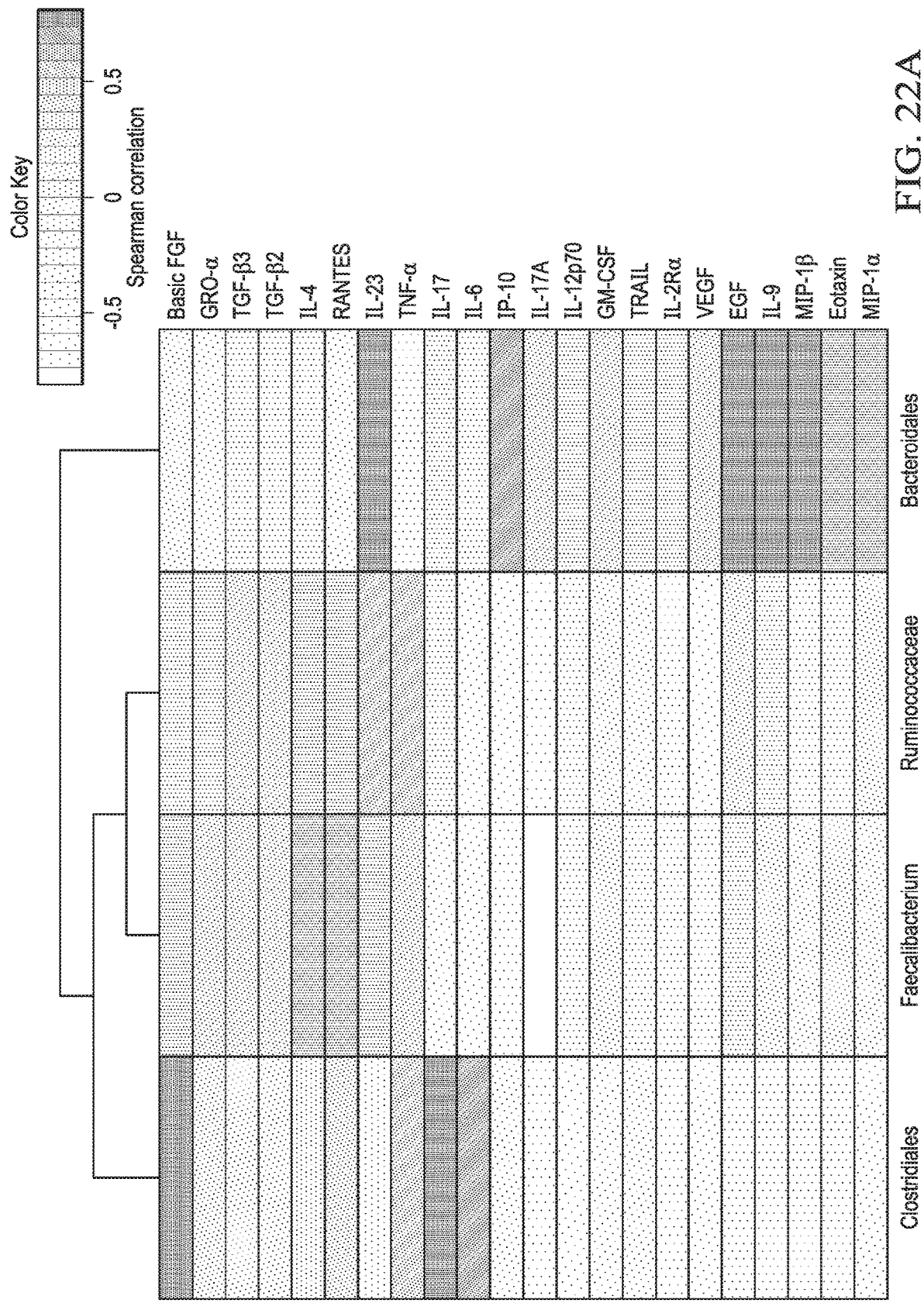

FIG. 21: Gating strategy for flow cytometric analysis of peripheral blood in patients treated with anti-PD-1 therapy. PBMC at baseline in patients treated with anti-PD-1 were analyzed by gating for CD19+ B cells, CD3+CD8+ T cells, CD3+CD4+ T cells (CD3+CD4+FoxP3+ regulatory and CD3+CD4+FoxP3− effector), monocytes (based on CD14/HLA-DR), and MDSC (CD3−CD19−HLADRCD33+CD11b+).

FIGS. 22A-D: Patients with high *Faecalibacterium* abundance display a peripheral cytokine profile favorable for response to PD-1 blockade at baseline and enhanced cytokine responses over the course of therapy. (A) Spearman rank correlation heatmap between Clostridiales, *Faecalibacterium*, Ruminococcaceae, and Bacteroidales abundance and peripheral concentration of cytokines in pg/mL by multiplex bead assay. Positive correlation, negative correlation and no correlation is indicated. Change in production of cytokines in serum of responders (n=2) and non-responders (n=2) to anti-PD-1 therapy for (B) IP-10 (p=0.042 and p=0.344, respectively), (C) MIP-1β (p=0.043 and p=0.898, respectively), and (D) IL-17A (p=0.072 and p=0.862, respectively) in fold-change from baseline by ratio paired t-test.

Figure 23:
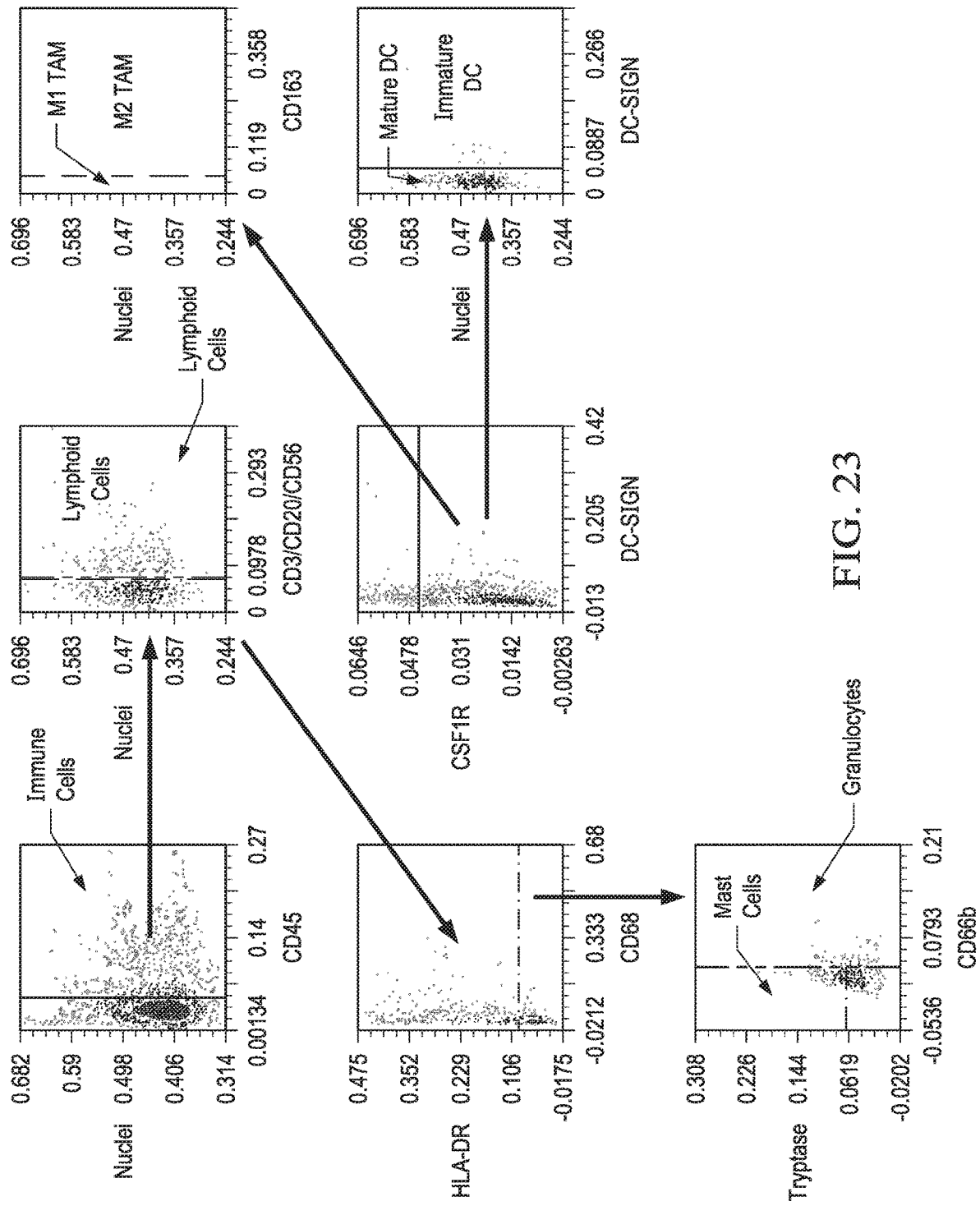

FIG. 23: Gating strategy for myeloid multiplex IHC in the tumors of patients treated with PD-1 blockade at baseline. Myeloid multiplex immunohistochemistry gating strategy showing immune cells (CD45+), lymphoid cells (CD45+CD3+CD20+CD56+), myeloid cells (CD45+CD3−CD20−CD56−), mast cells (CD45+CD3−CD20−CD56−HLADR−Tryptase+), granulocytes (CD45+CD3−CD20−CD56−HLADRCD66b+), M1 tumor-associated macrophages (CD45+CD3−CD20−CD56−HLADR+CSF1R+CD163−), M2 tumor-associated macrophages (CD45+CD3−CD20−CD56−HLADR+CSF1R+CD163+), mature dendritic cells (CD45+CD3−CD20−CD56−HLADR+CSF1R−DCSIGN−) and immature dendritic cells (CD45+CD3−CD20−CD56−HLADR+CSF1R−DCSIGN+).

Figure 24A:
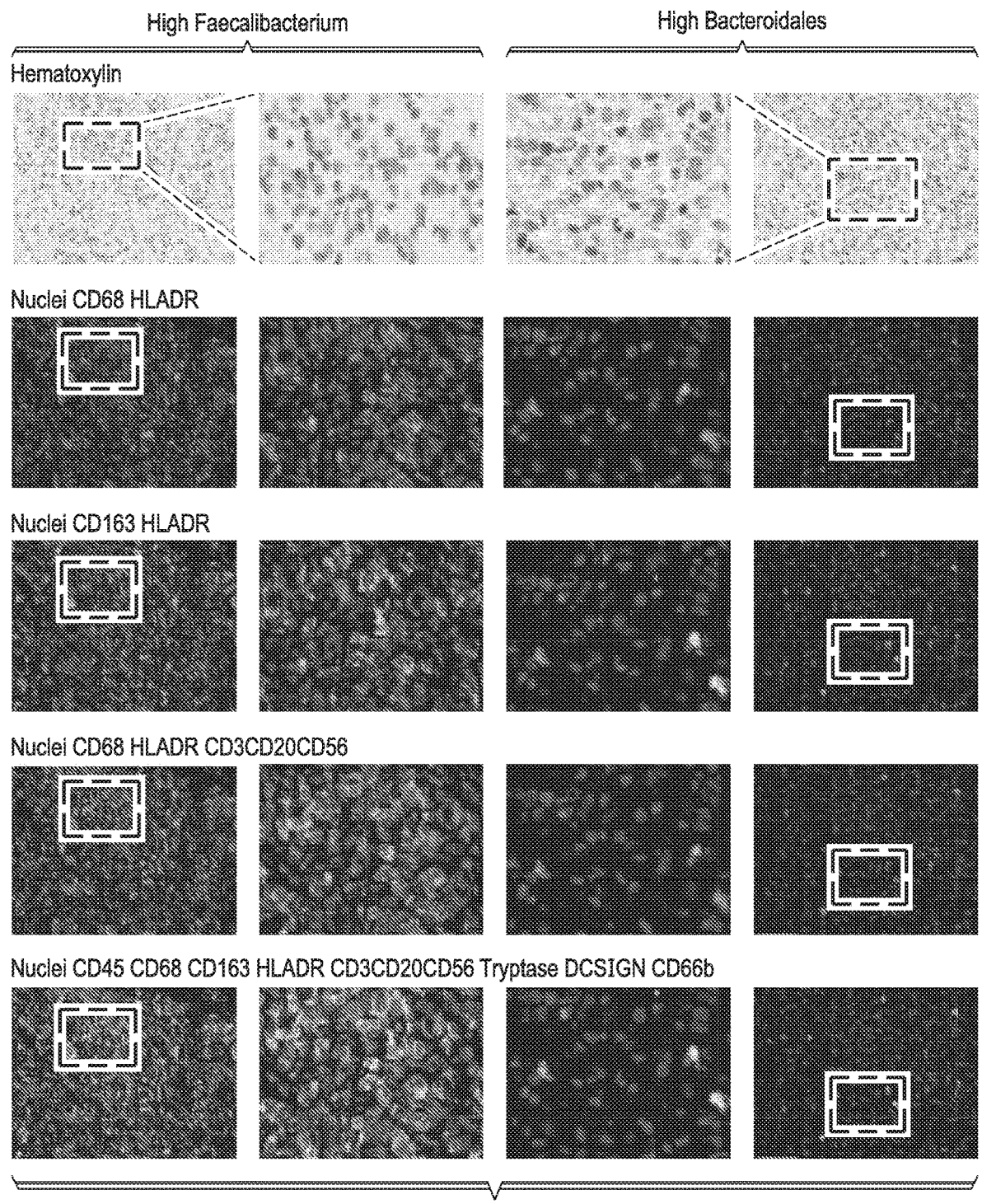
Figure 24B:
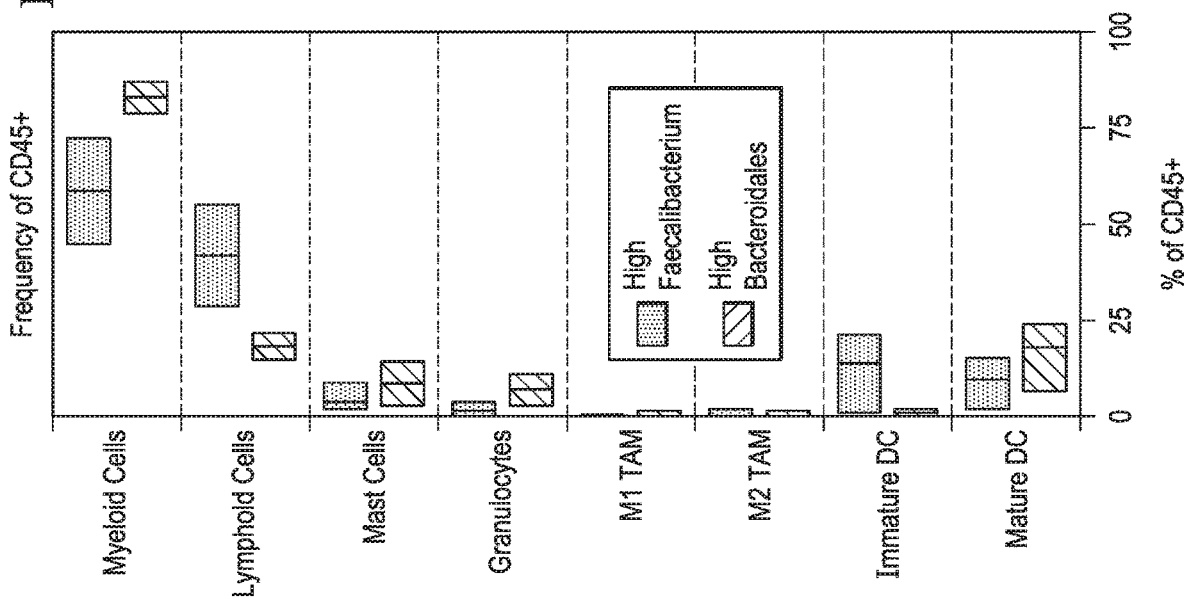
Figure 24C:
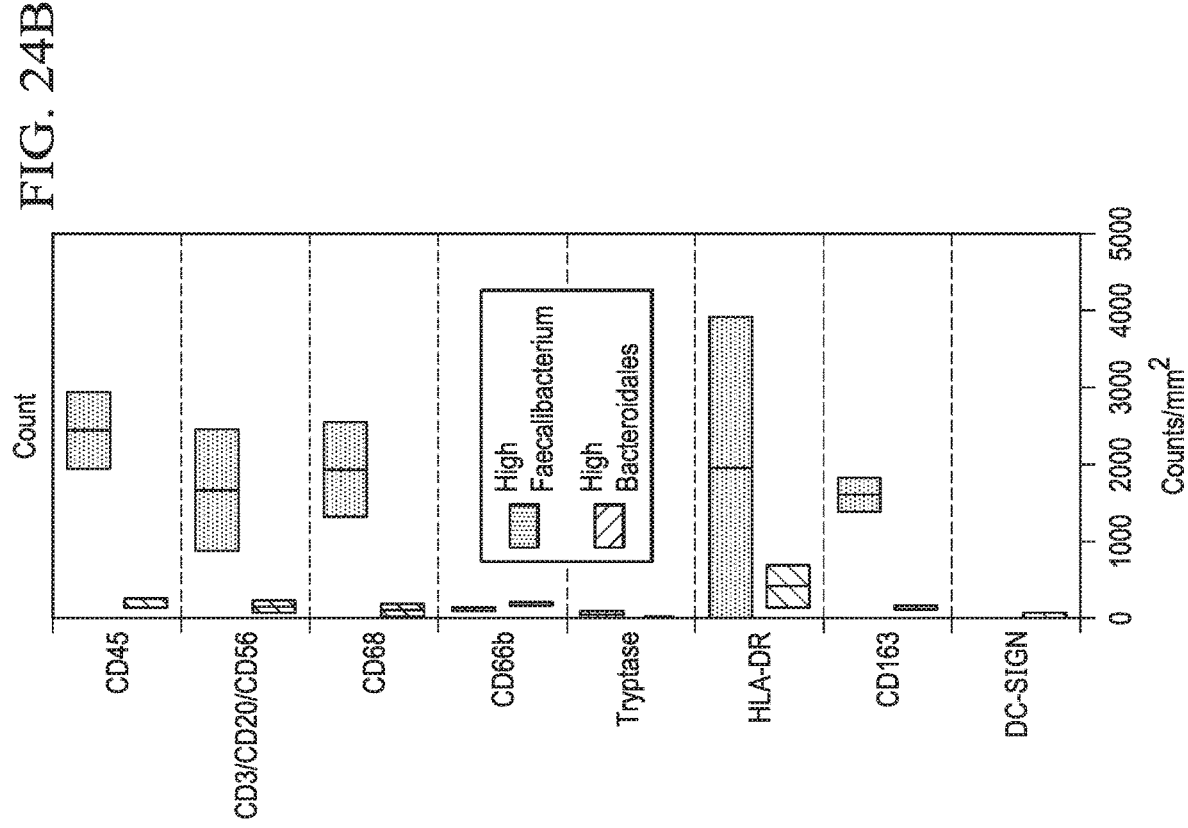

FIGS. 24A-C: High *Faecalibacterium* abundance at baseline is associated with an increased immune infiltrate prior to PD-1 blockade. (A) Multiplex immunohistochemistry showing representative myeloid immune cell staining at 40× magnification. (B) Quantification of CD45, CD3/CD20/CD56, CD68, CD66b, Tryptase, HLA-DR, CD163, and DC-SIGN as counts/mm2 (C) Quantification of myeloid cells, lymphoid cells, mast cells, granulocytes, M1 and M2 tumor-associated macrophages, immature dendritic cells, and mature dendritic cells as a percentage of total CD45+ immune cells in patients with a high *Faecalibacterium* (n=2) or high Bacteroidales (n=2) abundance.

Figure 25A:
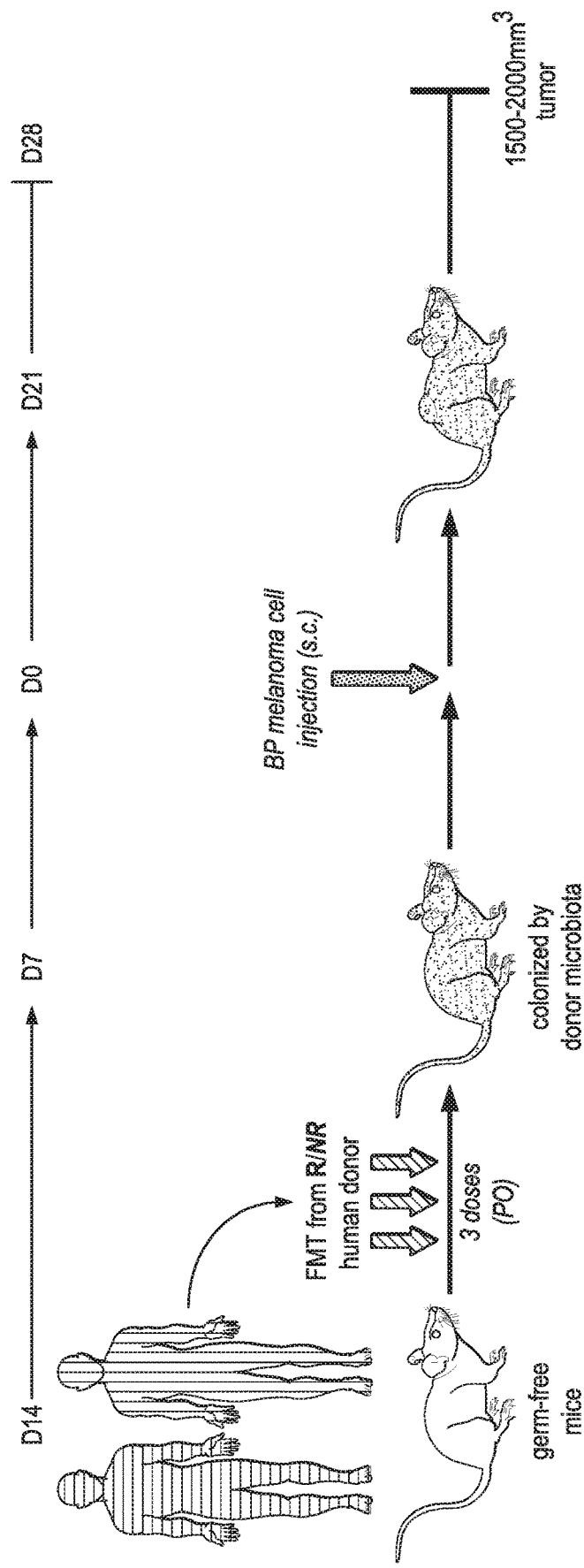
Figure 25B:
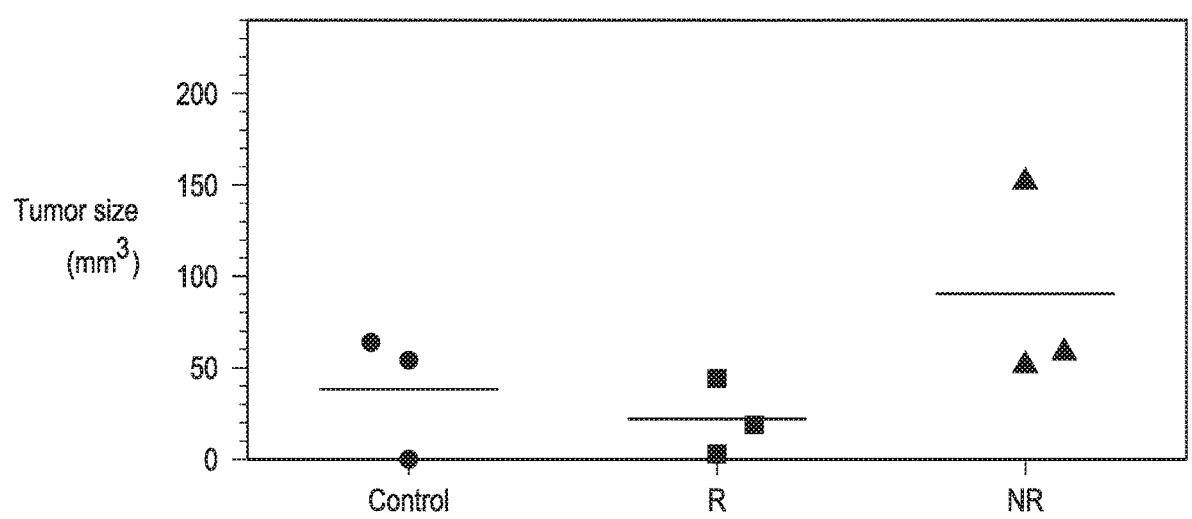

FIGS. 25A-B: Fecal Microbiota Transplantation (FMT) of a favorable gut microbiome in germ-free (GF) mice reduces tumor growth. (A) Experimental design of FMT1 experiment in germ-free (GF) mice. Time is indicated in days (D) relative to the day of tumor injection ($8 \times 10^{-5}$ tumor cells). (B) Difference in size of tumors implanted in responder (R)-FMT and non-responder (NR)-FMT mice, or control mice. Tumor volumes on day 14 post-tumor implantation are plotted, each value representing a single mouse.

Figure 26A:
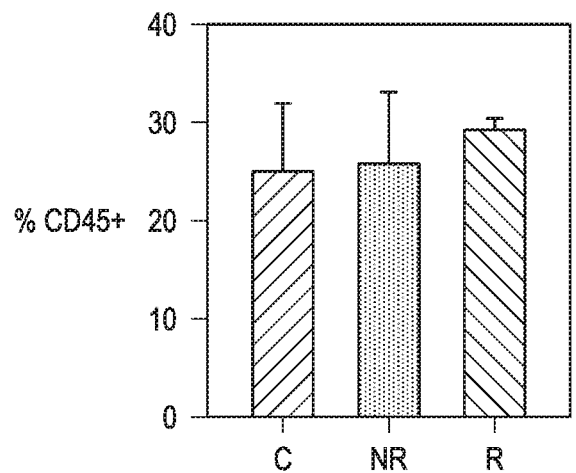
Figure 26B:
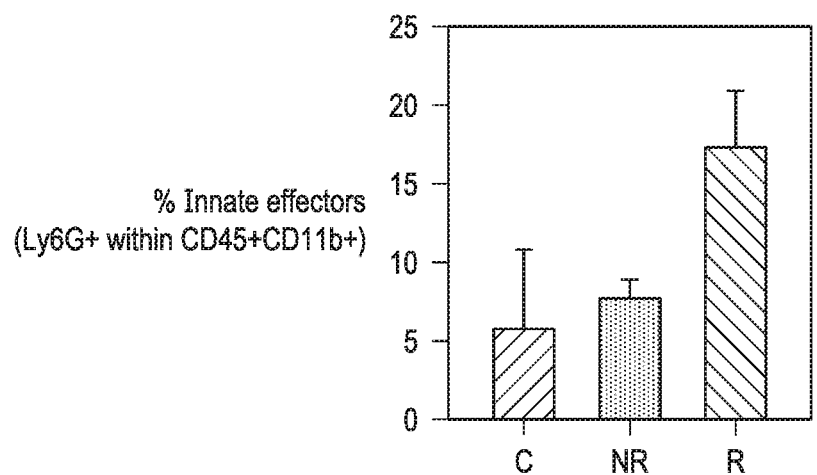
Figure 26C:
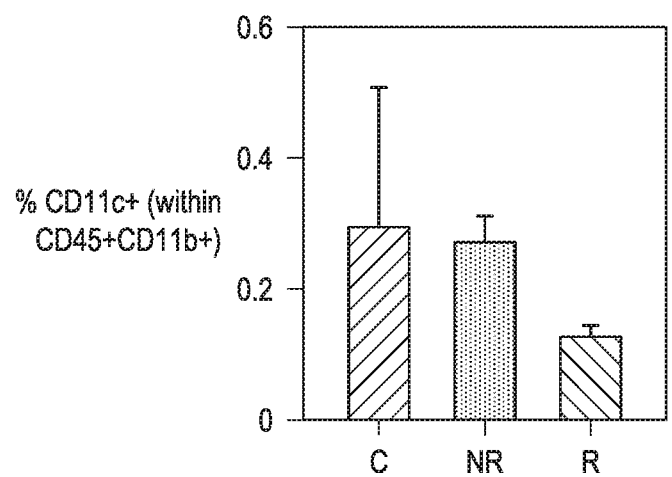

FIGS. 26A-C: Favorable FMT promotes innate effector and reduced myeloid suppressor infiltration in the spleen of GF mice. (A) Flow cytometry quantification showing the frequency of CD45+ immune cells in R-FMT (R), NR-FMT (NR), and control mice (C) in the spleen. (B) Flow cytometry quantification showing the frequency of CD45+CD11b+Ly6G+ innate effector cells in R-FMT (R), NR-FMT (NR), and control mice (C) in the spleen. (C) Flow cytometry quantification showing the frequency of CD45+CD11b+CD11c+ suppressive cells in R-FMT (R), NR-FMT (NR), and control mice (C) in the spleen.

Figure 27A:
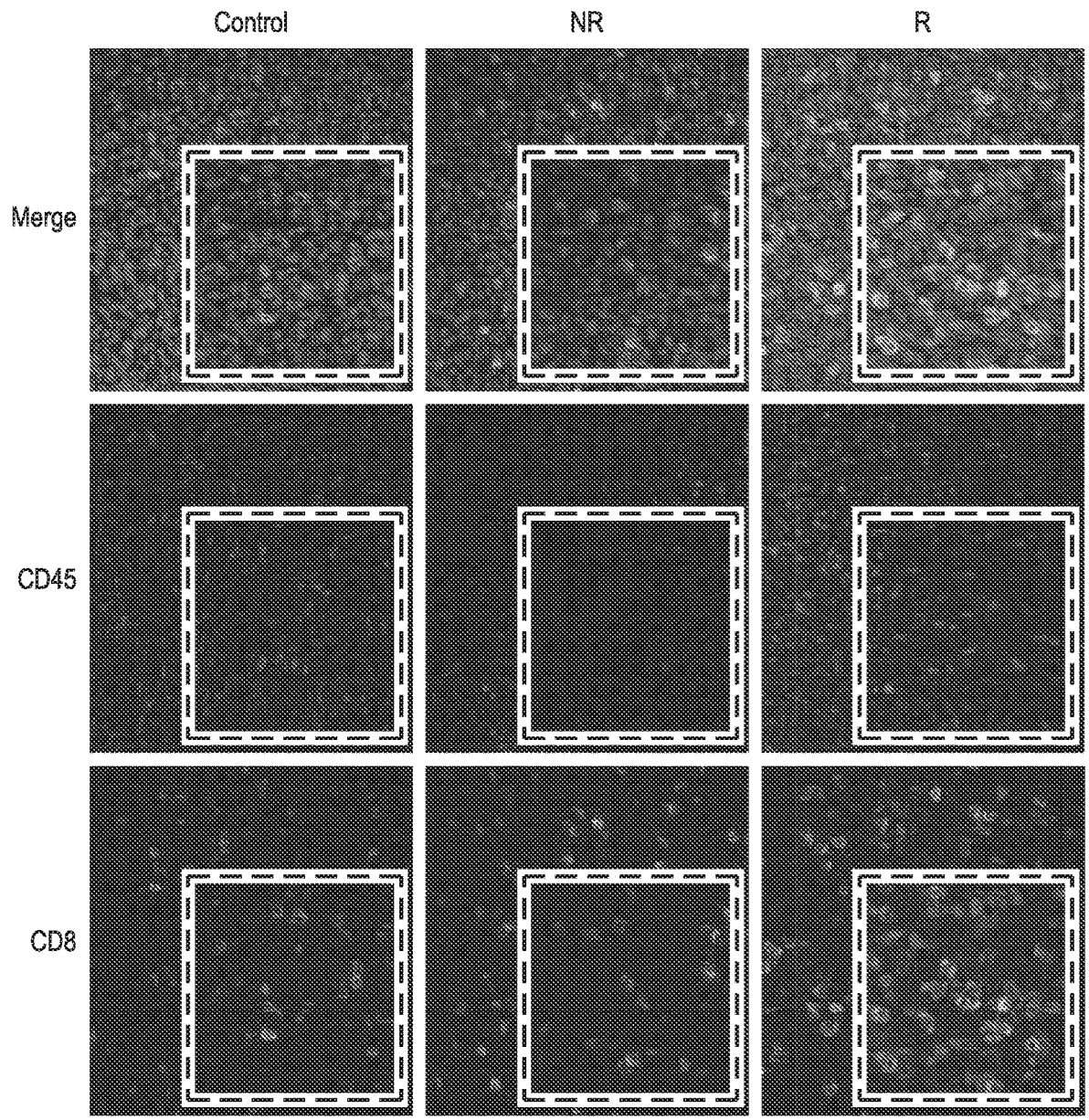
Figure 27B:
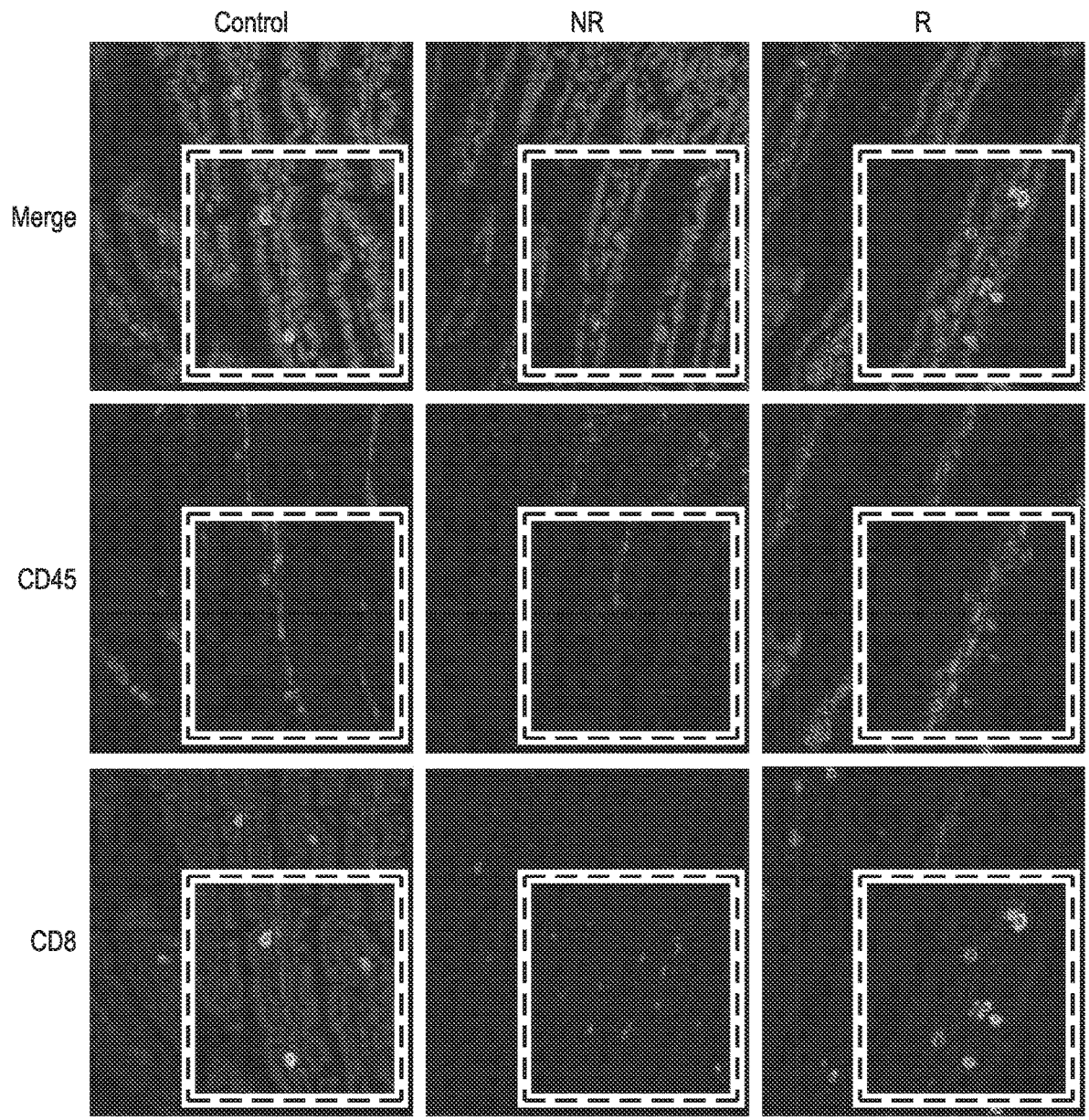
Figure 27C:
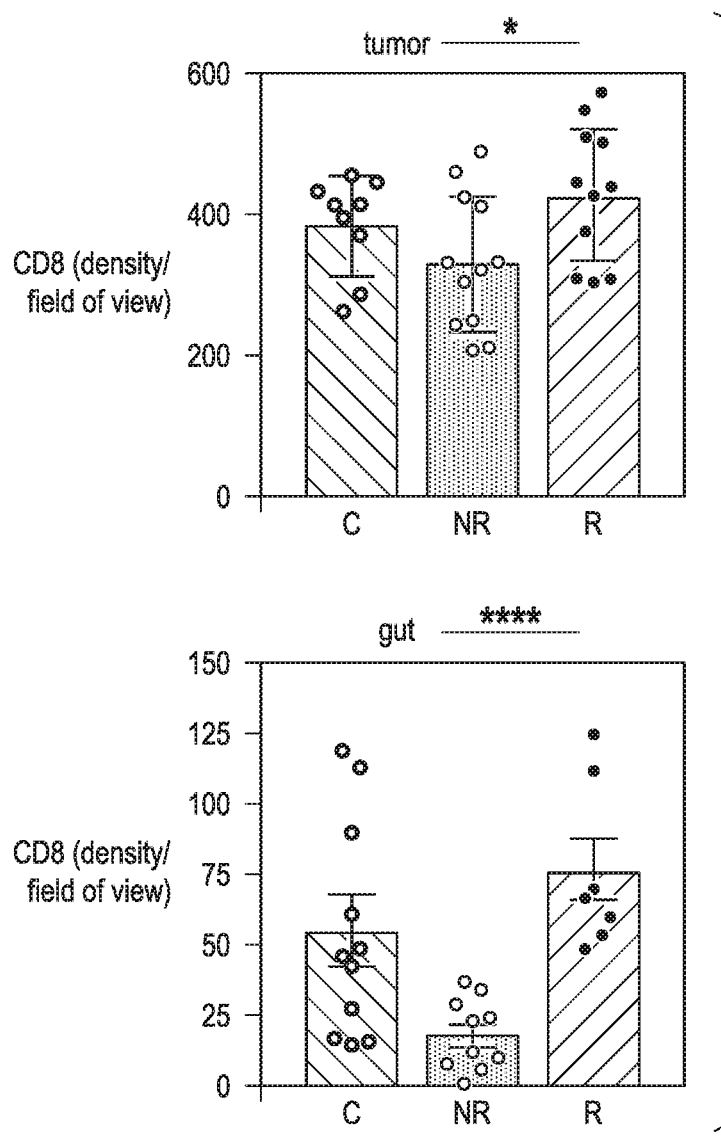

FIGS. 27A-C: Favorable FMT increases CD45+ and CD8+ in the gut and tumor of GF mice. Representative immunofluorescent staining of (A) tumor and (B) gut from Control (left), NR-FMT (middle), and R-FMT (right) in the tumor of GF mice post-FMT for CD45, CD8, and nuclei (DAPI). (C) Quantification of CD8$^+$ density in tumor (top) of R-FMT (n=2, median=433.5 cells/HPF across 12 regions), NR-FMT (NR-FMT n=2, median=325 cells/HPF across 12 regions) and Control mice (n=2, median=412 cells/HPF across 9 regions). p=0.30 (R-FMT vs Control) and gut (bottom) (R-FMT n=2, median=67 cells/HPF across 7 regions, NR-FMT n=2, median=24 cells/HPF across in 5 regions, Control n=2, median=47 cells/HPF across 10 regions). p=0.17 (R-FMT vs Control).

Figure 28A:
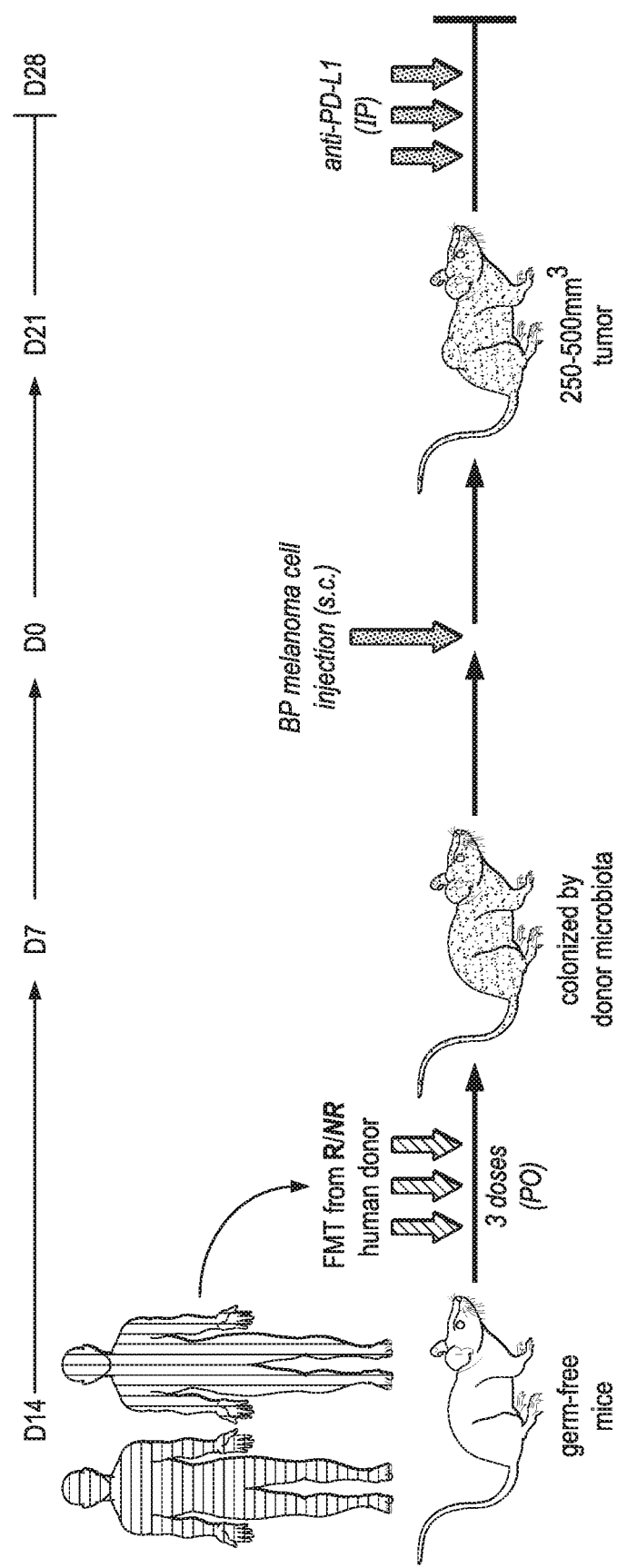
Figure 28B:
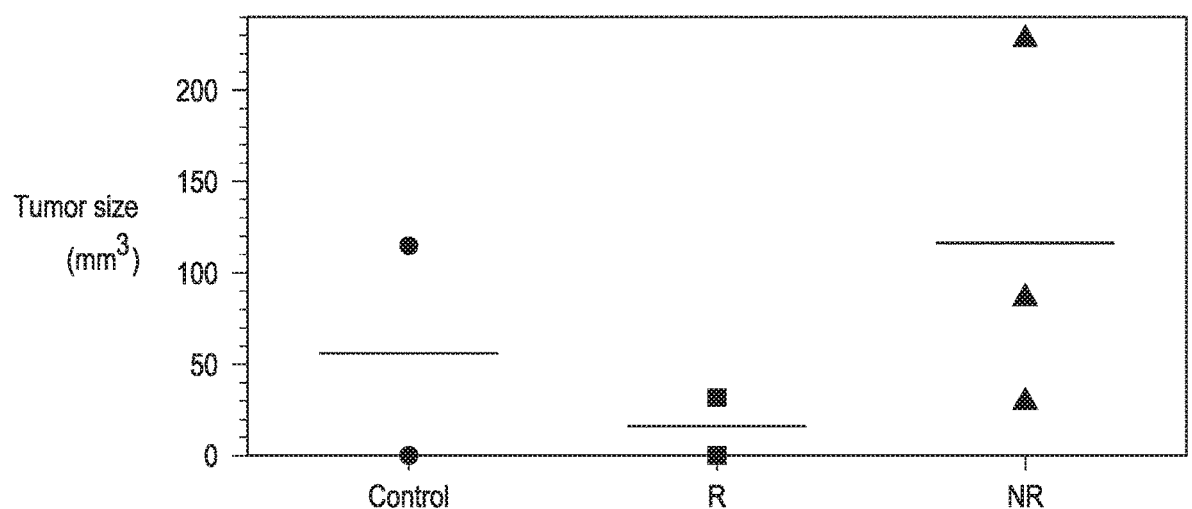
Figure 28C:
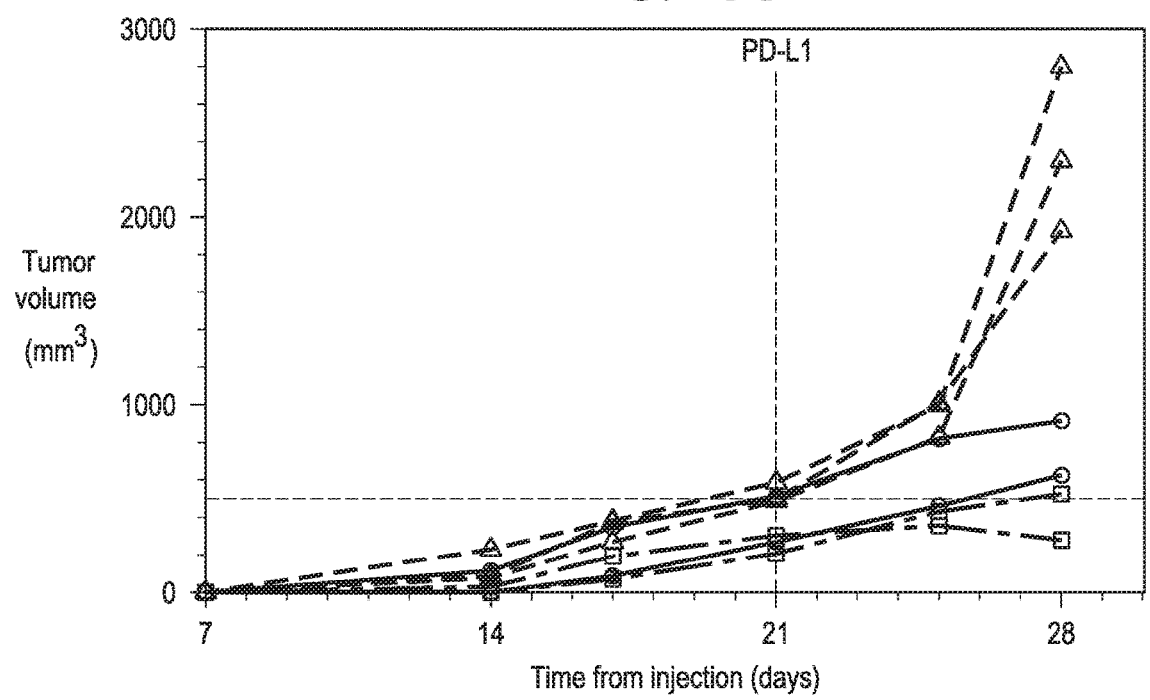

FIGS. 28A-C: FMT of a favorable gut microbiome in GF mice reduces tumor growth and enhances response to α-PD-L1 therapy. (A) Experimental design of FMT2 experiment in germ-free (GF) mice. Time is indicated in days (D) relative to the day of tumor injection (2.5×10$^{-5}$ tumor cells). (B) Difference in size of tumors implanted in R-FMT (R, squares) and NR-FMT mice (NR, triangles), or control mice (circles). Tumor volumes on day 14 post-tumor implantation are plotted, each value representing a single mouse. (C) Tumor growth curves for each GF mouse from α-PD-L1 treated (3×100 µg ip every 3 days) R-FMT (squares, n=2, median tumor volume=403.7 mm$^3$), NR-FMT (triangles, n=2, median tumor volume=2301 mm$^3$), and Control (circles, n=2, median tumor volume=771.35 mm$^3$) mice. p=0.20 (R-FMT vs NR-FMT), p=0.33 (NR-FMT vs Control by two-sided MW test). Dotted black line marks the tumor size cutoff for α-PD-L1 treatment (500 mm$^3$).

FIGS. 29A-E: Enhanced therapeutic response upon favorable FMT correlates with increased innate effector and reduced myeloid suppressor infiltration in tumors in GF mice. (A) Flow cytometry quantification showing the frequency of CD45$^+$ immune cells in R-FMT, NR-FMT, and control mice infiltrating the tumor, as indicated. (B) Flow cytometry representative plots of CD45$^+$CD11b$^+$Ly6G$^+$ innate effector cells and (D) CD11b$^+$CD11c$^+$ suppressive myeloid cells in Control (left), NR-FMT (middle), and R-FMT (right) mice. (C) Flow cytometry quantification showing the frequency of CD45$^+$CD11b$^+$Ly6G$^+$ innate effector cells and (E) CD45$^+$CD11b$^+$CD11c$^+$ suppressive cells in R-FMT, NR-FMT, and control mice infiltrating the tumor, as indicated.

FIGS. 30A-D: GF mice receiving FMT from NR-donor have highly activated Th17 compartment. (A) Representative images of IHC staining for Retinoic acid-related orphan receptor gamma t (RORγT) nuclear receptor on tumors from R-FMT (right), NR-FMT (middle), and control (left) mice. Arrows point to RORγT-positive cells. (B) IHC quantification showing the number of RORγT+Th17 cells in R-FMT (R), NR-FMT (NR), and control mice (C) in tumor as counts/mm$^2$. (C) Flow cytometry quantification showing the frequency of CD4$^+$ FoxP3+ regulatory T cells in R-FMT (R), NR-FMT (NR), and control mice (C) in spleen. (D) Flow cytometry quantification showing the frequency of CD4$^+$ IL17+Th17 cells in R-FMT (R), NR-FMT (NR), and control mice (C) in spleen.

Figure 31A:
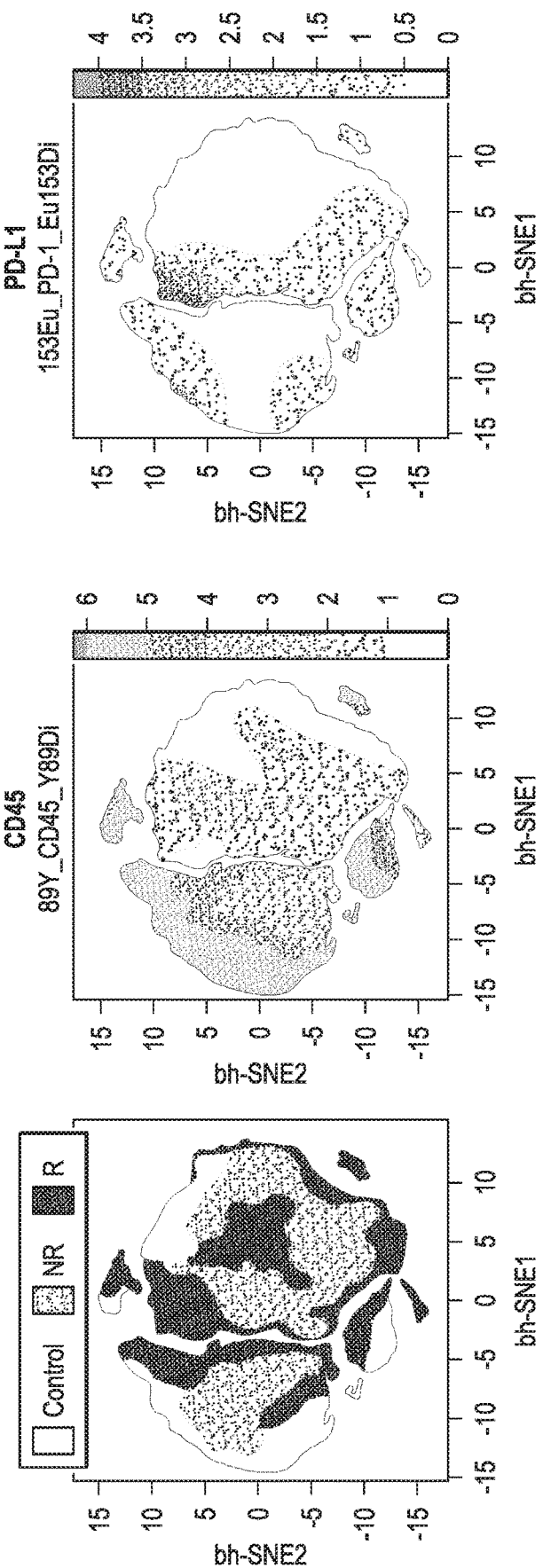
Figure 31B:
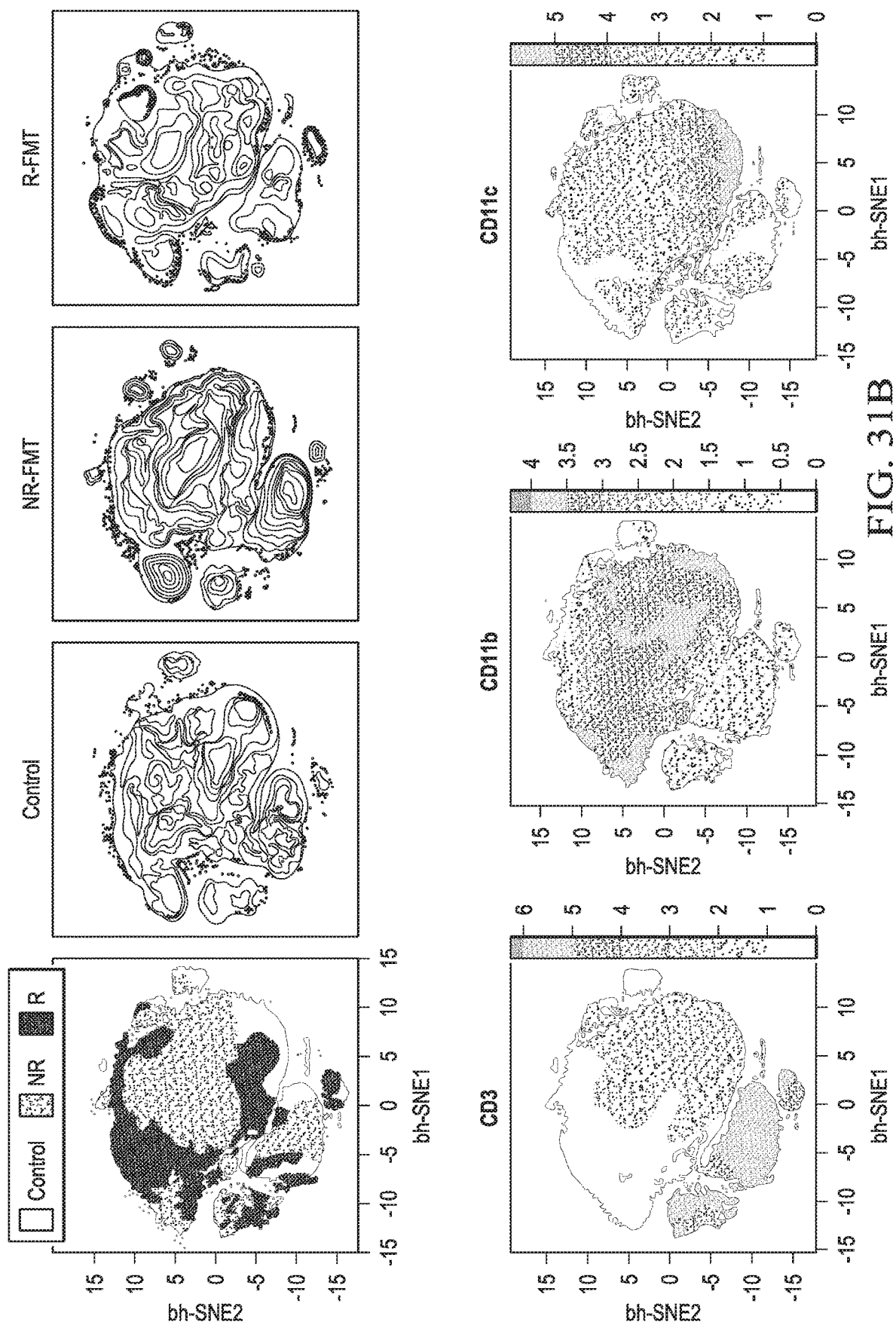

FIGS. 31A-B: Up-regulation of PD-L1 in the tumor microenvironment of mice receiving R-FMT versus NR-FMT by mass cytometry (CyTOF). (A) t-SNE plot of total live cells (left) isolated from tumors derived from control, NR-, and R-colonized mice, as indicated, by mass cytometry. t-SNE plot of total live cells overlaid with the expression of CD45 (middle) and PD-L1 (right). Equal numbers of cells are displayed from each group. (B) (top left) t-SNE plot of total CD45$^+$ cells isolated from tumors derived from control, NR-FMT, and R-FMT mice, as indicated, by CyTOF. (top right) Density plots of total CD45$^+$ cells isolated from tumors derived from the indicated experimental groups. (bottom) t-SNE plot of total CD45$^+$ cells overlaid with the expression of indicated markers.

Figure 32A:
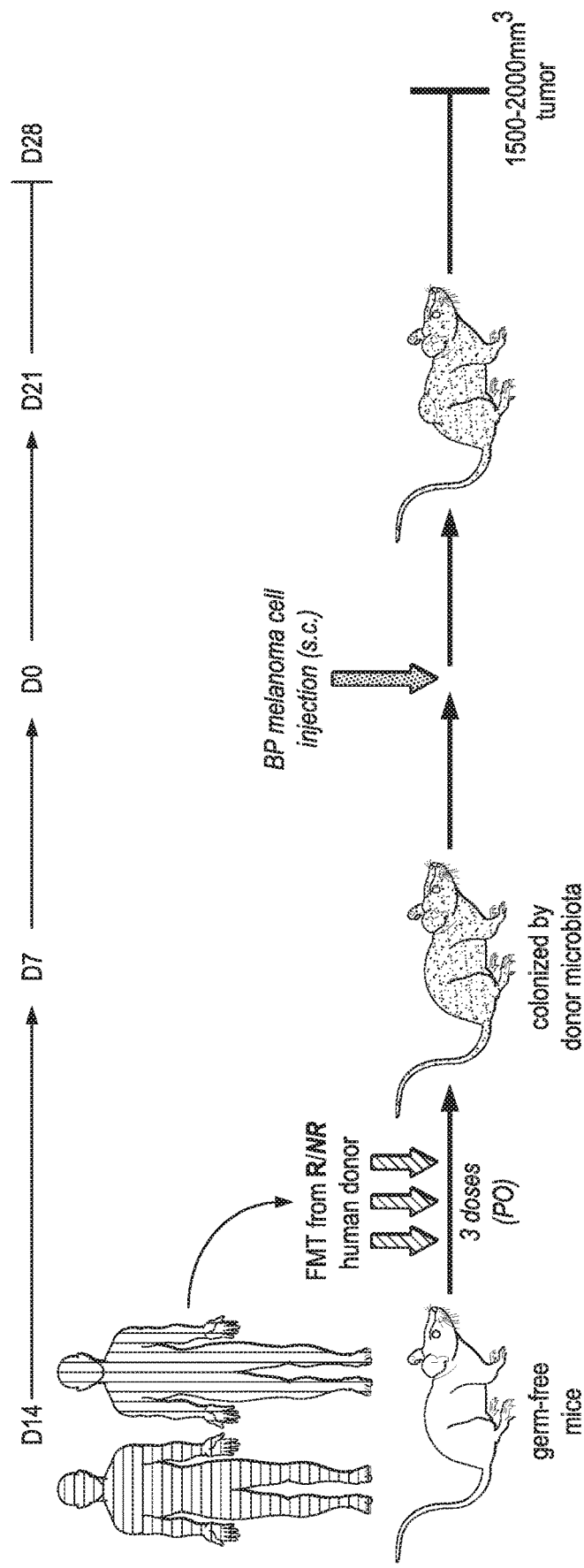
Figure 32B:
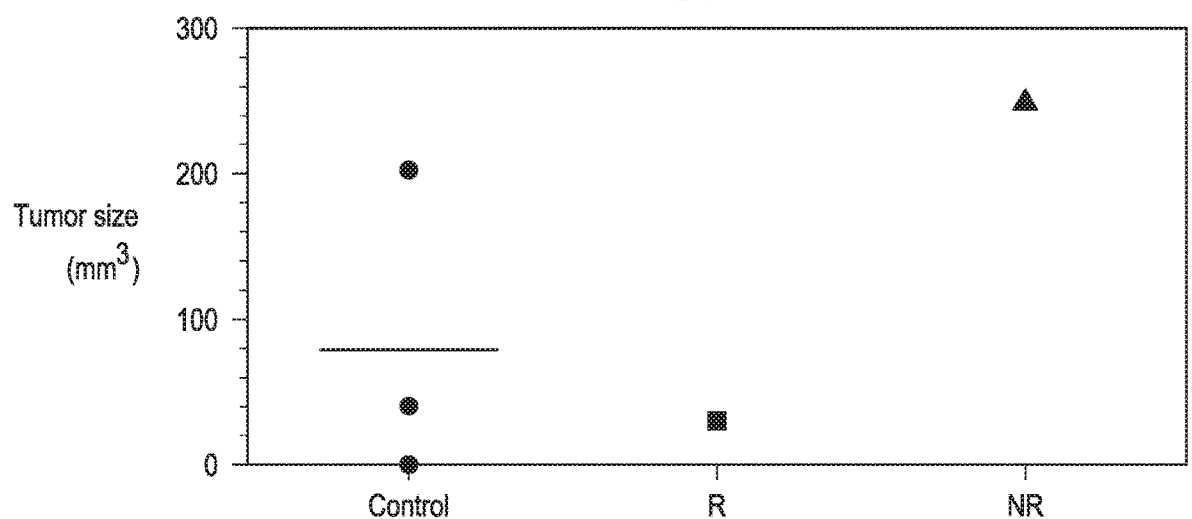
Figure 32C:
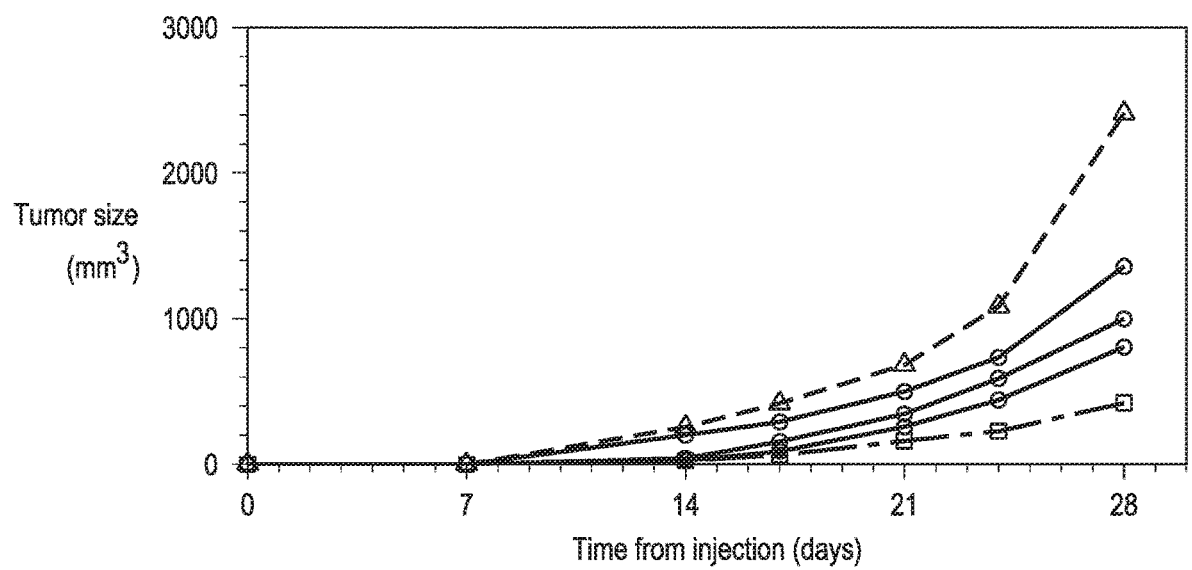
Figure 33A:
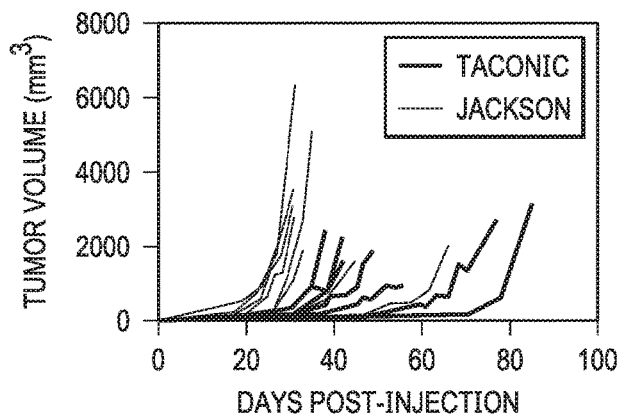
Figure 33B:
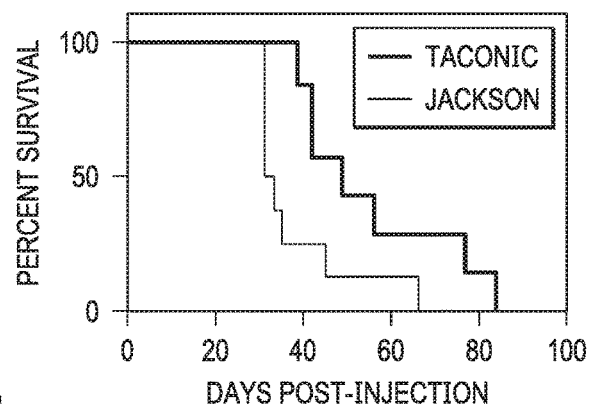
Figure 33C:
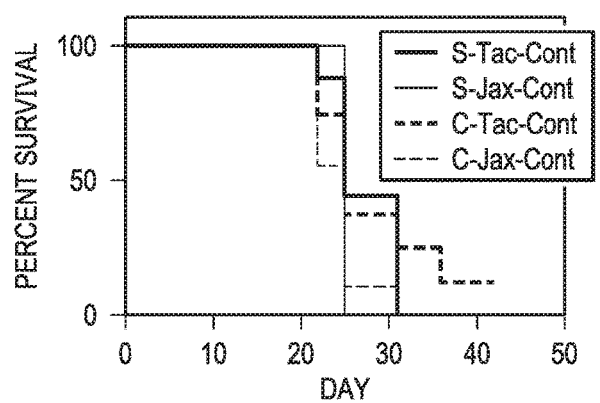
Figure 33F:
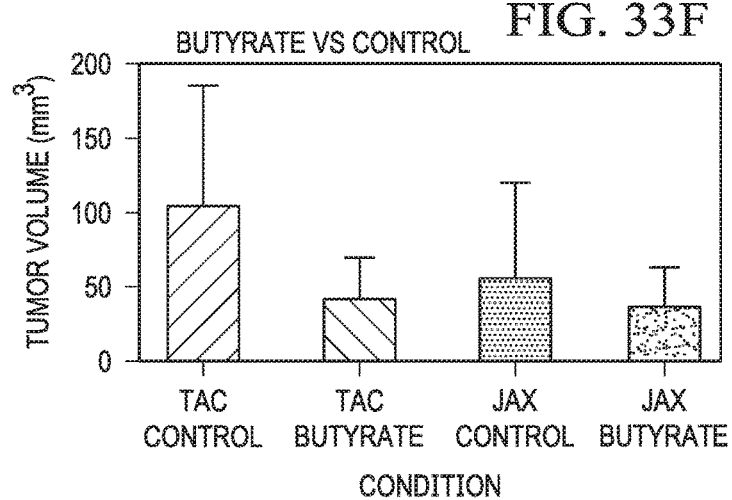
Figure 33E:
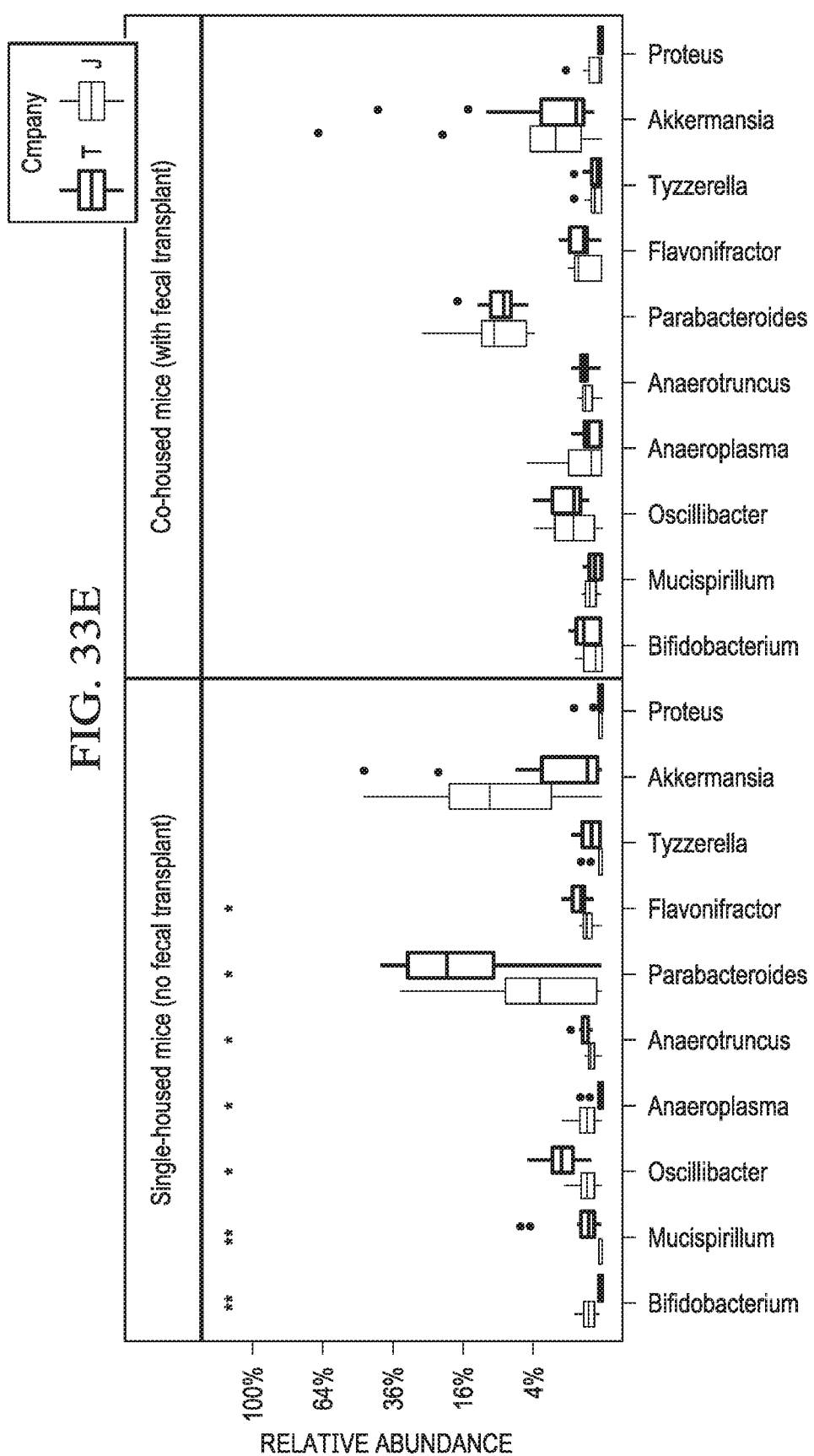

FIGS. 32A-C: FMT from another R-donor in GF mice confirms the impact of a favorable gut microbiome on tumor growth. (A) Experimental design of FMT2 experiment in germ-free (GF) mice. Time is indicated in days (D) relative to the day of tumor injection (2.5×10$^{-5}$ tumor cells). (B) Difference in size of tumors implanted in R-FMT (squares) and NR-FMT mice (triangles), or control mice (circles). Tumor volumes on day 14 post-tumor implantation are plotted, each value representing a single mouse. (C) Tumor growth curves for each GF mouse from R-FMT (square, tumor volume=414.3 mm$^3$), NR-FMT (triangle, tumor volume=1909.1 mm$^3$), and Control (circle, n=3, median tumor volume=1049.3 mm$^3$) mice.

FIGS. 33A-33F: Genetically-identical C57/BL6 mice from Jackson and Taconic exhibit differential tumor growth (earlier in Jackson) (A), survival (higher in Taconic) (B-C), and microbiome composition (Taconic single-housed upper right; Jackson single-housed lower right) (D) after implantation of murine melanoma tumors (BRAF-mutant, PTEN-null). Co-housing of Taconic and Jackson mice resulted in similar tumor outgrowth (C) and increased microbiome similarity was observed by principal coordinate analysis (D). Differential abundance at the genus level was observed in singly-housed mice from Jackson and Taconic, but no differences were noted after co-housing (E). Oral administration of butyrate significantly delayed tumor outgrowth in mice implanted with melanoma tumors (F).

Figure 34A:
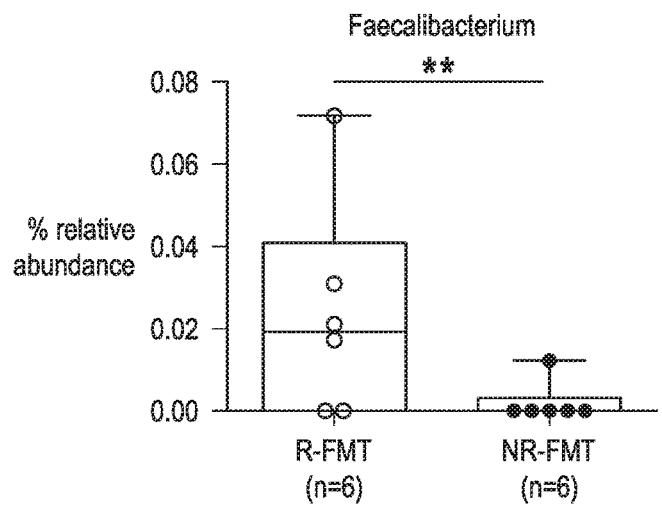
Figure 34B:
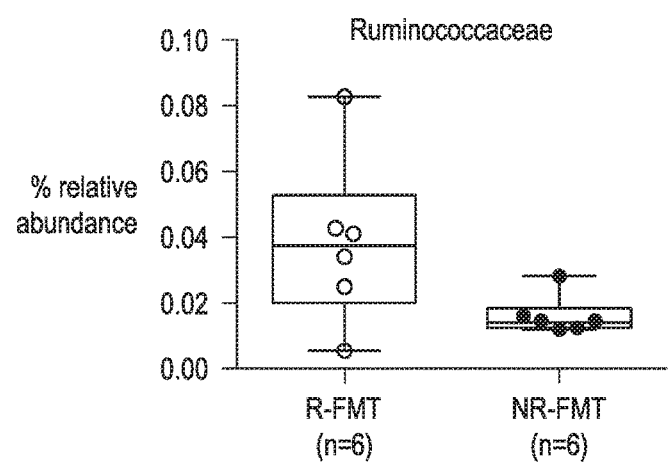
Figure 34C:
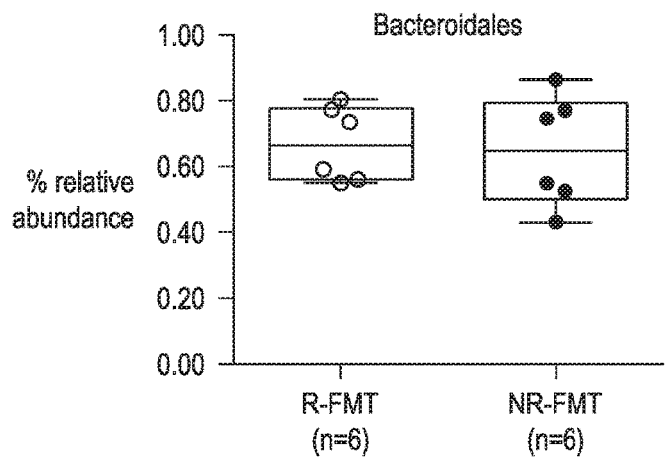

FIGS. 34A-C: 16S analysis of fecal samples from R and NR donors and germ-free recipient mice. Relative abundance comparisons of (A) *Faecalibacterium*, (B) Ruminococcaceae and (C) Bacteroidales on day 14 post tumor injection. Data from 2 independent experiments are presented. **p<0.01.

DESCRIPTION OF ILLUSTRATIVE EMBODIMENTS

Tremendous advances have been made in cancer therapy through the use of molecularly targeted therapy and immunotherapy, however responses are variable and are not always durable. Treatment with immune checkpoint inhibitors is associated with response rates of 15-40% in patients with widespread melanoma, and efforts are underway to identify strategies to enhance responses to checkpoint inhibitor therapy. Thus, methods to improve therapeutic responses as well as increase the number of responders are critically needed.

The present disclosure overcomes problems with current technologies by providing methods to modulate the microbiome to improve immune response to cancer and therapeutic response to immune checkpoint inhibitors in cancer patients. Studies in the present disclosure used a large cohort of patients with metastatic melanoma undergoing systemic treatment (n=233), a subset of whom were treated with PD-1-based immunotherapy (n=112). Oral and gut microbiome samples were characterized in these patients via 16S rRNA gene sequencing and metagenomic whole genome shotgun sequencing. In these analyses, significant differences were observed in the diversity and composition of the gut microbiome in responders versus non-responders to immune checkpoint blockade therapy (e.g., to PD-1-based therapy), with a significantly higher diversity and increased abundance of specific bacteria (e.g., within the order Clostridiales and family Ruminococcaceae) in the gut microbiome of responders versus non-responders. In particular, the species *Faecalibacterium prausnitzii* was found to be more abundant in responders. These bacteria are known to produce short chain fatty acids such as butyrate, which help sustain the integrity of specific cells within the gut (i.e., enterocytes) and may enhance immunity.

Interestingly, non-responders to therapy were noted to have low levels of these bacteria and significantly higher levels of bacteria of the order Bacteroidales, which has been shown in some studies to down-regulate systemic immune responses. Metagenomic analysis via whole genome shotgun sequencing was performed in a subset of these patients validating these findings, and further demonstrated differences in metabolic processes in bacteria of responders versus non-responders. Furthermore, it was demonstrated that modulation of the gut microbiome by co-housing Taconic and Jackson mice and by oral administration of short chain fatty acids (e.g., butyrate) resulted in delayed tumor outgrowth in mice with a less favorable gut microbiome (Jackson mice). These results from human and murine studies have potentially far-reaching implications to enhance responses to immune checkpoint blockade via modulation of the gut microbiome.

Importantly, the present studies show that patients with a "favorable" gut microbiome (with high diversity and high relative abundance of bacteria of the order Clostridiales and/or family Ruminococcaceae) have enhanced systemic and anti-tumor immune responses mediated by enhanced antigen presentation at the level of the lymph node and tumor, as well as preserved effector T cell function in the periphery and the tumor microenvironment. In contrast, patients with an "unfavorable" gut microbiome (with low diversity and high relative abundance of bacteria of the order Bacteroidales) have impaired systemic and anti-tumor immune responses mediated by limited intratumoral infiltration of both lymphoid and myeloid elements, weakened antigen presentation capacity, and skewing towards immunoregulatory cellular and humoral elements in the periphery, including Treg and MDSC.

Further studies were also undertaken in a mouse melanoma model system. These studies showed mice that received fecal microbiota transplantation from a responder population had decreased tumor growth and increased response to anti-PDL1 therapy. Moreover, mice that received transplantation of a responder microbial popultion had higher percentages of innate effector cells (expressing $CD45^+CD11b^+Ly6G^+$) and lower frequency of suppressive myeloid cells (expressing $CD11b^+CD11c^+$) in the spleen as well as an increased the number of $CD45^+$ immune and $CD8^+$ T cells in the gut. These findings highlight the potential for parallel modulation of the gut microbiome to significantly enhance checkpoint blockade efficacy, warranting prompt evaluation in clinical trials.

Based on these findings, methods of cancer treatment and diagnosis are provided herein. In one method, short-chain fatty acids, such as butyrate and/or a population of short-chain fatty acid-producing bacteria, such as butyrate-producing bacteria, are administered to patients during treatment with immune checkpoint blockade to enhance therapeutic responses. Also provided herein are methods to use the diversity and composition of the gut microbiome as a predictive biomarker to identify patients who will have a favorable response to immune checkpoint blockade.

I. DEFINITIONS

As used herein, "essentially free," in terms of a specified component, is used herein to mean that none of the specified component has been purposefully formulated into a composition and/or is present only as a contaminant or in trace amounts. The total amount of the specified component resulting from any unintended contamination of a composition is therefore well below 0.01%. Most preferred is a composition in which no amount of the specified component can be detected with standard analytical methods.

As used herein, "a" or "an" may mean one or more than one.

The use of the term "or" in the claims is used to mean "and/or" unless explicitly indicated to refer to alternatives only or the alternatives are mutually exclusive, although the disclosure supports a definition that refers to only alternatives and "and/or." As used herein, the term "another" may mean at least a second or more.

Throughout this application, the term "about" is used to indicate that a value includes the inherent variation of error for the device, the method being employed to determine the value, or the variation that exists among the study subjects.

The phrase "effective amount" or "therapeutically effective amount" or "sufficient amount" means a dosage of a drug or agent sufficient to produce a desired result. The desired result can be a decrease in tumor size, a decrease in the rate of growth of cancer cells, a decrease in metastasis, increase in $CD8^+$ T lymphocytes in the tumor or tumor immune infiltrate, an increase in CD45+, CD3+/CD20+/CD56+, CD68+ and/or HLA-DR+ cells in the tumor, an increase in CD3, CD8, PD1, FoxP3, Granzyme B and/or PD-L1 expression in a tumor immune infiltrate, a decrease in RORγT expression in a tumor immune infiltrate, an increase of effector $CD4^+$, $CD8^+$ T, monocytes and/or myeloid dendritic cell in the systemic circulation or the peripheral blood, a decrease of B cells, regulatory T cells and/or myeloid derived suppressor cells in the systemic circulation or the peripheral blood of the subject or any combination of the above.

The term "tumor cell" or "cancer cell" denotes a cell that demonstrates inappropriate, unregulated proliferation. A "human" tumor is comprised of cells that have human chromosomes. Such tumors include those in a human patient, and tumors resulting from the introduction into a non-human host animal of a malignant cell line having human chromosomes.

As used herein, the term "antibody" refers to an immunoglobulin, derivatives thereof which maintain specific binding ability, and proteins having a binding domain which is homologous or largely homologous to an immunoglobulin binding domain. These proteins may be derived from natural sources, or partly or wholly synthetically produced. An antibody may be monoclonal or polyclonal. The antibody may be a member of any immunoglobulin class, including any of the human classes: IgG, IgM, IgA, IgD, and IgE. Antibodies used with the methods and compositions described herein are generally derivatives of the IgG class. The term antibody also refers to antigen-binding antibody fragments. Examples of such antibody fragments include, but are not limited to, Fab, Fab', F(ab')2, scFv, Fv, dsFv diabody, and Fd fragments. Antibody fragments may be produced by any means. For instance, the antibody fragment may be enzymatically or chemically produced by fragmentation of an intact antibody, it may be recombinantly produced from a gene encoding the partial antibody sequence, or it may be wholly or partially synthetically produced. The antibody fragment may optionally be a single chain antibody fragment. Alternatively, the fragment may comprise multiple chains which are linked together, for instance, by disulfide linkages. The fragment may also optionally be a multimolecular complex. A functional antibody fragment retains the ability to bind its cognate antigen at comparable affinity to the full antibody.

The term "monoclonal antibody" as used herein refers to an antibody obtained from a population of substantially homogeneous antibodies, e.g., the individual antibodies comprising the population are identical except for possible mutations, e.g., naturally occurring mutations, that may be present in minor amounts. Thus, the modifier "monoclonal" indicates the character of the antibody as not being a mixture of discrete antibodies. In certain embodiments, such a monoclonal antibody typically includes an antibody comprising a polypeptide sequence that binds a target, wherein the target-binding polypeptide sequence was obtained by a process that includes the selection of a single target binding polypeptide sequence from a plurality of polypeptide sequences. For example, the selection process can be the selection of a unique clone from a plurality of clones, such as a pool of hybridoma clones, phage clones, or recombinant DNA clones. It should be understood that a selected target binding sequence can be further altered, for example, to improve affinity for the target, to humanize the target binding sequence, to improve its production in cell culture, to reduce its immunogenicity in vivo, to create a multispecific antibody, etc., and that an antibody comprising the altered target binding sequence is also a monoclonal antibody of this disclosure. In contrast to polyclonal antibody preparations, which typically include several different antibodies directed against different determinants (epitopes), each monoclonal antibody of a monoclonal antibody preparation is directed against a single determinant on an antigen. In addition to their specificity, monoclonal antibody preparations are advantageous in that they are typically uncontaminated by other immunoglobulins.

The phrases "pharmaceutical composition" or "pharmacologically acceptable compisition" refers to molecular entities and compositions that do not produce an adverse, allergic, or other untoward reaction when administered to an animal, such as a human, as appropriate. The preparation of a pharmaceutical composition comprising an antibody or additional active ingredient will be known to those of skill in the art in light of the present disclosure. Moreover, for animal (e.g., human) administration, it will be understood that preparations should meet sterility, pyrogenicity, general safety, and purity standards as required by FDA Office of Biological Standards.

As used herein, "pharmaceutically acceptable carrier" includes any and all aqueous solvents (e.g., water, alcoholic/aqueous solutions, saline solutions, parenteral vehicles, such as sodium chloride, and Ringer's dextrose), non-aqueous solvents (e.g., propylene glycol, polyethylene glycol, vegetable oil, and injectable organic esters, such as ethyloleate), dispersion media, coatings, surfactants, antioxidants, preservatives (e.g., antibacterial or antifungal agents, anti-oxidants, chelating agents, and inert gases), isotonic agents, absorption delaying agents, salts, drugs, drug stabilizers, gels, binders, excipients, disintegration agents, lubricants, sweetening agents, flavoring agents, dyes, fluid and nutrient replenishers, such like materials and combinations thereof, as would be known to one of ordinary skill in the art. The pH and exact concentration of the various components in a pharmaceutical composition may be adjusted according to well-known parameters.

The term "unit dose" or "dosage" refers to physically discrete units suitable for use in a subject, each unit containing a predetermined quantity of the therapeutic composition calculated to produce the desired responses discussed herein in association with its administration, i.e., the appropriate route and treatment regimen. The quantity to be administered, both according to number of treatments and unit dose, depends on the effect desired. The actual dosage amount of a composition of the present embodiments administered to a patient or subject can be determined by physical and physiological factors, such as body weight, the age, health, and sex of the subject, the type of disease being treated, the extent of disease penetration, previous or concurrent therapeutic interventions, idiopathy of the patient, the route of administration, and the potency, stability, and toxicity of the particular therapeutic substance. For example, a dose may also comprise from about 1 µg/kg/body weight to about 1000 mg/kg/body weight (this such range includes intervening doses) or more per administration, and any particular dose derivable therein. In non-limiting examples of a range derivable from the numbers listed herein, a range of about 5 µg/kg/body weight to about 100 mg/kg/body weight, about 5 µg/kg/body weight to about 500 mg/kg/body weight, etc., can be administered. The practitioner responsible for administration will, in any event, determine the concentration of active ingredient(s) in a composition and appropriate dose(s) for the individual subject.

An "anti-cancer" agent is capable of negatively affecting a cancer cell/tumor in a subject, for example, by promoting killing of cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer.

The term "immune checkpoint" refers to a component of the immune system which provides inhibitory signals to its components in order to regulate immune reactions. Known immune checkpoint proteins comprise CTLA-4, PD-1 and its ligands PD-L1 and PD-L2 and in addition LAG-3, BTLA, B7H3, B7H4, TIM3, KIR. The pathways involving LAGS, BTLA, B7H3, B7H4, TIM3, and KIR are recognized in the art to constitute immune checkpoint pathways similar to the CTLA-4 and PD-1 dependent pathways (see e.g. Pardon, 2012, *Nature Rev Cancer* 12:252-264; Mellman et al., 2011, Nature 480:480-489).

The term "PD-1 axis binding antagonist" refers to a molecule that inhibits the interaction of a PD-1 axis binding partner with either one or more of its binding partners, so as to remove T-cell dysfunction resulting from signaling on the PD-1 signaling axis—with a result being to restore or enhance T-cell function (e.g., proliferation, cytokine production, target cell killing). The term "PD-1" axis" refers to any component of the PD-1 immune checkpoint (e.g., PD-1, PD-L1, and PD-L2). As used herein, a PD-1 axis binding antagonist includes a PD-1 binding antagonist, a PD-L1 binding antagonist and a PD-L2 binding antagonist.

The term "PD-1 binding antagonist" refers to a molecule that decreases, blocks, inhibits, abrogates or interferes with signal transduction resulting from the interaction of PD-1 with one or more of its binding partners, such as PD-L1 and/or PD-L2. The PD-1 binding antagonist may be a molecule that inhibits the binding of PD-1 to one or more of its binding partners. In a specific aspect, the PD-1 binding antagonist inhibits the binding of PD-1 to PD-L1 and/or PD-L2. For example, PD-1 binding antagonists include anti-PD-1 antibodies, antigen binding fragments thereof, immunoadhesins, fusion proteins, oligopeptides and other molecules that decrease, block, inhibit, abrogate or interfere with signal transduction resulting from the interaction of PD-1 with PD-L1 and/or PD-L2. An exemplary PD-1 binding antagonist is an anti-PD-1 antibody. For example the PD-1 binding antagonist is MDX-1106 (nivolumab), MK-3475 (pembrolizumab), CT-011 (pidilizumab), or AMP-224.

The term "PD-L1 binding antagonist" refers to a molecule that decreases, blocks, inhibits, abrogates or interferes with signal transduction resulting from the interaction of PD-L1 with either one or more of its binding partners, such as PD-1 or B7-1. For example, a PD-L1 binding antagonist is a molecule that inhibits the binding of PD-L1 to its binding partners. In a specific aspect, the PD-L1 binding antagonist inhibits binding of PD-L1 to PD-1 and/or B7-1. The PD-L1 binding antagonists may include anti-PD-L1 antibodies, antigen binding fragments thereof, immunoadhesins, fusion proteins, oligopeptides and other molecules that decrease, block, inhibit, abrogate or interfere with signal transduction resulting from the interaction of PD-L1 with one or more of its binding partners, such as PD-1 or B7-1. For example, a PD-L1 binding antagonist reduces the negative co-stimulatory signal mediated by or through cell surface proteins expressed on T lymphocytes mediated signaling through PD-L1 so as to render a dysfunctional T-cell less dysfunctional (e.g., enhancing effector responses to antigen recognition). In one example, a PD-L1 binding antagonist is an anti-PD-L1 antibody. The anti-PD-L1 antibody may be YW243.55.S70, MDX-1105, MPDL3280A, or MEDI4736.

The term "PD-L2 binding antagonist" refers to a molecule that decreases, blocks, inhibits, abrogates or interferes with signal transduction resulting from the interaction of PD-L2 with either one or more of its binding partners, such as PD-1. A PD-L2 binding antagonist may be a molecule that inhibits the binding of PD-L2 to one or more of its binding partners. For example, the PD-L2 binding antagonist inhibits binding of PD-L2 to PD-1, such as PD-L2 antagonists including anti-PD-L2 antibodies, antigen binding fragments thereof, immunoadhesins, fusion proteins, oligopeptides and other molecules that decrease, block, inhibit, abrogate or interfere with signal transduction resulting from the interaction of PD-L2 with either one or more of its binding partners, such as PD-1.

An "immune checkpoint inhibitor" refers to any compound inhibiting the function of an immune checkpoint protein. Inhibition includes reduction of function and full blockade. In particular the immune checkpoint protein is a human immune checkpoint protein. Thus the immune checkpoint protein inhibitor in particular is an inhibitor of a human immune checkpoint protein.

"Subject" and "patient" refer to either a human or non-human, such as primates, mammals, and vertebrates. In particular embodiments, the subject is a human.

As used herein, the terms "treat," "treatment," "treating," or "amelioration" when used in reference to a disease, disorder or medical condition, refer to therapeutic treatments for a condition, wherein the object is to reverse, alleviate, ameliorate, inhibit, slow down or stop the progression or severity of a symptom or condition. The term "treating" includes reducing or alleviating at least one adverse effect or symptom of a condition. Treatment is generally "effective" if one or more symptoms or clinical markers are reduced. Alternatively, treatment is "effective" if the progression of a condition is reduced or halted. That is, "treatment" includes not just the improvement of symptoms or markers, but also a cessation or at least slowing of progress or worsening of symptoms that would be expected in the absence of treatment. Beneficial or desired clinical results include, but are not limited to, alleviation of one or more symptom(s), diminishment of extent of the deficit, stabilized (i.e., not worsening) state of a tumor or malignancy, delay or slowing of tumor growth and/or metastasis, and an increased lifespan as compared to that expected in the absence of treatment.

The "gut microbiota" or "gut microbiome" designates the population of microorganisms living in the intestine of a subject.

The term "alpha diversity" is a measure of intra-sample diversity and refers to the distribution and assembly patterns of all microbiota within samples and is calculated as a scalar value for each sample. "Beta diversity" is a term for inter-sample diversity, and involves the comparison of samples to each which provides a measure of the distance or dissimilarity between each sample pair.

The term "relative amount", which can also be designated as the "relative abundance", is defined as the number of bacteria of a particular taxonomic level (from phylum to species) as a percentage of the total number of bacteria of that level in a biological sample. This relative abundance can be assessed, for example, by measuring the percentage of 16S rRNA gene sequences present in the sample which are assigned to these bacteria. It can be measured by any appropriate technique known by the skilled artisan, such as 454 pyrosequencing and quantitative PCR of these specific bacterial 16S rRNA gene markers or quantitative PCR of a specific gene.

In the present text, a "good responder to a treatment", also called a "responder" or "responsive" patient or in other words a patient who "benefits from" this treatment, refers to a patient who is affected with a cancer and who shows or will show a clinically significant relief in the cancer after receiving this treatment. Conversely, a "bad responder" or "non-responder" is one who does not or will not show a clinically significant relief in the cancer after receiving this treatment. The decreased response to treatment may be assessed according to the standards recognized in the art, such as immune-related response criteria (irRC), WHO or RECIST criteria.

The term "isolated" encompasses a bacterium or other entity or substance that has been (1) separated from at least some of the components with which it was associated when initially produced (whether in nature or in an experimental setting), and/or (2) produced, prepared, purified, and/or manufactured by the hand of man. Isolated bacteria may be separated from at least about 10%, about 20%, about 30%, about 40%, about 50%, about 60%, about 70%, about 80%, about 90%, or more of the other components with which they were initially associated. In some embodiments, isolated bacteria are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

The terms "purify," "purifying" and "purified" refer to a bacterium or other material that has been separated from at least some of the components with which it was associated either when initially produced or generated (e.g., whether in nature or in an experimental setting), or during any time after its initial production. A bacterium or a bacterial population may be considered purified if it is isolated at or after production, such as from a material or environment containing the bacterium or bacterial population, and a purified bacterium or bacterial population may contain other materials up to about 10%, about 20%, about 30%, about 40%, about 50%, about 60%, about 70%, about 80%, about 90%, or above about 90% and still be considered "isolated." In some embodiments, purified bacteria and bacterial populations are more than about 80%, about 85%, about 90%, about 91%, about 92%, about 93%, about 94%, about 95%, about 96%, about 97%, about 98%, about 99%, or more than about 99% pure. In the instance of bacterial compositions provided herein, the one or more bacterial types present in the composition can be independently purified from one or more other bacteria produced and/or present in the material or environment containing the bacterial type. Bacterial compositions and the bacterial components thereof are generally purified from residual habitat products.

II. PURIFIED BACTERIAL POPULATION

Embodiments of the present disclosure concern short-chain fatty acid-containing compositions, such as butyrate-containing compositions and purified bacterial populations (e.g., short-chain fatty acid-containing bacterial populations, such as butyrate-producing bacterial populations) for the treatment of cancer, such as in a subject being or having been administered an immune checkpoint inhibitor. In some embodiments, the subject is administered a prebiotic and/or probiotic to enrich for butyrate-producing bacteria. In certain aspects, the subject undergoes dietary changes to enrich for butyrate-producing bacteria.

In certain embodiments, the present disclosure provides probiotic compositions and live bacterial products which comprise bacterial populations beneficial for immune checkpoint therapy response. The probiotic composition may comprise bacteria of the phylum Firmicutes. The bacterial population may belong to the class Clostridia, specifically to the order Clostridales, or one or more bacterial populations may belong to the family Clostridiaceae, Ruminococcaceae (e.g., specifically to the genus *Ruminococcus* or the genus *Faecalibacterium*), Micrococcaceae (e.g., specifically to the genus *Rothia*), Lachnospiraceae, and/or Veilonellaceae. In further aspects, the bacterial population may belong to the phylum Tenericutes, particularly to the class Mollicutes. The bacteria may belong to the genus Peptoniphilus, particularly to the species *P. asaccharolyticus, P. gorbachii, P. harei, P. ivorii, P. lacrimalis,* and/or *P. olsenii*. Further exemplary bacterial populations for the probiotic composition may include bacterial populations that belong to the genus *Porphyromonas*, particularly to the species *Porphyromonas pasteri*, the species *Clostridium hungatei*, the genus *Phascolarctobacterium* or the species *Phascolarctobacterium faecium*.

For example, bacterial populations of the genus *Ruminococcus* can include bacteria of the species *Ruminococcus albus, Ruminococcus bromii, Ruminococcus callidus, Ruminococcus flavefaciens, Ruminococcus champanellensis, Ruminococcus faecis, Ruminococcus gauvreauii, Ruminococcus gnavus, Ruminococcus hansenii, Ruminococcus hydrogenotrophicus, Ruminococcus lactaris, Ruminococcus luti, Ruminococcus obeum, Ruminococcus palustris, Ruminococcus pasteurii, Ruminococcus productus, Ruminococcus schinkii,* and/or *Ruminococcus torques*. Bacterial populations of the genus *Faecalibacterium* can include bacteria of the species *Faecalibacterium prausnitzii*.

Exemplary bacterial populations of the genus *Rothia* can include bacteria of the species *R. aeria, R. amarae, R. dentocariosa, R. endophytica, R. mucilaginosa, R. nasimurium,* and/or *R. terrae*.

Exemplary bacterial populations for inclusion in the probiotic composition include bacterial populations that belong to the phylum Firmicutes, class Clostridia, family Ruminococcaceae, species *Faecalibacterium prausnitzii*, genus *Ruminococcus*, species *Porphyromonas* pasteri, family Veilonellaceae, species *Colostridium hungatei*, genus *Phascolarctobacterium*, species *Phascolarctobacterium faecium*, genus *Peptoniphilus*, family Micrococcaceae, class Mollicutes, and/or genus *Rothia*.

In particular aspects, the probiotic composition or live bacterial product does not comprise bacterial populations of the order Bacteroidales, such as of the genus *Bacteroides*, particularly of the species *B. thetaiotaomicron, B. fragilis, B. vulgatus, B. distasonis, B. ovatus, B. stercoris, B. merda, B. uniformis, B. eggerithii,* or *B. caccae*. In particular, the probiotic composition does not comprise bacterial populations of the genus *Gardnerella* or of the species *Collinsella stercoris, Desulfovibrio alaskensis, Bacteroides mediterraneensis, Prevotella histicola* or *Gardnerella vaginalis*.

TABLE 1

Operational taxonomic units of Sets 1-3

| OTUs | Set | TAX_id | Phylum | Class | Order | Family | Genus | Species | ei |
|---|---|---|---|---|---|---|---|---|---|
| OTU_219 | SET 3 | 28113 | Bacteroidetes | Bacteroidia | Bacteroidales | Bacteroidaceae | Bacteroides | *Bacteroides heparinolyticus* | −1.00 |
| OTU_140 | SET 3 | 185237 | Bacteroidetes | Bacteroidia | Bacteroidales | Prevotellaceae | Prevotellamassilia | *Prevotellamassilia timonensis* | −1.00 |
| OTU_320 | SET 3 | 1122135 | Proteobacteria | Alphaproteobacteria | Kiloniellales | Kiloniellaceae | Kiloniella | *Kiloniella laminariae* DSM 19542 | −1.00 |
| OTU_166 | SET 3 | 1796646 | Bacteroidetes | Bacteroidia | Bacteroidales | Prophyromonadaceae | Muribaculum | *Muribaculum intestinale* | −1.00 |
| OTU_1381 | SET 3 | 1348613 | Firmicutes | Clostridia | Clostridiales | Defluviitaleaceae | Vallitalea | *Vallitalea pronyensis* | −0.64 |
| OTU_2558 | SET 3 | 1841856 | Bacteroidetes | Bacteroidia | Bacteroidales | Bacteroidaceae | Bacteroides | *Bacteroides mediterraneensis* | −1.00 |
| OTU_788 | SET 3 | 1002367 | Bacteroidetes | Bacteroidia | Bacteroidales | Prevotellaceae | Prevotella | *Prevotella stercorea* DSM 18206 | −1.00 |
| OTU_1772 | SET 3 | 1841856 | Bacteroidetes | Bacteroidia | Bacteroidales | Bacteroidaceae | Bacteroides | *Bacteroides mediterraneensis* | −1.00 |
| OTU_2085 | SET 3 | 58134 | Firmicutes | Clostridia | Clostridiales | Lachnospiraceae | Lachnoclostridium | *[Desulfotomaculum] guttoideum* | −1.00 |
| OTU_648 | SET 3 | 1527 | Firmicutes | Clostridia | Clostridiales | Lachnospiraceae | Anaerocolumna | *Anaerocolumna aminovalerica* | −1.00 |
| OTU_623 | SET 3 | 187979 | Firmicutes | Negativicutes | Selenomonadales | Selenomonadaceae | Mitsuokella | *Mitsuokella jalaludinii* | −1.00 |
| OTU_671 | SET 3 | 1841857 | Bacteroidetes | Bacteroidia | Bacteroidales | Odoribacteraceae | Culturomica | *Culturomica massiliensis* | −1.00 |
| OTU_600 | SET 3 | 387661 | Bacteroidetes | Bacteroidia | Bacteroidales | Porphyromonadaceae | Parabacteroides | *Parabacteroides johnsonii* | −1.00 |
| OTU_1038 | SET 3 | 1841857 | Bacteroidetes | Bacteroidia | Bacteroidales | Odoribacteraceae | Culturomica | *Culturomica massiliensis* | −1.00 |
| OTU_2899 | SET 3 | 357276 | Bacteroidetes | Bacteroidia | Bacteroidales | Bacteroidaceae | Bacteroides | *Bacteroides dorei* | −0.64 |
| OTU_1079 | SET 3 | 45254 | Bacteroidetes | Bacteroidia | Bacteroidales | Porphyromonadaceae | Dysgonomonas | *Dysgonomonas capnocytophagoides* | −1.00 |
| OTU_546 | SET 3 | 762984 | Bacteroidetes | Bacteroidia | Bacteroidales | Bacteroidaceae | Bacteroides | *Bacteroides clarus* YIT 12056 | −1.00 |
| OTU_1213 | SET 3 | 544645 | Bacteroidetes | Bacteroidia | Bacteroidales | Odoribacteraceae | Butyricimonas | *Butyricimonas virosa* | −0.55 |
| OTU_823 | SET 3 | 204516 | Bacteroidetes | Bacteroidia | Bacteroidales | Bacteroidaceae | Bacteroides | *Bacteroides massiliensis* | −0.55 |
| OTU_954 | SET 3 | 1796646 | Bacteroidetes | Bacteroidia | Bacteroidales | Porphyromonadaceae | Muribaculum | *Muribaculum intestinale* | −1.00 |
| OTU_886 | SET 3 | 537011 | Bacteroidetes | Bacteroidia | Bacteroidales | Prevotellaceae | Prevotella | *Prevotella copri* DSM 18205 | −0.55 |
| OTU_2805 | SET 3 | 52226 | Firmicutes | Negativicutes | Selenomonadales | Selenomonadaceae | Mitsuokella | *Mitsuokella multacida* | −1.00 |
| OTU_611 | SET 3 | 742742 | Actinobacteria | Coriobacteriia | Coriobacteriales | Coriobacteriaceae | Collinsella | *Collinsella tanakaei* YIT 12063 | −1.00 |
| OTU_1853 | SET 3 | 291644 | Bacteroidetes | Bacteroidia | Bacteroidales | Bacteroidaceae | Bacteroides | *Bacteroides salyersiae* | −1.00 |
| OTU_1691 | SET 3 | 484018 | Bacteroidetes | Bacteroidia | Bacteroidales | Bacteroidaceae | Bacteroides | *Bacteroides plebeius* DSM 17135 | −1.00 |
| OTU_2206 | SET 3 | 484018 | Bacteroidetes | Bacteroidia | Bacteroidales | Bacteroidaceae | Bacteroides | *Bacteroides plebeius* DSM 17135 | −1.00 |
| OTU_749 | SET 3 | 204516 | Bacteroidetes | Bacteroidia | Bacteroidales | Bacteroidaceae | Bacteroides | *Bacteroides massiliensis* | −1.00 |
| OTU_2557 | SET 3 | 1841856 | Bacteroidetes | Bacteroidia | Bacteroidales | Bacteroidaceae | Bacteroides | *Bacteroides mediterraneensis* | −1.00 |
| OTU_2249 | SET 3 | 820 | Bacteroidetes | Bacteroidia | Bacteroidales | Bacteroidaceae | Bacteroides | *Bacteroides uniformis* | −1.00 |
| OTU_418 | SET 3 | 1796620 | Firmicutes | Clostridia | Clostridiales | Ruminococcaceae | Acutalibacter | *Acutalibacter muris* | −0.51 |
| OTU_2640 | SET 3 | 342942 | Firmicutes | Clostridia | Clostridiales | Lachnospiraceae | Lachnoclostridium | *[Clostridium] glycyrrhizinilyticum* | −1.00 |
| OTU_2555 | SET 3 | 1841856 | Bacteroidetes | Bacteroidia | Bacteroidales | Bacteroidaceae | Bacteroides | *Bacteroides mediterraneensis* | −1.00 |
| OTU_1263 | SET 3 | 169435 | Firmicutes | Clostridia | Clostridiales | Ruminococcaceae | Anaerotruncus | *Anaerotruncus colihominis* | −1.00 |
| OTU_1641 | SET 3 | 1298596 | Firmicutes | Clostridia | Clostridiales | Ruminococcaceae | Ruminococcus | *Ruminococcus faecis* JCM 15917 | −1.00 |
| OTU_884 | SET 3 | 147206 | Actinobacteria | Coriobacteriia | Coriobacteriales | Coriobacteriaceae | Collinsella | *Collinsella stercoris* | −1.00 |
| OTU_2384 | SET 3 | 290054 | Firmicutes | Clostridia | Clostridiales | Eubacteriaceae | Eubacterium | *Eubacterium coprostanoligenes* | −0.64 |
| OTU_620 | SET 3 | 253257 | Firmicutes | Clostridia | Clostridiales | Lachnospiraceae | Lachnoclostridium | *[Clostridium] amygdalinum* | −0.80 |
| OTU_1559 | SET 3 | 817 | Bacteroidetes | Bacteroidia | Bacteroidales | Bacteroidaceae | Bacteroides | *Bacteroides fragilis* | −0.64 |
| OTU_3115 | SET 3 | 47678 | Bacteroidetes | Bacteroidia | Bacteroidales | Bacteroidaceae | Bacteroides | *Bacteroides caccae* | −0.64 |
| OTU_935 | SET 3 | 40545 | Proteobacteria | Betaproteobacteria | Burkholderiales | Sutterellaceae | Sutterella | *Sutterella wadsworthensis* | −1.00 |
| OTU_2415 | SET 3 | 645466 | Firmicutes | Clostridia | Clostridiales | Lachnospiraceae | Anaerostipes | *Anaerostipes butyraticus* | −1.00 |
| OTU_876 | SET 3 | 1776382 | Firmicutes | Clostridia | Clostridiales | Ruminococcaceae | Neglecta | *Neglecta timonensis* | −0.64 |
| OTU_1027 | SET 3 | 1852367 | Firmicutes | Clostridia | Clostridiales | Clostridiales Family XIII. Incertae Sedis | Ihubacter | *Ihubacter massiliensis* | −0.64 |
| OTU_2412 | SET 3 | 1532 | Firmicutes | Clostridia | Clostridiales | Lachnospiraceae | Blautia | *Blautia coccoides* | −1.00 |
| OTU_1305 | SET 3 | 1841857 | Bacteroidetes | Bacteroidia | Bacteroidales | Odoribacteraceae | Culturomica | *Culturomica massiliensis* | −1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1554 | SET 3 | 1535 | Firmicutes | Clostridia | Clostridiales | Ruminococcaceae | Ruminiclostridium | [Clostridium] leptum | -1.00 |
| OTU_567 | SET 3 | 333367 | Firmicutes | Clostridia | Clostridiales | Lachnospiraceae | Lachnoclostridium | [Clostridium] asparagiforme | -0.55 |
| OTU_815 | SET 3 | 544645 | Bacteroidetes | Bacteroidia | Bacteroidales | Odoribacteraceae | Butyricimonas | Butyricimonas virosa | -1.00 |
| OTU_1898 | SET 3 | 454154 | Bacteroidetes | Bacteroidia | Bacteroidales | Prevotellaceae | Paraprevotella | Paraprevotella clara | -0.64 |
| OTU_1143 | SET 3 | 46503 | Bacteroidetes | Bacteroidia | Bacteroidales | Porphyromonadaceae | Parabacteroides | Parabacteroides merdae | -1.00 |
| OTU_3106 | SET 3 | 454154 | Bacteroidetes | Bacteroidia | Bacteroidales | Prevotellaceae | Paraprevotella | Paraprevotella clara | -1.00 |
| OTU_576 | SET 3 | 1535 | Firmicutes | Clostridia | Clostridiales | Ruminococcaceae | Ruminiclostridium | [Clostridium] leptum | -0.59 |
| OTU_740 | SET 3 | 156456 | Firmicutes | Negativicutes | Veillonellales | Veillonellaceae | Anaeroglobus | Anaeroglobus geminatus | -1.00 |
| OTU_1827 | SET 3 | 470145 | Bacteroidetes | Bacteroidia | Bacteroidales | Bacteroidaceae | Bacteroides | Bacteroides coprocola DSM 17136 | -1.00 |
| OTU_3025 | SET 3 | 169435 | Firmicutes | Clostridia | Clostridiales | Ruminococcaceae | Anaerotruncus | Anaerotruncus colihominis | -1.00 |
| OTU_1709 | SET 3 | 46206 | Firmicutes | Clostridia | Clostridiales | Lachnospiraceae | Pseudobutyrivibrio | Pseudobutyrivibrio ruminis | -1.00 |
| OTU_3158 | SET 3 | 820 | Bacteroidetes | Bacteroidia | Bacteroidales | Bacteroidaceae | Bacteroides | Bacteroides uniformis | -1.00 |
| OTU_2415 | SET 3 | 544645 | Bacteroidetes | Bacteroidia | Bacteroidales | Odoribacteraceae | Butyricimonas | Butyricimonas virosa | -0.64 |
| OTU_3211 | SET 3 | 449673 | Bacteroidetes | Bacteroidia | Bacteroidales | Bacteroidaceae | Bacteroides | Bacteroides stercoris ATCC 43183 | -0.64 |
| OTU_2912 | SET 3 | 180164 | Firmicutes | Clostridia | Clostridiales | Lachnospiraceae | Blautia | Blautia schinkii | -1.00 |
| OTU_3210 | SET 3 | 1232428 | Firmicutes | Negativicutes | Veillonellales | Veillonellaceae | Megasphaera | Megasphaera massiliensis | -0.75 |
| OTU_2843 | SET 3 | 449673 | Bacteroidetes | Bacteroidia | Bacteroidales | Bacteroidaceae | Bacteroides | Bacteroides stercoris ATCC 43183 | -0.75 |
| OTU_1531 | SET 3 | 1232428 | Firmicutes | Negativicutes | Veillonellales | Veillonellaceae | Megasphaera | Megasphaera massiliensis | -1.00 |
| OTU_750 | SET 3 | 239935 | Verrucomicrobia | Verrucomicrobiae | Verrucomicrobiales | Akkermansiaceae | Akkermansia | Akkermansia muciniphila | -0.55 |
| OTU_1801 | SET 3 | 204516 | Bacteroidetes | Bacteroidia | Bacteroidales | Bacteroidaceae | Bacteroides | Bacteroides massiliensis | -0.80 |
| OTU_1621 | SET 3 | 84026 | Firmicutes | Clostridia | Clostridiales | Ruminococcaceae | Ruminiclostridium | [Clostridium] methylpentosum | -1.00 |
| OTU_2179 | SET 3 | 449673 | Bacteroidetes | Bacteroidia | Bacteroidales | Bacteroidaceae | Bacteroides | Bacteroides stercoris ATCC 43183 | -1.00 |
| OTU_2121 | SET 3 | 1544 | Firmicutes | Clostridia | Clostridiales | Lachnospiraceae | Lachnoclostridium | [Clostridium] oroticum | -0.64 |
| OTU_2070 | SET 3 | 204516 | Bacteroidetes | Bacteroidia | Bacteroidales | Bacteroidaceae | Bacteroides | Bacteroides massiliensis | -1.00 |
| OTU_1071 | SET 3 | 585528 | Actinobacteria | Actinobacteria | Bifidobacteriales | Bifidobacteriaceae | Gardnerella | Gardnerella vaginalis ATCC 14018 = JCM 11026 | -1.00 |
| OTU_767 | SET 3 | 33039 | Firmicutes | Clostridia | Clostridiales | Lachnospiraceae | Blautia | [Ruminococcus] torques | -0.55 |
| OTU_2257 | SET 3 | 821 | Bacteroidetes | Bacteroidia | Bacteroidales | Bacteroidaceae | Bacteroides | Bacteroides vulgatus | -0.55 |
| OTU_2072 | SET 3 | 339860 | Euryarchaeota | Methanobacteria | Methanobacteriales | Methanobacteriaceae | Methanosphaera | Methanosphaera stadmanae DSM 3091 | -1.00 |
| OTU_1321 | SET 3 | 1535 | Firmicutes | Clostridia | Clostridiales | Ruminococcaceae | Ruminiclostridium | [Clostridium] leptum | -1.00 |
| OTU_2533 | SET 3 | 308994 | Firmicutes | Negativicutes | Veillonellales | Veillonellaceae | Dialister | Dialister propionicifaciens | -1.00 |
| OTU_1105 | SET 3 | 1796102 | Firmicutes | Clostridia | Clostridiales | Lachnospiraceae | Cuneatibacter | Cuneatibacter caecimuris | -0.64 |
| OTU_2403 | SET 3 | 824 | Proteobacteria | Epsilonproteobacteria | Campylobacterales | Campylobacteraceae | Campylobacter | Campylobacter gracilis | -1.00 |
| OTU_1914 | SET 3 | 204516 | Bacteroidetes | Bacteroidia | Bacteroidales | Bacteroidaceae | Bacteroides | Bacteroides massiliensis | -0.55 |
| OTU_2553 | SET 3 | 1841896 | Bacteroidetes | Bacteroidia | Bacteroidales | Bacteroidaceae | Bacteroides | Bacteroides mediterraneensis | -1.00 |
| OTU_2977 | SET 3 | 40519 | Firmicutes | Clostridia | Clostridiales | Ruminococcaceae | Ruminococcus | Ruminococcus callidus | -1.00 |
| OTU_2988 | SET 3 | 301302 | Firmicutes | Clostridia | Clostridiales | Lachnospiraceae | Roseburia | Roseburia faecis | -1.00 |
| OTU_3316 | SET 3 | 33025 | Firmicutes | Negativicutes | Acidaminococcales | Acidaminococcaceae | Phascolarctobacterium | Phascolarctobacterium faecium | -1.00 |
| OTU_3019 | SET 3 | 487175 | Proteobacteria | Betaproteobacteria | Burkholderiales | Sutterellaceae | Parasutterella | Parasutterella excrementihominis | -0.75 |
| OTU_2198 | SET 3 | 39496 | Firmicutes | Clostridia | Clostridiales | Eubacteriaceae | Eubacterium | Eubacterium ventriosum | -1.00 |
| OTU_46 | SET 3 | 199 | Proteobacteria | Epsilonproteobacteria | Campylobacterales | Campylobacteraceae | Campylobacter | Campylobacter concisus | -0.55 |
| OTU_2942 | SET 3 | 871665 | Firmicutes | Clostridia | Clostridiales | Lachnospiraceae | Blautia | Blautia faecis | -0.75 |
| OTU_1361 | SET 3 | 626937 | Firmicutes | Clostridia | Clostridiales | Christensenellaceae | Christensenella | Christensenella minuta | -0.64 |
| OTU_2636 | SET 3 | 1265 | Firmicutes | Clostridia | Clostridiales | Ruminococcaceae | Ruminococcus | Ruminococcus flavefaciens | -1.00 |
| OTU_2285 | SET 3 | 1232428 | Firmicutes | Negativicutes | Veillonellales | Veillonellaceae | Megasphaera | Megasphaera massiliensis | -1.00 |
| OTU_3094 | SET 3 | 84026 | Firmicutes | Clostridia | Clostridiales | Ruminococcaceae | Ruminiclostridium | [Clostridium] methylpentosum | -0.75 |
| OTU_1358 | SET 3 | 40519 | Firmicutes | Clostridia | Clostridiales | Ruminococcaceae | Ruminococcus | Ruminococcus callidus | -0.64 |
| OTU_2259 | SET 3 | 46867 | Firmicutes | Clostridia | Clostridiales | Clostridiaceae | Clostridium | Clostridium chauvoei | -0.64 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_3181 | SET 3 | 218538 | Firmicutes | Negativicutes | Veillonellales | Veillonellaceae | Dialister | Dialister invisus | −0.64 |
| OTU_2642 | SET 3 | 253257 | Firmicutes | Clostridia | Clostridiales | Lachnospiraceae | Lachnoclostridium | [Clostridium] amygdalinum | −1.00 |
| OTU_2552 | SET 3 | 1236515 | Bacteroidetes | Bacteroidia | Bacteroidales | Bacteroidaceae | Bacteroides | Bacteroides sartorii JCM 17136 = DSM 21941 | −1.00 |
| OTU_2556 | SET 3 | 1531 | Firmicutes | Clostridia | Clostridiales | Lachnospiraceae | Lachnoclostridium | [Clostridium] clostridioforme | −1.00 |
| OTU_2616 | SET 3 | 116085 | Firmicutes | Clostridia | Clostridiales | Lachnospiraceae | Coprococcus | Coprococcus catus | −1.00 |
| OTU_2943 | SET 3 | 292800 | Firmicutes | Clostridia | Clostridiales | unclassified. NA | Flavonifractor | Flavonifractor plautii | −1.00 |
| OTU_2989 | SET 3 | 1121115 | Firmicutes | Clostridia | Clostridiales | Lachnospiraceae | Blautia | Blautia wexlerae DSM 19850 | −1.00 |
| OTU_2624 | SET 3 | 357276 | Bacteroidetes | Bacteroidia | Bacteroidales | Bacteroidaceae | Bacteroides | Bacteroides dorei | −0.64 |
| OTU_2243 | SET 3 | 1096246 | Firmicutes | Clostridia | Clostridiales | Clostridiaceae | Hungatella | Hungatella effluvii | −0.64 |
| OTU_2214 | SET 3 | 1232428 | Firmicutes | Negativicutes | Veillonellales | Veillonellaceae | Megasphaera | Megasphaera massiliensis | −0.55 |
| OTU_2199 | SET 3 | 454154 | Bacteroidetes | Bacteroidia | Bacteroidales | Prevotellaceae | Paraprevotella | Paraprevotella clara | −0.64 |
| OTU_1990 | SET 3 | 537011 | Bacteroidetes | Bacteroidia | Bacteroidales | Prevotellaceae | Prevotella | Prevotella copri DSM 18205 | −1.00 |
| OTU_3002 | SET 3 | 45851 | Firmicutes | Clostridia | Clostridiales | Lachnospiraceae | Butyrivibrio | Butyrivibrio crossotus | −1.00 |
| OTU_1596 | SET 3 | 172901 | Lentisphaerae | Lentisphaeria | Victivallales | Victivallaceae | Victivallis | Victivallis vadensis | −1.00 |
| OTU_1151 | SET 3 | 76517 | Proteobacteria | Epsilonproteobacteria | Campylobacterales | Campylobacteraceae | Campylobacter | Campylobacter hominis | −1.00 |
| OTU_1322 | SET 3 | 168384 | Firmicutes | Clostridia | Clostridiales | Lachnospiraceae | Marvinbryantia | Marvinbryantia formatexigens | −1.00 |
| OTU_2692 | SET 3 | 166486 | Firmicutes | Clostridia | Clostridiales | Lachnospiraceae | Roseburia | Roseburia intestinalis | −1.00 |
| OTU_3054 | SET 3 | 1471761 | Firmicutes | Bacilli | Bacillales | Thermoactinomycetaceae | Novibacillus | Novibacillus thermophilus | −1.00 |
| OTU_3131 | SET 3 | 204516 | Bacteroidetes | Bacteroidia | Bacteroidales | Bacteroidaceae | Bacteroides | Bacteroides massiliensis | −1.00 |
| OTU_2905 | SET 3 | 204516 | Bacteroidetes | Bacteroidia | Bacteroidales | Bacteroidaceae | Bacteroides | Bacteroides massiliensis | −1.00 |
| OTU_1783 | SET 3 | 84026 | Firmicutes | Clostridia | Clostridiales | Ruminococcaceae | Ruminiclostridium | [Clostridium] methylpentosum | −1.00 |
| OTU_1498 | SET 3 | 824 | Proteobacteria | Epsilonproteobacteria | Campylobacterales | Campylobacteraceae | Campylobacter | Campylobacter gracilis | −1.00 |
| OTU_2450 | SET 3 | 154046 | Firmicutes | Clostridia | Clostridiales | Clostridiaceae | Hungatella | Hungatella hathewayi | −1.00 |
| OTU_3004 | SET 3 | 69825 | Firmicutes | Clostridia | Clostridiales | Lachnospiraceae | Lachnoclostridium | [Clostridium] indolis | −0.64 |
| OTU_954 | SET 3 | 28135 | Bacteroidetes | Bacteroidia | Bacteroidales | Prevotellaceae | Prevotella | Prevotella oris | −0.75 |
| OTU_1368 | SET 3 | 1776382 | Firmicutes | Clostridia | Clostridiales | Ruminococcaceae | Neglecta | Neglecta timonensis | −0.64 |
| OTU_1460 | SET 3 | 381308 | Proteobacteria | Gammaproteobacteria | Chromatiales | Thioalkalispiraceae | Thiohalophilus | Thiohalophilus thiocyanatoxydans | −1.00 |
| OTU_1488 | SET 3 | 28446 | Firmicutes | Clostridia | Clostridiales | Lachnospiraceae | Tyzzerella | [Clostridium] propionicum | −1.00 |
| OTU_1601 | SET 3 | 181487 | Actinobacteria | Actinobacteria | Actinomycetales | Actinomycetaceae | Actinomyces | Actinomyces cardiffensis | −1.00 |
| OTU_69 | SET 3 | 505 | Proteobacteria | Betaproteobacteria | Neisseriales | Neisseriaceae | Kingella | Kingella oralis | −1.00 |
| OTU_2301 | SET 3 | 515620 | Firmicutes | Clostridia | Clostridiales | Eubacteriaceae | Eubacterium | [Eubacterium] eligens ATCC 27750 | −0.64 |
| OTU_1510 | SET 3 | 113107 | Firmicutes | Bacilli | Lactobacillales | Streptococcaceae | Streptococcus | Streptococcus australis | −0.75 |
| OTU_2258 | SET 3 | 871665 | Firmicutes | Clostridia | Clostridiales | Lachnospiraceae | Blautia | Blautia faecis | −0.64 |
| OTU_2473 | SET 3 | 213810 | Firmicutes | Clostridia | Clostridiales | Ruminococcaceae | Ruminococcus | Ruminococcus champanellensis 18P13 = JCM 17042 | −1.00 |
| OTU_1671 | SET 3 | 40545 | Proteobacteria | Betaproteobacteria | Burkholderiales | Sutterellaceae | Sutterella | Sutterella wadsworthensis | −1.00 |
| OTU_2545 | SET 3 | 1002367 | Bacteroidetes | Bacteroidia | Bacteroidales | Prevotellaceae | Prevotella | Prevotella stercorea DSM 18206 | −1.00 |
| OTU_2620 | SET 3 | 1796636 | Firmicutes | Clostridia | Clostridiales | Lachnospiraceae | Frisingicoccus | Frisingicoccus caecimuris | −1.00 |
| OTU_2956 | SET 3 | 470145 | Bacteroidetes | Bacteroidia | Bacteroidales | Bacteroidaceae | Bacteroides | Bacteroides coprocola DSM 17136 | −1.00 |
| OTU_1598 | SET 3 | 1264 | Firmicutes | Clostridia | Clostridiales | Ruminococcaceae | Ruminococcus | Ruminococcus albus | −1.00 |
| OTU_2537 | SET 3 | 745368 | Firmicutes | Clostridia | Clostridiales | Ruminococcaceae | Gemmiger | Gemmiger formicilis | −1.00 |
| OTU_684 | SET 3 | 644 | Proteobacteria | Gammaproteobacteria | Aeromonadales | Aeromonadaceae | Aeromonas | Aeromonas hydrophila | −1.00 |
| OTU_951 | SET 3 | 47847 | Actinobacteria | Actinobacteria | Micrococcales | Dermabacteraceae | Brachybacterium | Brachybacterium nesterenkovii | −1.00 |
| OTU_286 | SET 3 | 888828 | Proteobacteria | Gammaproteobacteria | Pasteurellales | Pasteurellaceae | Haemophilus | Haemophilus parainfluenzae ATCC 33392 | −0.64 |
| OTU_1238 | SET 3 | 553973 | Firmicutes | Clostridia | Clostridiales | Lachnospiraceae | Lachnoclostridium | [Clostridium] hylemonae DSM 15053 | −0.75 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1135 | SET 3 | 638849 | Synergistetes | Synergistia | Synergistales | Synergistaceae | Pyramidobacter | Pyramidobacter piscolens | −1.00 |
| OTU_1789 | SET 3 | 454154 | Bacteroidetes | Bacteroidia | Bacteroidales | Prevotellaceae | Paraprevotella | Paraprevotella clara | −1.00 |
| OTU_526 | SET 3 | 470565 | Bacteroidetes | Bacteroidia | Bacteroidales | Prevotellaceae | Prevotella | Prevotella histicola | −0.80 |
| OTU_1166 | SET 3 | 28137 | Bacteroidetes | Bacteroidia | Bacteroidales | Prevotellaceae | Prevotella | Prevotella veroralis | −0.64 |
| OTU_1281 | SET 3 | 1417852 | Firmicutes | Clostridia | Clostridiales | unclassified. NA | Flintibacter | Flintibacter butyricus | −0.64 |
| OTU_883 | SET 3 | 1348613 | Firmicutes | Clostridia | Clostridiales | Defluviitaleaceae | Vallitalea | Vallitalea pronyensis | −1.00 |
| OTU_1445 | SET 3 | 29364 | Firmicutes | Clostridia | Clostridiales | Lachnospiraceae | Lachnoclostridium | [Clostridium] polysaccharolyticum | −1.00 |
| OTU_1582 | SET 3 | 169435 | Firmicutes | Clostridia | Clostridiales | Ruminococcaceae | Anaerotruncus | Anaerotruncus colihominis | −1.00 |
| OTU_1958 | SET 3 | 58134 | Firmicutes | Clostridia | Clostridiales | Lachnospiraceae | Lachnoclostridium | [Desulfotomaculum] guttoideum | −1.00 |
| OTU_352 | SET 3 | 52693 | Firmicutes | Clostridia | Clostridiales | Eubacteriaceae | Acetobacterium | Acetobacterium paludosum | −1.00 |
| OUT_941 | SET 3 | 425941 | Bacteroidetes | Bacteroidia | Bacteroidales | Prevotellaceae | Prevotella | Prevotella nanceiensis | −1.00 |
| OTU_1495 | SET 3 | 43675 | Actinobacteria | Actinobacteria | Micrococcales | Micrococcaceae | Rothia | Rothia mucilaginosa | −1.00 |
| OTU_2172 | SET 3 | 187326 | Firmicutes | Negativicutes | Veillonellales | Veillonellaceae | Megasphaera | Megasphaera micronuciformis | −1.00 |
| OTU_511 | SET 3 | 228603 | Bactero | Bacteroidia | Bacteroidales | Prevotellaceae | Prevotella | Prevotella shahii | −1.00 |
| OTU_601 | SET 3 | 1236516 | Bacteroidetes | Bacteroidia | Bacteroidales | Prevotellaceae | Prevotella | Prevotella saccharolytica JCM 17484 | −1.00 |
| OTU_1074 | SET 3 | 264463 | Firmicutes | Clostridia | Clostridiales | Lachnospiraceae | Anaerosporobacter | Anaerosporobacter mobilis | −1.00 |
| OTU_48 | SET 1 | 717959 | Bacteroidetes | Bacteroidia | Bacteroidales | Rikenellaceae | Alistipes | Alistipes shahii WAL 8301 | 1.00 |
| OUT_242 | SET 1 | 587 | Proteobacteria | Gammaproteobacteria | Enterobacterales | Morganellaceae | Providencia | Providencia rettgeri | 1.00 |
| OTU_194 | SET 1 | 758827 | unclassified. NA | unclassified. NA | unclassified. NA | unclassified. NA | Vampirovibrio | Vampirovibrio chlorellavorus | 1.00 |
| OTU_262 | SET 1 | 649756 | Firmicutes | Clostridia | Clostridiales | Lachnospiraceae | Anaerostipes | Anaerostipes hadrus | 1.00 |
| OTU_1226 | SET 1 | 44749 | Firmicutes | Clostridia | Clostridiales | Ruminococcaceae | Sporobacter | Sporobacter termitidis | 1.00 |
| OTU_213 | SET 1 | 671218 | Bacteroidetes | Bacteroidia | Bacteroidales | Prevotellaceae | Alloprevotella | Alloprevotella rava | 1.00 |
| OTU_350 | SET 1 | 1264 | Firmicutes | Clostridia | Clostridiales | Ruminococcaceae | Ruminococcus | Ruminococcus albus | 1.00 |
| OTU_249 | SET 1 | 1122135 | Proteobacteria | Alphaproteobacteria | Kiloniellales | Kiloniellaceae | Kiloniella | Kiloniella laminariae DSM 19542 | 1.00 |
| OTU_477 | SET 1 | 853 | Firmicutes | Clostridia | Clostridiales | Ruminococcaceae | Faecalibacterium | Faecalibacterium prausnitzii | 1.00 |
| OTU_356 | SET 1 | 484018 | Bacteroidetes | Bacteroidia | Bacteroidales | Bacteroidaceae | Bacteroides | Bacteroides plebeius DSM 17135 | 1.00 |
| OTU_426 | SET 1 | 46503 | Bacteroidetes | Bacteroidia | Bacteroidales | Porphyromonadaceae | Parabacteroides | Parabacteroides merdae | 1.00 |
| OTU_143 | SET 1 | 54565 | Proteobacteria | Deltaproteobacteria | Desulfovibrionales | Desulfovibrionaceae | Desulfovibrio | Desulfovibrio simplex | 1.00 |
| OTU_386 | SET 1 | 290052 | Firmicutes | Clostridia | Clostridiales | Ruminococcaceae | Acetivibrio | Acetivibrio ethanolgignens | 1.00 |
| OUT_387 | SET 1 | 216931 | Tenericutes | Mollicutes | Entomoplasmatales | Spiroplasmataceae | Spiroplasma | Spiroplasma alleghenense | 1.00 |
| OTU_1618 | SET 1 | 575978 | Proteobacteria | Deltaproteobacteria | Desulfovibrionales | Desulfovibrionaceae | Desulfovibrio | Desulfovibrio idahonensis | 1.00 |
| OTU_80 | SET 1 | 433321 | Firmicutes | Negativicutes | Selenomonadales | Selenomonadaceae | Propionispira | Propionispira arcuata | 1.00 |
| OTU_359 | SET 1 | 1796646 | Bacteroidetes | Bacteroidia | Bacteroidales | Porphyromonadaceae | Muribaculum | Muribaculum intestinale | 1.00 |
| OTU_128 | SET 1 | 1122135 | Proteobacteria | Alphaproteobacteria | Kiloniellales | Kiloniellaceae | Kiloniella | Kiloniella laminariae DSM 19542 | 1.00 |
| OTU_536 | SET 1 | 213810 | Firmicutes | Clostridia | Clostridiales | Ruminococcaceae | Ruminococcus | Ruminococcus champanellensis 18P13 = JCM 17042 | 1.00 |
| OTU_392 | SET 1 | 1122135 | Proteobacteria | Alphaproteobacteria | Kiloniellales | Kiloniellaceae | Kiloniella | Kiloniella laminariae DSM 19542 | 1.00 |
| OUT_499 | SET 1 | 228924 | Firmicutes | Clostridia | Clostridiales | Clostridiales Family XII. Incertae Sedis | Guggenheimella | Guggenheimella bovis | 1.00 |
| OTU_264 | SET 1 | 717959 | Bacteroidetes | Bacteroidia | Bacteroidales | Rikenellaceae | Alistipes | Alistipes shahii WAL, 8301 | 1.00 |
| OTU_110 | SET 1 | 1796646 | Bacteroidetes | Bacteroidia | Bacteroidales | Porphyromonadaceae | Muribaculum | Muribaculum intestinale | 1.00 |
| OTU_215 | SET 1 | 290054 | Firmicutes | Clostridia | Clostridiales | Eubacteriaceae | Eubacterium | Eubacterium coprostanoligenes | 1.00 |
| OTU_484 | SET 1 | 1509 | Firmicutes | Clostridia | Clostridiales | Clostridiaceae | Clostridium | Clostridium sporogenes | 1.00 |
| OTU_86 | SET 1 | 1462919 | Firmicutes | Clostridia | Clostridiales | Lachnospiraceae | Mobilitalea | Mobilitalea sibirica | 1.00 |
| OTU_275 | SET 1 | 29375 | Firmicutes | Clostridia | Clostridiales | Lachnospiraceae | Lachnoclostridium | [Clostridium] xylanolyticum | 1.00 |
| OTU_178 | SET 1 | 337097 | Firmicutes | Bacilli | Bacillales | Bacillaceae | Vulcanibacillus | Vulcanibacillus modesticaldus | 1.00 |
| OTU_2653 | SET 1 | 129859 | Firmicutes | Clostridia | Clostridiales | Ruminococcaceae | Ruminococcus | Ruminococcus faecis JCM 15917 | 1.00 |
| OTU_337 | SET 1 | 487174 | Bacteroidetes | Bacteroidia | Bacteroidales | Porphyromonadaceae | Barnesiella | Barnesiella intestinihominis | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_530 | SET 1 | 642492 | Firmicutes | Clostridia | Clostridiales | Lachnospiraceae | Cellulosilyticum | *Clostridium lentocellum* DSM 5427 | 1.00 |
| OTU_123 | SET 1 | 1735 | Firmicutes | Erysipelotrichia | Erysipelotrichales | Erysipelotrichaceae | Holdemanella | *Holdemanella biformis* | 1.00 |
| OTU_1846 | SET 1 | 1297424 | Firmicutes | Clostridia | Clostridiales | Ruminococcaceae | Anaerobacterium | *Anaerobacterium chartisolvens* | 1.00 |
| OTU_134 | SET 1 | 742766 | Bacteroidetes | Bacteroidia | Bacteroidales | Porphyromonodaceae | Dysgonomonas | *Dysgonomonas gadei* ATCC BAA-286 | 1.00 |
| OTU_654 | SET 1 | 1462919 | Firmicutes | Clostridia | Clostridiales | Lachnospiraceae | Mobilitalea | *Mobilitalea sibirica* | 1.00 |
| OTU_621 | SET 1 | 46680 | Proteobacteria | Gammaproteobacteria | Pseudomonadales | Pseudomonadaceae | Methylobacillus | *Pseudomonas nitroreducens* | 1.00 |
| OTU_233 | SET 1 | 132925 | Firmicutes | Clostridia | Clostridiales | Clostridiaceae | Clostridium | *Clostridium bowmanii* | 1.00 |
| OTU_271 | SET 1 | 758823 | unclassified_NA | unclassified_NA | unclassified_NA | unclassified_NA | unclassified_NA | *Vampirovibrio chlorellavorus* | 1.00 |
| OTU_561 | SET 1 | 411467 | Firmicutes | Clostridia | Clostridiales | unclassified_NA | Pseudoflavonifractor | *Pseudoflavonifractor capillosus* ATCC 29799 | 1.00 |
| OTU_687 | SET 1 | 1122135 | Proteobacteria | Alphaproteobacteria | Kiloniellales | Kiloniellaceae | Kiloniella | *Kiloniella laminariae* DSM 19542 | 1.00 |
| OTU_707 | SET 1 | 1318465 | Tenericutes | Mollicutes | Acholeplasmatales | Acholeplasmataceae | Acholeplasma | *Acholeplasma brassicae* 0502 | 1.00 |
| OTU_1950 | SET 1 | 1852367 | Firmicutes | Clostridia | Clostridiales | Clostridiales Family XIII. Incenae Sedis | Ihubacter | *Ihubacter massiliensis* | 1.00 |
| OTU_1113 | SET 1 | 1841857 | Bacteroidetes | Bacteroidia | Bacteroidales | Odoribacteraceae | (Alituromica | *Culturomica massiliensis* | 1.00 |
| OTU_344 | SET 1 | 169679 | Firmicutes | Clostridia | Clostridiales | Clostridiaceae | Clostridium | *Clostridium saccharobutylicum* | 1.00 |
| OTU_529 | SET 1 | 1175296 | Euryarchaeota | Thermoplasmata | Methanomassiliicoccales | Methanomassiliicoccaceae | Methanomassiliicoccus | *Methanomassiliicoccus luminyensis* B10 | 1.00 |
| OTU_58 | SET 1 | 1122135 | Proteobacteria | Alphaproteobacteria | Kiloniellales | Kiloniellaceae | Kiloniella | *Kiloniella laminariae* DSM 19542 | 1.00 |
| OTU_2607 | SET 1 | 259063 | Firmicutes | Clostridia | Clostridiales | Lachnospiraceae | Anaerocolumna | *Anaerocolumna jejuensis* | 1.00 |
| OTU_541 | SET 1 | 172901 | Firmicutes | Lentisphaeria | Victivallales | Victivallaceae | Victivallis | *Victivallis vadensis* | 1.00 |
| OTU_473 | SET 1 | 39488 | Firmicutes | Clostridia | Clostridiales | Eubacteriaceae | Eubacterium | *[Eubacterium] hallii* | 1.00 |
| OTU_473 | SET 1 | 57172 | Firmicutes | Clostridia | Clostridiales | Peptococcaceae | Desulfotomaculum | *Desulfotomaculum halophilum* | 1.00 |
| OTU_2146 | SET 1 | 28118 | Bacteroidetes | Bacteroidia | Bacteroidales | Odoribacteraceae | Odoribacter | *Odoribacter splanchnicus* | 1.00 |
| OTU_791 | SET 1 | 166486 | Firmicutes | Clostridia | Clostridiales | Lachnospiraceae | Roseburia | *Roseburia intestinalis* | 1.00 |
| OTU_90 | SET 1 | 28133 | Bacteroidetes | Bacteroidia | Bacteroidales | Prevotellaceae | Prevotella | *Prevotella nigrescens* | 1.00 |
| OTU_593 | SET 1 | 758823 | unclassified_NA | unclassified_NA | unclassified_NA | unclassified_NA | Vampirovibrio | *Vampirovibrio chlorellavorus* | 1.00 |
| OTU_504 | SET 1 | 1529 | Firmicutes | Clostridia | Clostridiales | Clostridiaceae | Clostridium | *Clostridium cadaveris* | 1.00 |
| OTU_322 | SET 1 | 44749 | Firmicutes | Clostridia | Clostridiales | Ruminococcaceae | Sporobacter | *Sporobacter termitidis* | 1.00 |
| OTU_524 | SET 1 | 694434 | Firmicutes | Clostridia | Clostridiales | Gracilibacteraceae | Gracilibacter | *Gracilibacter thermotolerans* JW/YJL-SI | 1.00 |
| OTU_805 | SET 1 | 1007096 | Firmicutes | Clostridia | Clostridiales | Oscillospiraceae | Oscillibacter | *Oscillibacter ruminantium* GH1 | 1.00 |
| OTU_798 | SET 1 | 84030 | Firmicutes | Clostridia | Clostridiales | Lachnospiraceae | Lachnoclostidium | *[Clostridium] saccharolyticum* | 1.00 |
| OTU_300 | SET 1 | 56774 | Firmicutes | Clostridia | Clostridiales | Clostridiales Family XIII. Incertae Sedis | unclassified_NA | *[Epbacterium] infirmum* | 1.00 |
| OTU_617 | SET 1 | 102148 | Firmicutes | Erysipelotrichia | Erysipelotrichales | Erysipelotrichaceae | Solobacterium | *Solobacterium moorei* | 1.00 |
| OTU_156 | SET 1 | 626947 | Proteobacteria | Betaproteobacter | Burkholderiales | Sutterellaceae | Parasutterella | *Parasutterella secunda* | 1.00 |
| OTU_1449 | SET 1 | 1297424 | Firmicutes | Clostridia | Clostridiales | Ruminococcaceae | Anaerobacterium | *Anaerobacterium chartisolvens* | 1.00 |
| OTU_109 | SET 1 | 290054 | Firmicutes | Clostridia | Clostridiales | Eubacteriaceae | Eubacterium | *Eubacterium coprostanaligenes* | 1.00 |
| OTU_1622 | SET 1 | 216933 | Tenericutes | Mollicutes | Entomoplasmatale | Spiroplasmataceae | Spiroplasma | *Spiroplasma chrysopicola* | 1.00 |
| OTU_205 | SET 1 | 626947 | Proteobacteria | Betaproteobacter | Burkholderiales | Sutterellaceae | Parasutterella | *Parasutterella secunda* | 1.00 |
| OTU_306 | SET 1 | 758823 | unclassified_NA | unclassified_NA | unclassified_NA | unclassified 14A | Vampirovibrio | *Vampirovibrio chlorellavorus* | 1.00 |
| OTU_206 | SET 1 | 1348613 | Firmicutes | Clostridia | Clostridiales | Defluviitaleaceae | Vallitalea | *Vallitalea pronyensis* | 1.00 |
| OTU_2657 | SET 1 | 44749 | Firmicutes | Clostridia | Clostridiales | Ruminococcaceae | Sporobacter | *Sporobacter termictidis* | 1.00 |
| OTU_2102 | SET 1 | 1472417 | Bacteroidetes | Bacteroidia | Bacteroidales | Odoribacteraceae | Butyricimonas | *Butyricimonas parvirosa* | 1.00 |
| OTU_329 | SET 1 | 100176 | Firmicutes | Clostridia | Clostridiales | Ruminococcaceae | Papillibacter | *Papillibacter cinnamivorans* | 1.00 |
| OTU_1499 | SET 1 | 824 | Proteobacteria | Epsilonproteobacteria | Campylobacterales | Campylobactiomlcetaceae | Campylobacter | *Campylobacter gracilis* | 1.00 |
| OTU_756 | SET 1 | 1471761 | Firmicutes | Bacilli | Bacillales | Thermoactinomicetaceae | Novibacillus | *Novibacillus thermophilus* | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_634 | SET 1 | 1297617 | Firmicutes | Clostridia | Clstridiales | unclassified. NA | Intestinimonas | Intestinimonas butyriciproducens | 1.00 |
| OTU_374 | SET 1 | 288966 | Firmicutes | Clostridia | Clostridiales | Clostridiaceae | Lutispora | Lutispora thermophila | 1.00 |
| OTU_527 | SET 1 | 1317125 | Bacteroidetes | Cytophagia | Cytophagiales | Hymenobacteraceae | Pontibacter | Pontibacter indicus | 1.00 |
| OTU_772 | SET 1 | 28197 | Proteobacteria | Epsilonproteobacteria | Campylobacterale | Campbacteraceae | Arcobacter | Arcobacter bretzleri | 1.00 |
| OTU_2652 | SET 1 | 358743 | Firmicutes | Clostridia | Clostridiles | Lachospiraceae | Lachnoclostridium | [Clostridium] citroniae | 1.00 |
| OTU_1352 | SET 1 | 642492 | Firmicutes | Clostridia | Clostridiales | Lachnospiraceae | Cellulosilyticum | [Clostridium] lentocellum DSM 542 | 1.00 |
| OTU_678 | SET 1 | 264639 | Tenericutes | Mollicutes | Acholeplasmatales | Acholeplasmataceae | Acholeplasma | Acholeplasma parvum | 1.00 |
| OTU_468 | SET 1 | 1265 | Firmicutes | Clostridia | Clostridiales | Ruminococcaceae | Ruminococcus | Ruminococcus flavefaciens | 1.00 |
| OTU_775 | SET 1 | 1122135 | Proteobacteria | Alphaproteobacteria | Kilonellales | Kilontellaceae | Kilontella | Kilontella laminariae 19542 | 1.00 |
| OTU_1526 | SET 1 | 1335 | Firmicutes | Bacilli | Lactobacillales | Streptococcaceae | Streptococcus | Streptococcus equinus | 1.00 |
| OTU_2951 | SET 1 | 66219 | Firmicutes | Clostridia | Clostridiales | Lachnospiraceae | Lachnoclostridium | Lachnoclostridium phytofermentans | 1.00 |
| OTU_953 | SET 1 | 69473 | Tenericutes | Mollicutes | Acholeplasmatales | Acholeplasmiataceae | Acholeplasma | Acholeplasma vituli | 1.00 |
| OTU_431 | SET 1 | 115117 | Proteobacteria | Deltaprobacteria | Desulfovibrionales | Desulfovibnonaceae | Desulfovibrio | Desulfovibrio desulfuricans subsp. desulfuricans | 1.00 |
| OTU_1952 | SET 1 | 341220 | Firmicutes | Clostridia | Clostridiales | Clostridiaceae | Lactonifactor | Lactonifactor longoviformis | 1.00 |
| OTU_599 | SET 1 | 758823 | unclassified. NA | unclassified.NA | unclassified. NA | unclassified. NA | Vampirovibrio | Vampirovibrio chlorellavarus | 1.00 |
| OTU_362 | SET 1 | 1732 | Firmicutes | Clostridia | Clostridiales | Eubacteriaceae | Eubacterium | Eubacterium oxidoreducens | 1.00 |
| OTU_340 | SET 1 | 873513 | Bacteroidetes | Bacteroidia | Bacteroidales | Prevotellaceae | Prevotella | Prevotella buccae AITC 33574 | 1.00 |
| OTU_1032 | SET 1 | 1796646 | Bacteroidetes | Bacteroidia | Bacteroidales | Porphyromonadaceae | Muribaculum | Muribaculum intestinale | 1.00 |
| OTU_2116 | SET 1 | 411467 | Firmicutes | Clostridia | Clostridiales | unclassified. NA | Pseudoflavonifractor | Pseucdflavonifractor capillosus ATCC 29799 | 1.00 |
| OTU_1480 | SET 1 | 742766 | Bacteroidetes | Bacteroidia | Bacteroidales | Porphyromonadaceae | Dysgonomonas | Dysgonomonas gadei ATCC BAA-286 | 1.00 |
| OTU_103 | SET 1 | 487174 | Bacteroidetes | Bacteroidia | Bacteroidales | Porphyromonadaceae | Barnesiella | Barnesiella intestinihominis | 0.55 |
| OTU_2458 | SET 1 | 396504 | Firmicutes | Clostridia | Clostridiales | Ruminococcaceae | Ruminclostridium | [Clostridium] sufflavan | 1.00 |
| OTU_1020 | SET 1 | 1796619 | Firmicutes | Clostridia | Clostridiales | Eubacteriaceae | Irregularibacter | Irregularibacter murts | 1.00 |
| OTU_967 | SET 1 | 1841857 | Bacteroidetes | Bacteroidia | Bacteroidales | Odoribacteraceae | Cultoromica | Cultoromica massiliensis | 1.00 |
| OTU_2801 | SET 1 | 45851 | Firmicutes | Clostridia | Clostridiales | Lachnospiraceae | Butyrivibrio | Butyrivibrio crossotus | 1.00 |
| OTU_1965 | SET 1 | 1509 | Firmicutes | Clostridia | Clostridiales | Clostridiaceae | Clostridium | Clostridium sporogenes | 1.00 |
| OTU_942 | SET 1 | 259063 | Firmicutes | Clostridia | Clostridiales | Lachnospiraceae | Anaerocolumna | Anaerocolumna jejuensis | 1.00 |
| OTU_2995 | SET 1 | 2741 | Firmicutes | Clostridia | Clostridiales | Peptococcaceae | Peptococcus | Peptococcus niger | 1.00 |
| OTU_865 | SET 1 | 105841 | Firmicutes | Clostridia | Clostridiales | Lachnospiraceae | Anaerostipes | Anaerostipes caccae | 1.00 |
| OTU_1158 | SET 1 | 86332 | Firmicutes | Clostridia | Clostridiales | Clostridiales Family XIII. Incertae Sedis | Mogibacterium | Mogibacterium pumilum | 1.00 |
| OTU_1693 | SET 1 | 1349822 | Bacteroidetes | Bacteroidia | Bacteroidales | Porphyromonadaceae | Coprobacter | Coprobacter fastidiosus NSB1 | 1.00 |
| OTU_236 | SET 1 | 84087 | Firmicutes | Clostridia | Clostridiales | Lachnospiraceae | Syntrophococcus | Syntrophococcus sucromutans | 1.00 |
| OTU_2554 | SET 1 | 180311 | Firmicutes | Clostridia | Clostridiales | Lachnospiraceae | Hespellia | Hespellia stercorisuis | 1.00 |
| OTU_558 | SET 1 | 44749 | Firmicutes | Clostridia | Clostridiales | Ruminococcaceae | Sporobacter | Sporobacter termitidis | 0.59 |
| OTU_223 | SET 1 | 54291 | Proteobacteria | Gammaproteobacteria | Enterobacterales | Enterobacteriaceae | Raoultella | Raoultella ornithinolytica | 1.00 |
| OTU_925 | SET 1 | 1509 | Firmicutes | Clostridia | Clostridiales | Clostridiaceae | Clostridium | Clostridium sporogenes | 1.00 |
| OTU_608 | SET 1 | 29375 | Firmicutes | Clostridia | Clostridiales | Lachnospiraceae | Lachnoclostridium | [Clostridium] xylanolyticum | 1.00 |
| OTU_836 | SET 1 | 1217282 | Bacteroidetes | Bacteroidia | Bacteroidales | Porphyromonadaceae | Parabacteroides | Parabacteroides faecis | 1.00 |
| OTU_862 | SET 1 | 172901 | Lentisphaerae | Lentisphaeria | Victivallales | Victivallaceae | Victivallis | Victivallis vadensis | 1.00 |
| OTU_227 | SET 1 | 694434 | Firmicutes | Clostridia | Clostridiales | Gracilibacteraceae | Gracilibacter | Gracilibacter thermotelerans JW/YJL-S1 | 1.00 |
| OTU_185 | SET 1 | 762984 | Bacteroidetes | Bacteroidia | Bacteroidales | Bacteroidaceae | Bacteroides | Bacteroides clarus YIT 12056 | 1.00 |
| OTU_406 | SET 1 | 1188412 | Firmicutes | Clostridia | Clostridiales | Defluviitaleaceae | Vallitalea | Vallitalea guaymasensis | 1.00 |
| OTU_479 | SET 1 | 154046 | Firmicutes | Clostridia | Clostridiales | Clostridiaceae | Hungatella | Hungatella hathewayi | 1.00 |
| OTU_127 | SET 1 | 1122135 | Proteobacteria | Alphaproteobacteria | Kilonellales | Kiloniellaceae | Kiloniella | Kiloniella laminariae DSM 19542 | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1344 | SET 1 | 663278 | Firmicutes | Clostridia | Clostridiales | Ruminococcaceae | Ethanoligenens | Ethanoligenens harbinense YUAN-3 | 1.00 |
| OTU_136 | SET 1 | 1543 | Firmicutes | Clostridia | Clostridiales | Clostridiaceae | Clostridium | Clostridium oceanicum | 0.65 |
| OTU_1050 | SET 1 | 626947 | Proteobacteria | Betaproteobacteria | Burkholderiales | Sutterellaceae | Parasutterella | Parasutterella secunda | 1.00 |
| OTU_995 | SET 1 | 398512 | Firmicutes | Clostridia | Clostridiales | Ruminococcaceae | Pseudobacteroides | Pseudobacteroides cellulosolvens ATCC 35603 = DSM 2933 | 1.00 |
| OTU_2543 | SET 1 | 129742 | Firmicutes | Clostridia | Clostridiales | Ruminococcaceae | Anaerobacterium | Anaerobacterium chartisolvens | 1.00 |
| OTU_2983 | SET 1 | 1335 | Firmicutes | Bacilli | Lactobacillales | Streptococcaceae | Streptococcus | Streptococcus equinus | 1.00 |
| OTU_1869 | SET 1 | 587 | Proteobacteria | Gammaproteobacteria | Enterobacterales | Morganellaceae | Providencia | Providencia rettgeri | 1.00 |
| OTU_190 | SET 1 | 66219 | Firmicutes | Clostridia | Clostridiales | Lachnospiraceae | lachnoclostridium | Lachnoclostridium phytofermentans | 1.00 |
| OTU_1714 | SET 1 | 69825 | Firmicutes | Clostridia | Clostridiales | Lachnospiraceae | lachnoclostridium | [Clostridium] indolis | 1.00 |
| OTU_657 | SET 1 | 117529 | Euryarchaeota | Thermoplasmata | Methanomassiliicoccales | Methanomassiliicoccaceae | Methanomassiliicoccus | Methanomassiliicoccus luminyensis B10 | 1.00 |
| OTU_957 | SET 1 | 1841867 | Firmicutes | Clostridia | Clostridiales | Ruminococcaceae | Phocea | Phocea massiliensis | 1.00 |
| OTU_346 | SET 1 | 1535 | Firmicutes | Clostridia | Clostridiales | Ruminococcaceae | Ruminiclostridium | [Clostridium] leptum | 1.00 |
| OTU_1979 | SET 1 | 1265 | Firmicutes | Clostridia | Clostridiales | Ruminococcaceae | Ruminococcus | Ruminococcus flavefaciens | 1.00 |
| OTU_2606 | SET 1 | 1510 | Firmicutes | Clostridia | Clostridiales | Ruminococcaceae | Ruminiclostridium | [Clostridium] stercorarium | 1.00 |
| OTU_989 | SET 1 | 84026 | Firmicutes | Clostridia | Clostridiales | Ruminococcaceae | Ruminiclostridium | [Clostridium] methylpentosum | 1.00 |
| OTU_2820 | SET 1 | 1502 | Firmicutes | Clostridia | Clostridiales | Clostridiaceae | Clostridium | Clostridium perfringens | 1.00 |
| OTU_1434 | SET 1 | 1297424 | Firmicutes | Clostridia | Clostridiales | Ruminococcaceae | Anaerobacterium | Anaerobacterium chartisolvens | 1.00 |
| OTU_596 | SET 1 | 1619234 | Firmicutes | Clostridia | Clostridiales | Lachnospiraceae | Anaerobium | Anaerobium acetethylicum | 1.00 |
| OTU_1447 | SET 1 | 398512 | Firmicutes | Clostridia | Clostridiales | Ruminococcaceae | Pseudobacteroides | Pseudobacteroides cellulosolvens ATCC 35603 = DSM 2933 | 1.00 |
| OTU_2980 | SET 1 | 1335 | Firmicutes | Bacilli | Lactobacillales | Streptococcaceae | Streptococcus | Streptococcus equinus | 1.00 |
| OTU_1848 | SET 1 | 39497 | Firmicutes | Clostridia | Clostridiales | Eubacteriaceae | Eubacterium | Eubacterium xylanophilum | 1.00 |
| OTU_1802 | SET 1 | 1544 | Firmicutes | Clostridia | Clostridiales | Lachnospiraceae | Lachnoclostridium | [Clostridium] oroticum | 1.00 |
| OTU_2171 | SET 1 | 873513 | Bacteroidetes | Bacteroidia | Bacteroidales | Prevotellaceae | Prevotella | Prevotella buccae ATCC 33574 | 1.00 |
| OTU_1141 | SET 1 | 29343 | Firmicutes | Clostridia | Clostridiales | Ruminococcaceae | Ruminiclostridium | [Clostridium] cellulosi | 1.00 |
| OTU_83 | SET 1 | 45851 | Firmicutes | Clostridia | Clostridiales | Lachnospiraceae | Butyrivibrio | Butyrivibrio crossotus | 1.00 |
| OTU_627 | SET 1 | 694434 | Firmicutes | Clostridia | Clostridiales | Gracilibacteraceae | Gracilibacter | Gracilibacter thermotolerans JW/YJL-S1 | 1.00 |
| OTU_3010 | SET 1 | 56774 | Firmicutes | Clostridia | Clostridiales | Clostridiales Family XIII. Incertae Sedis | unclassified. NA | [Eubacterium] infirmum | 1.00 |
| OTU_1055 | SET 1 | 1732 | Firmicutes | Clostridia | Clostridiales | Eubacteriaceae | Eubacterium | Eubacterium oxidoreducens | 1.00 |
| OTU_2647 | SET 1 | 649762 | Firmicutes | Clostridia | Clostridiales | Lachnospiraceae | Blautia | Blautia luti DSM 14534 | 1.00 |
| OTU_1230 | SET 1 | 154046 | Firmicutes | Clostridia | Clostridiales | Clostridiaceae | Hungatella | Hungatella hathewayi | 1.00 |
| OTU_1549 | SET 1 | 290267 | Firmicutes | Clostridia | Clostridiales | Eubacteriaceae | Eubacterium | Eubacterium coprostanoligenes | 1.00 |
| OTU_1985 | SET 1 | 332095 | Tissierellia | Tissierellia | unclassified. NA | unclassified. NA | Dethiosulfatibacter | Dethiosulfatibacter aminovorans | 1.00 |
| OTU_1040 | SET 1 | 536633 | Firmicutes | Clostridia | Clostridiales | Lachnospiraceae | Blautia | Blautia glucerasea | 1.00 |
| OTU_404 | SET 1 | 1033731 | Bacteroidetes | Bacteroidia | Bacteroidales | Rikenellaceae | Alistipes | Alistipes timonensis JC136 | 1.00 |
| OTU_722 | SET 1 | 1297617 | Firmicutes | Clostridia | Clostridiales | unclassified. NA | Intestinimonas | Intestinimonas butyriciproducens | 1.00 |
| OTU_173 | SET 1 | 574930 | Bacteroidetes | Bacteroidia | Bacteroidales | Polphyromonadaceae | Parabacteroides | Parabacteroides gordonii | 0.55 |
| OTU_932 | SET 1 | 742818 | Actinobacteria | Coriobacteriia | Eggerthellales | Eggerthellaceae | Slackia | Slackia piriformis YIT 12062 | 1.00 |
| OTU_1296 | SET 1 | 1264 | Firmicutes | Clostridia | Clostridiales | Ruminococcaceae | Ruminococcus | Ruminococcus albus | 1.00 |
| OTU_801 | SET 1 | 177412 | Verrucomicrobia | Verrucomicrobiae | Verrucomicrobiales | Verrucomicrobiaceae | Fucophilus | Fucophilus fucoidanolyticus | 1.00 |
| OTU_1320 | SET 1 | 1121308 | Firmicutes | Clostridia | Clostridiales | Peptostreptococcaceae | Clostridioides | Clostridioides difficile ATCC 9689 = DSM 1296 | 0.50 |
| OTU_2930 | SET 1 | 419208 | Firmicutes | Negativicutes | Veillonellales | Veillonellaceae | Veillonella | Veillonella denticariosi | 1.00 |
| OTU_503 | SET 1 | 1673717 | Firmicutes | Clostridia | Clostridiales | Ruminococcaceae | Anaeromassilibacillus | Anaeromassilibacillus senegalensis | 1.00 |
| OTU_708 | SET 1 | 84026 | Firmicutes | Clostridia | Clostridiales | Ruminococcaceae | Ruminiclostridium | [Clostridium] methylpentosum | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_129 | SET 1 | 180311 | Firmicutes | Clostridia | Clostridiales | Lachnospiraceae | Hespellia | Hespellia stercorisuis | 0.59 |
| OTU_385 | SET 1 | 55779 | Firmicutes | Clostridia | Thermoanaerobacterales | Thermoanaerobacteraceae | Moorella | Moorella glycerini | 0.55 |
| OTU_279 | SET 1 | 28117 | Bacteroidetes | Bacteroidia | Bacteroidales | Rikenellaceae | Alistipes | Alistipes putredinis | 1.00 |
| OTU_1489 | SET 1 | 626937 | Firmicutes | Clostridia | Clostridiales | Christensenellaceae | Christensenella | Christensenella minuta | 1.00 |
| OTU_1237 | SET 1 | 180332 | Firmicutes | Clostridia | Clostridiales | Lachnospiraceae | Robinsoniella | Robinsoniella peoriensis | 1.00 |
| OTU_1951 | SET 1 | 213810 | Firmicutes | Clostridia | Clostridiales | Ruminococcaceae | Ruminococcus | Ruminococcus champanellensis 18P13 = JCM 17042 | 1.00 |
| OTU_2662 | SET 1 | 1776382 | Firmicutes | Clostridia | Clostridiales | Ruminococcaceae | Neglecta | Neglecta timonensis | 1.00 |
| OTU_3108 | SET 1 | 40519 | Firmicutes | Clostridia | Clostridiales | Ruminococcaceae | Ruminococcus | Ruminococcus callidus | 1.00 |
| OTU_1201 | SET 1 | 34062 | Proteobacteria | Gammaproteobacteria | Pseudomonadales | Moraxellaceae | Moraxella | Moraxella osloensis | 1.00 |
| OTU_551 | SET 1 | 40518 | Firmicutes | Clostridia | Clostridiales | Ruminococcaceae | Ruminococcus | Ruminococcus bromii | 1.00 |
| OTU_1077 | SET 1 | 74426 | Actinobacteria | Coriobacteriia | Coriobacteriales | Coriobacteriaceae | Collinsella | Collinsella aerofaciens | 1.00 |
| OTU_1126 | SET 1 | 1216062 | Firmicutes | Clostridia | Clostridiales | Peptococcaceae | Desulfotomaculum | Desulfotomaculum tongense | 1.00 |
| OTU_1138 | SET 1 | 293826 | Firmicutes | Clostridia | Clostridiales | Clostridiaceae | Alkaliphilus | Alkaliphilus metalliredigens QYMF | 1.00 |
| OTU_952 | SET 1 | 1619234 | Firmicutes | Clostridia | Clostridiales | Lachnospiraceae | Anaerobium | Anaerobium acetethylicum | 1.00 |
| OTU_2954 | SET 1 | 45851 | Firmicutes | Clostridia | Clostridiales | Lachnospiraceae | Butyrivibrio | Butyrivibrio crossotus | 1.00 |
| OTU_1721 | SET 1 | 84026 | Firmicutes | Clostridia | Clostridiales | Ruminococcaceae | Ruminiclostridium | [Clostridium] methylpentosum | 1.00 |
| OTU_1084 | SET 1 | 850 | Fusobacteria | Fusobacteriia | Fusobacteriales | Fusobacteriaceae | Fusobacterium | Fusobacterium mortiferum | 1.00 |
| OTU_106 | SET 1 | 44749 | Firmicutes | Clostridia | Clostridiales | Ruminococcaceae | Sporobacter | Sporobacter termitidis | 0.50 |
| OTU_1013 | SET 1 | 645466 | Firmicutes | Clostridia | Clostridiales | Lachnospiraceae | Anaerostipes | Anaerostipes butyraticus | 1.00 |
| OTU_1345 | SET 1 | 474960 | Firmicutes | Clostridia | Clostridiales | Ruminococcaceae | Hydrogenoanaerobacterium | Hydrogenoanaerobacterium saccharovorans | 1.00 |
| OTU_1775 | SET 1 | 84030 | Firmicutes | Clostridia | Clostridiales | Lachnospiraceae | Lachnoclostridium | [Clostridium] saccharolyticum | 1.00 |
| OTU_666 | SET 1 | 36835 | Firmicutes | Clostridia | Clostridiales | Lachnospiraceae | Tyzzerella | [Clostridium] colinum | 1.00 |
| OTU_1602 | SET 1 | 115544 | Firmicutes | Clostridia | Clostridiales | Lachnospiraceae | Parasporobacterium | Parasporobacterium paucivorans | 1.00 |
| OTU_550 | SET 1 | 1515 | Firmicutes | Clostridia | Clostridiales | Ruminococcaceae | Ruminiclostridium | Ruminiclostridium thermocellum | 1.00 |
| OTU_851 | SET 1 | 1515 | Firmicutes | Clostridia | Clostridiales | Ruminococcaceae | Ruminiclostridium | Ruminiclostridium thermocellum | 1.00 |
| OTU_1982 | SET 1 | 88431 | Firmicutes | Clostridia | Clostridiales | Lachnospiraceae | Dorea | Dorea longicatena | 1.00 |
| OTU_486 | SET 1 | 1515 | Firmicutes | Clostridia | Clostridiales | Ruminococcaceae | Ruminiclostridium | Ruminiclostridium thermocellum | 1.00 |
| OTU_1024 | SET 1 | 216932 | Tenericutes | Mollicutes | Entomoplasmatales | Spiroplasmataceae | Spiroplasma | Spiroplasma chinense | 1.00 |
| OTU_1262 | SET 1 | 853 | Firmicutes | Clostridia | Clostridiales | Ruminococcaceae | Faecalibacterium | Faecalibacterium prausnitzii | 1.00 |
| OTU_382 | SET 1 | 1417852 | Firmicutes | Clostridia | Clostridiales | unclassified. NA | Flintibacter | Flintibacter butyricus | 0.73 |
| OTU_472 | SET 1 | 694434 | Firmicutes | Clostridia | Clostridiales | Gracilibacteraceae | Gracilibacter | Gracilibacter thermotolerans JW/YJL-S1 | 1.00 |
| OTU_1076 | SET 1 | 39492 | Firmicutes | Clostridia | Clostridiales | Ruminococcaceae | Ruminiclostridium | [Eubacterium] siraeum | 1.00 |
| OTU_686 | SET 1 | 290042 | Firmicutes | Clostridia | Clostridiales | Eubacteriaceae | Eubacterium | Eubacterium coprostanoligenes | 1.00 |
| OTU_458 | SET 1 | 1583 | Firmicutes | Bacilli | Lactobacillales | Leuconostocaceae | Weissella | Weissella confusa | 1.00 |
| OTU_449 | SET 1 | 663278 | Firmicutes | Clostridia | Clostridiales | Ruminococcaceae | Ethanoligenens | Ethanoligenens harbinense YUAN-3 | 1.00 |
| OTU_555 | SET 1 | 154046 | Firmicutes | Clostridia | Clostridiales | Clostridiaceae | Hungatella | Hungatella hathewayi | 1.00 |
| OTU_1623 | SET 1 | 1297617 | Firmicutes | Clostridia | Clostridiales | unclassified. NA | Intestinimonas | Intestinimonas butyriciproducens | 1.00 |
| OTU_703 | SET 1 | 1515 | Firmicutes | Clostridia | Clostridiales | Ruminococcaceae | Ruminiclostridium | Ruminiclostridium thermocellum | 1.00 |
| OTU_347 | SET 1 | 420247 | Euryarchaeota | Methanobacteria | Methanobacteriales | Methanobacteriaceae | Methanobrevibacter | Methanobrevibacter smithii ATCC 35061 | 0.55 |
| OTU_1139 | SET 1 | 118967 | Bacteroidetes | Bacteroidia | Bacteroidales | Bacteroidaceae | Anaerorhabdus | Anaerorhabdus furcosa | 1.00 |
| OTU_1407 | SET 1 | 169435 | Firmicutes | Clostridia | Clostridiales | Ruminococcaceae | Anaerotruncus | Anaerotruncus colihominis | 1.00 |
| OTU_1414 | SET 1 | 1515 | Firmicutes | Clostridia | Clostridiales | Lachnospiraceae | Lachnoclostridium | [Clostridium] populeti | 1.00 |
| OTU_791 | SET 1 | 138595 | Actinobacteria | Coriobacteriia | Coriobacteriales | Atopobiaceae | Olsenella | Olsenella profusa | 1.00 |
| OTU_1246 | SET 1 | 31971 | Firmicutes | Erysipelotrichia | Erysipelotrichales | Erysipelotrichaceae | unclassified. NA | [Eubacterium] dolichum | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_216 | SET 1 | 100886 | Firmicutes | Erysipelotrichia | Erysipelotrichales | Erysipelotrichaceae | Catenibacterium | Catenibacterium mitsuokai | 1.00 |
| OTU_1147 | SET 1 | 1197717 | Synergistetes | Synergistia | Synergistales | Synergistaceae | Cloacibacillus | Cloacibacillus porcorum | 1.00 |
| OTU_733 | SET 1 | 234908 | Proteobacteria | Betaproteobacteria | Burkholderiales | Sutterellaceae | Sutterella | Sutterella stercoricanis | 1.00 |
| OTU_2095 | SET 1 | 44749 | Firmicutes | Clostridia | Clostridiales | Ruminococcaceae | Sporobacter | Sporobacter termitidis | 1.00 |
| OTU_659 | SET 1 | 2741 | Firmicutes | Clostridia | Clostridiales | Peptococcaceae | Peptococcus | Peptococcus niger | 1.00 |
| OTU_757 | SET 1 | 1852367 | Firmicutes | Clostridia | Clostridiales | Clostridiales Family XIII. Incertae Sedis | Ihubacter | Ihubacter massiliensis | 1.00 |
| OTU_2678 | SET 1 | 1417852 | Firmicutes | Clostridia | Clostridiales | unclassified. NA | Flintibacter | Flintibacter butyricus | 1.00 |
| OTU_1477 | SET 1 | 84026 | Firmicutes | Clostridia | Clostridiales | Ruminococcaceae | Ruminiclostridium | [Clostridium] methylpentosum | 0.68 |
| OTU_1402 | SET 1 | 762984 | Bacteroidetes | Bacteroidia | Bacteroidales | Bacteroidaceae | Bacteroides | Bacteroides clarus YIT 12056 | 1.00 |
| OTU_2177 | SET 1 | 537007 | Firmicutes | Clostridia | Clostridiales | Lachnospiraceae | Blautia | Blautia hansenii DSM 20583 | 1.00 |
| OTU_2566 | SET 1 | 487174 | Bacteroidetes | Bacteroidia | Bacteroidales | Porphyromonadaceae | Barnesiella | Barnesiella intestinihominis | 1.00 |
| OTU_2119 | SET 1 | 1732 | Firmicutes | Clostridia | Clostridiales | Eubacteriaceae | Eubacterium | Eubacterium oxidoreducens | 1.00 |
| OTU_1039 | SET 1 | 1535 | Firmicutes | Clostridia | Clostridiales | Ruminococcaceae | Ruminiclostridium | [Clostridium] leptum | 1.00 |
| OTU_1603 | SET 1 | 228924 | Firmicutes | Clostridia | Clostridiales | Clostridiales Family XII. Incertae Sedis | Guggenheimella | Guggenheimella bovis | 1.00 |
| OTU_2669 | SET 1 | 319644 | Firmicutes | Clostridia | Clostridiales | Ruminococcaceae | Saccharofermentans | Saccharofermentans acetigenes | 1.00 |
| OTU_2044 | SET 1 | 168384 | Firmicutes | Clostridia | Clostridiales | Lachnospiraceae | Marvinbryantia | Marvinbryantia formatexigens | 1.00 |
| OTU_411 | SET 1 | 915173 | Firmicutes | Erysipelotrichia | Erysipelotrichales | Erysipelotrichaceae | Faecalicoccus | Faecalicoccus acidiformans | 1.00 |
| OTU_357 | SET 1 | 95159 | Firmicutes | Clostridia | Clostridiales | Clostridiaceae | Caloramator | Caloramator coolhaasii | 1.00 |
| OTU_1616 | SET 1 | 31971 | Firmicutes | Erysipelotrichia | Erysipelotrichales | Erysipelotrichaceae | unclassified. NA | [Eubacterium] dolichum | 1.00 |
| OTU_541 | SET 1 | 1515 | Firmicutes | Clostridia | Clostridiales | Ruminococcaceae | Ruminiclostridium | Ruminiclostridium thermocellum | 1.00 |
| OTU_1737 | SET 1 | 1816678 | Firmicutes | Clostridia | Clostridiales | Christensenellaceae | Christensenella | Christensenella timonensis | 1.00 |
| OTU_2707 | SET 1 | 1417852 | Firmicutes | Clostridia | Clostridiales | unclassified. NA | Flintibacter | Flintibacter butyricus | 1.00 |
| OTU_255 | SET 1 | 626940 | Firmicutes | Negativicutes | Acidaminococcales | Acidaminococcaceae | Phascolarctobacterium | Phascolarctobacterium succinatutens | 1.00 |
| OTU_1901 | SET 1 | 501571 | Firmicutes | Clostridia | Clostridiales | Clostridiaceae | Butyricicoccus | Butyricicoccus pullicaecorum | 0.50 |
| OTU_3081 | SET 1 | 1796620 | Firmicutes | Clostridia | Clostridiales | Ruminococcaceae | Acutalibacter | Acutalibacter muris | 1.00 |
| OTU_2902 | SET 1 | 888727 | Firmicutes | Clostridia | Clostridiales | Clostridiales Family XIII. Incertae Sedis | unclassified. NA | Eubacterium sulci ATCC 35585 | 1.00 |
| OTU_2418 | SET 1 | 1147123 | Firmicutes | Clostridia | Clostridiales | Clostridiaceae | Caloramator | Caloramator quimbayensis | 1.00 |
| OTU_2936 | SET 1 | 1298596 | Firmicutes | Clostridia | Clostridiales | Ruminococcaceae | Ruminococcus | Ruminococcus faecis JCM 15917 | 1.00 |
| OTU_1244 | SET 1 | 376806 | Bacteroidetes | Bacteroidia | Bacteroidales | Bacteroidaceae | Bacteroides | Bacteroides gallinarum | 0.55 |
| OTU_1333 | SET 1 | 1515 | Firmicutes | Clostridia | Clostridiales | Ruminococcaceae | Ruminiclostridium | Ruminiclostridium thermocellum | 1.00 |
| OTU_1340 | SET 1 | 1274356 | Firmicutes | Bacilli | Bacillales | Thermoactinomycetaceae | Kroppenstedtia | Kroppenstedtia guangzhouensis | 1.00 |
| OTU_900 | SET 1 | 1267 | Firmicutes | Clostridia | Clostridiales | Clostridiaceae | Clostridium | Clostridium ventriculi | 1.00 |
| OTU_1684 | SET 1 | 1335 | Firmicutes | Bacilli | lactobacillales | Streptococcaceae | Streptococcus | Streptococcus equinus | 1.00 |
| OTU_3012 | SET 1 | 39495 | Firmicutes | Clostridia | Clostridiales | Eubacteriaceae | Eubacterium | Eubacterium uniforme | 1.00 |
| OTU_3013 | SET 1 | 213810 | Firmicutes | Clostridia | Clostridiales | Ruminococcaceae | Ruminococcus | Ruminococcus champanellensis 18P13 = JCM 17042 | 1.00 |
| OTU_1300 | SET 1 | 169435 | Firmicutes | Clostridia | Clostridiales | Ruminococcaceae | Anaerotruncus | Anaerotruncus colihominis | 1.00 |
| OTU_912 | SET 1 | 1852367 | Firmicutes | Clostridia | Clostridiales | Clostridiales Family XIII. Incertae Sedis | Ihubacter | Ihubacter massiliensis | 1.00 |
| OTU_786 | SET 1 | 404403 | Firmicutes | Clostridia | Clostridiales | unclassified. NA | Howardella | Howardella ureilytica | 1.00 |
| OTU_1277 | SET 1 | 1348 | Firmicutes | Bacilli | Lactobacillales | Streptococcaceae | Streptococcus | Streptococcus parauberis | 1.00 |
| OTU_1617 | SET 1 | 172901 | Lentisphaerae | Lentisphaeria | Victivallales | Victivallaceae | Vichvallis | Vichvallis vadensis | 1.00 |
| OTU_1994 | SET 1 | 45851 | Firmicutes | Clostridia | Clostridiales | Lachnospiraceae | Butyrivibrio | Butyrivibrio crossotus | 1.00 |
| OTU_1850 | SET 1 | 253314 | Firmicutes | Clostridia | Clostridiales | Ruminococcaceae | Ruminiclostridium | [Clostridium] straminisolvens | 1.00 |
| OTU_2802 | SET 1 | 45851 | Firmicutes | Clostridia | Clostridiales | Lachnospiraceae | Butyrivibrio | Butyrivibrio crossotus | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_581 | SET 1 | 1796619 | Firmicutes | Clostridia | Clostridiales | Eubacteriaceae | irregularibacter | Irregularibacter muris | 1.00 |
| OTU_1747 | SET 1 | 258515 | Firmicutes | Clostridia | Clostridiales | Ruminococcaceae | Acetanaerobacterium | Acetanaerobebacterium elongatum | 0.50 |
| OTU_2428 | SET 1 | 1297617 | Firmicutes | Clostridia | Clostridiales | unclassified. NA | Intestimonas | Intestimonas butyriciproducens | 1.00 |
| OTU_157 | SET 1 | 33033 | Firmicutes | Tissierella | Tissierellales | Peptoniphilaceae | Parvimonas | Parvimonas micra | 1.00 |
| OTU_630 | SET 1 | 1007096 | Firmicutes | Clostridia | Clostridiales | Oscillospiraceae | Oscillibacter | Oscillibacter ruminantium GH1 | 0.55 |
| OTU_1366 | SET 1 | 1297617 | Firmicutes | Clostridia | Clostridiales | unclassified. NA | Intestimonas | Intestimonas butyriciproducens | 1.00 |
| OTU_1247 | SET 1 | 649762 | Firmicutes | Clostridia | Clostridiales | Lachnospiraceae | Blautia | Blautia luti DSM 14534 | 1.00 |
| OTU_1590 | SET 1 | 1118061 | Bacteroidetes | Bacteroidia | Bacteroidales | Rikenellaceae | Alistipes | Alistipes obesi | 1.00 |
| OTU_3014 | SET 1 | 357276 | Bacteroidetes | Bacteroidia | Bacteroidales | Bacteroidaceae | Bacteroides | Bacteroides dorei | 1.00 |
| OTU_489 | SET 1 | 214851 | Firmicutes | Clostridia | Clostridiales | Ruminococcaceae | Subdoligranulum | Subdoligranulum variabile | 0.50 |
| OTU_1311 | SET 1 | 320502 | Firmicutes | Clostridia | Clostridiales | Ruminococcaceae | Ruminiclostridium | [Clostridium] alkalicellulosi | 1.00 |
| OTU_1389 | SET 1 | 217731 | Tenericutes | Mollicutes | Entomoplasmatales | Entomoplasmataceae | Mesoplasma | Mesoplasma photuris | 1.00 |
| OTU_1086 | SET 1 | 246787 | Bacteroidetes | Bacteroidia | Bacteroidales | Bacteroidaceae | Bacteroides | Bacteroides cellulasilyticus | 0.59 |
| OTU_1131 | SET 1 | 626937 | Firmicutes | Clostridia | Clostridiales | Christensenellaceae | Christensenella | Christensenella minuta | 1.00 |
| OTU_704 | SET 1 | 1841867 | Firmicutes | Clostridia | Clostridiales | Ruminococcaceae | Phocea | Phocea massiliensis | 1.00 |
| OTU_710 | SET 1 | 29371 | Firmicutes | Clostridia | Clostridiales | Ruminococcaceae | Ruminiclostridium | [Clostridium] termitidis | 1.00 |
| OTU_2810 | SET 1 | 84030 | Firmicutes | Clostridia | Clostridiales | Lachnospiraceae | Lachnoclostridium | [Clostridium] saccharolyticum | 1.00 |
| OTU_921 | SET 1 | 649764 | Actinobacteria | Coriobacteria | Eggerthellales | Eggerthellaceae | Slackia | Slackia exigua ATTC 700122 | 1.00 |
| OTU_1159 | SET 1 | 290054 | Firmicutes | Clostridia | Clostridiales | Eubacteriaceae | Eubacterium | Eubacterium coprostanoligenes | 1.00 |
| OTU_2583 | SET 1 | 901 | Proteobacteria | Deltaproteobacteria | Desulfovibrionales | Desulfovibrionaceae | Desulfovibrio | Desulfovibrio piger | 1.00 |
| OTU_1767 | SET 1 | 1776382 | Firmicutes | Clostridia | Clostridiales | Ruminococcaceae | Neglecta | Neglecta timonensis | 1.00 |
| OTU_984 | SET 1 | 29374 | Firmicutes | Clostridia | Clostridiales | Peptostreptococcaceae | Filifactor | Filifactor villosus | 1.00 |
| OTU_1065 | SET 1 | 1776382 | Firmicutes | Clostridia | Clostridiales | Ruminococcaceae | Neglecta | Neglecta timonensis | 1.00 |
| OTU_1763 | SET 1 | 29343 | Firmicutes | Clostridia | Clostridiales | Ruminococcaceae | Ruminiclostridium | [Clostridium] cellulosi | 1.00 |
| OTU_1768 | SET 1 | 33043 | Firmicutes | Clostridia | Clostridiales | Lachnospiraceae | Coprococcus | Coprococcus eutactus | 1.00 |
| OTU_1525 | SET 1 | 39778 | Firmicutes | Negativicutes | Veillortellales | Veillonellaceae | Veillonella | Veillonella dispar | 1.00 |
| OTU_2860 | SET 1 | 39778 | Firmicutes | Negativicutes | Veilloneliales | Veillonellaceae | Veillonella | Veillonella clispar | 1.00 |
| OTU_2297 | SET 1 | 86332 | Fibmicu | Clostridia | Clostridiales | Clostridiales Family XIII, Incertae Sedis | Mogibacterium | Mogibacterium pumilum | 1.00 |
| OTU_842 | SET 1 | 682400 | Firmicutes | Clostridia | Clostridiales | unclassified. NA | Natranaerovirga | Natranaerovirga pectinivora | 0.55 |
| OTU_1567 | SET 1 | 871665 | Firmicutes | Clostridia | Clostridiales | Lachnospiraceae | Blautia | Blautia faecis | 1.00 |
| OTU_1774 | SET 1 | 160404 | Firmicutes | Clostridia | Clostridiales | Lactobacillaceae | Tyzzerella | [Clostridium] lactatifermentans | 1.00 |
| OTU_974 | SET 1 | 626937 | Firmicutes | Clostridia | Clostridiales | Christerisenellaceae | Christensenella | Christensenella minuta | 1.00 |
| OTU_1578 | SET 1 | 396504 | Firmicutes | Clostridia | Clostridiales | Ruminococcaceae | Ruminiclostridium | [Clostridium] sufflavum | 1.00 |
| OTU_1196 | SET 1 | 214851 | Firmicutes | Clostridia | Clostridiales | Ruminococcaceae | Subdoligranulum | Subdoligranulum variabile | 0.50 |
| OTU_1680 | SET 1 | 1502 | Firmicutes | Clostridia | Clostridiales | Clostridiaceae | Clostridium | Clostridium perfringens | 1.00 |
| OTU_562 | SET 1 | 40519 | Firmicutes | Clostridia | Clostridiales | Ruminococcaceae | Ruminococcus | Ruminococcus callidus | 1.00 |
| OTU_1455 | SET 1 | 745368 | Firmicutes | Clostridia | Clostridiales | Ruminococcaceae | Gemmiger | Gemmiger formicilis | 1.00 |
| OTU_2413 | SET 1 | 408 | Proteob acteria | Alphaproteobacteria | Rhizobiales | Methylobacteriaceae | Methylbacterium | Methylbacterium extorquens | 1.00 |
| OTU_575 | SET 1 | 1535 | Firmicutes | Clostridia | Clostridiales | Ruminococcaceae | Ruminiclostridium | [Clostridium] leptum | 1.00 |
| OTU_294 | SET 1 | 1584 | Firmicutes | Bacilli | Lactobacillales | Lactobacillaceae | Lactobacillus | Lactobacillus delbrueckii | 1.00 |
| OTU_1362 | SET 1 | 288966 | Firmicutes | Clostridia | Clostridiales | Clostridiaceae | Lutispora | Lutispora thermophila | 1.00 |
| OTU_1931 | SET 1 | 100176 | Firmicutes | Clostridia | Clostridiales | Ruminococcaceae | Papillibacter | Papillibacter cinnamivorans | 1.00 |
| OTU_1619 | SET 1 | 1510 | Firmicutes | Clostridia | Clostridiales | Ruminococcaceae | Ruminiclostridium | [Clostridium] stercorarium | 1.00 |
| OTU_779 | SET 1 | 333367 | Firmicutes | Clostridia | Clostridiales | Lachnospiraceae | Lachnoclostridium | [Clostridium] asparagiforme | 1.00 |
| OTU_1119 | SET 1 | 47246 | Firmicutes | Clostridia | Clostridiales | Ruminococcaceae | Ruminiclostrictlu | [Clostridium] viride | 1.00 |
| OTU_731 | SET 1 | 694434 | Firmicutes | Clostridia | Clostridiales | Gracilibacteraceae | Gracilibacter | Gracilibacter thermotolerans JW/YJL-S1 | 0.59 |
| OTU_403 | SET 1 | 1007096 | Firmicutes | Clostridia | Clostridiales | Oscillospiraceae | Oscillibacter | Oscillibacter ruminantium GH1 | 0.55 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1279 | SET 1 | 47246 | Firmicutes | Clostridia | Clostridiales | Ruminococcaceae | Ruminiclostridium | [Clostridium] viride | 1.00 |
| OTU_1514 | SET 1 | 1096246 | Firmicutes | Clostridia | Clostridiales | Clostridiaceae | Hungatella | Hungatella effluvii | 1.00 |
| OTU_1992 | SET 1 | 154046 | Firmicutes | Clostridia | Clostridiales | Clostridiaceae | Hungatella | Hungatella hathewayi | 1.00 |
| OTU_2248 | SET 1 | 290052 | Firmicutes | Clostridia | Clostridiales | Ruminococcaceae | Acetivibrio | Acetivibrio ethanolgignens | 1.00 |
| OTU_2668 | SET 1 | 642492 | Firmicutes | Clostridia | Clostridiales | Lachnospiraceae | Cellulosilyticum | Clostridium lentocellum DSM 5427 | 1.00 |
| OTU_631 | SET 1 | 53342 | Firmicutes | Clostridia | Clostridiales | Clostridiaceae | Caloramator | Caloramator proteoclasticus | 0.63 |
| OTU_1998 | SET 1 | 54291 | Proteobacteria | Gammaproteobacteria | Enterobacterales | Enterobacteriaceae | Raoultella | Raoultella ornithinolytica | 1.00 |
| OTU_1031 | SET 1 | 438033 | Firmicutes | Clostridia | Clostridiales | Ruminococcaceae | Ruminococcus | Ruminococcus gauvreauii | 1.00 |
| OTU_2991 | SET 1 | 351091 | Firmicutes | Clostridia | Clostridiales | Oscillospiraceae | Oscillibacter | Oscillibacter valericigenes | 0.55 |
| OTU_2032 | SET 1 | 1796622 | Firmicutes | Clostridia | Clostridiales | Lachnospiraceae | Extibacter | Extibacter muris | 1.00 |
| OTU_2641 | SET 1 | 169435 | Firmicutes | Clostridia | Clostridiales | Ruminococcaceae | Anaerotruncus | Anaerotruncus colihominis | 1.00 |
| OTU_1657 | SET 1 | 44749 | Firmicutes | Clostridia | Clostridiales | Ruininococcaceae | Sporobacter | Sporobacter termitidis | 0.55 |
| OTU_880 | SET 1 | 694434 | Firmicutes | Clostridia | Clostridiales | Gracilibacteraceae | Gracilibacter | Gracilibacter thermotolerans JW/YJL-S1 | 1.00 |
| OTU_405 | SET 1 | 1776384 | Firmicutes | Clostridia | Clostridiales | Clostridiales Family XIII, Incertae Sedis | Emergencia | Emergencia timonensis | 0.50 |
| OTU_809 | SET 1 | 39492 | Firmicutes | Clostridia | Clostridiales | Ruminococcaceae | Ruminiclostridium | [Eubacterium] siraeum | 1.00 |
| OTU_2167 | SET 1 | 817 | Bacteroidetes | Bacteroidia | Bacteroidales | Bacteroidaceae | Bacteroides | Bacteroides fragilis | 1.00 |
| OTU_2670 | SET 1 | 84026 | Firmicutes | Clostridia | Clostridiales | Ruiminococcaceae | Ruminiclostridium | [Clostridium] methylpentosum | 1.00 |
| OTU_2671 | SET 1 | 1417852 | Firmicutes | Clostridia | Clostridiales | unclassified. NA | Flintibacter | Flintibacter butyricus | 1.00 |
| OTU_1056 | SET 1 | 411467 | Firmicutes | Clostridia | Clostridiales | unclassified. NA | Pseudoflavonifractor | Pseudoflavonifractor capillosus | 1.00 |
| OTU_1597 | SET 1 | 1776348 | Firmicutes | Clostridia | Clostridiales | Clostridiales Family XIII, Incertae Sedis | Emergencia | Emergencia timonensis | 1.00 |
| OTU_739 | SET 1 | 48256 | Firmicutes | Clostridia | Clostridiales | Ruminococcaceae | Ruminiclostridium | [Clostridium] hungatei | 1.00 |
| OTU_894 | SET 1 | 853 | Firmicutes | Clostridia | Clostridiales | Ruminococcaceae | Faecalibacterium | Faecalibacterium prausnitzii | 1.00 |
| OTU_961 | SET 1 | 853 | Firmicutes | Clostridia | Clostridiales | Ruminococcaceae | Faecalibacterium | Faecalibacterium prausnitzii | 1.00 |
| OTU_820 | SET 1 | 1515 | Firmicutes | Clostridia | Clostridiales | Ruminococcaceae | Ruminiclostridium | Ruminiclostridium thermocellum | 1.00 |
| OTU_1466 | SET 1 | 1706620 | Firmicutes | Clostridia | Clostridiales | Ruminococcaceae | Acutalibacter | Acutalibacter muris | 1.00 |
| OTU_1741 | SET 1 | 720554 | Firmicutes | Clostridia | Clostridiales | Ruminococcaceae | Ruminiclostridium | [Clostridium] clariflavum DSM 19732 | 1.00 |
| OTU_1984 | SET 1 | 1007096 | Firmicutes | Clostridia | Clostridiales | Oscillospiraceae | Oscillibacter | Oscillibacter ruminantium GH1 | 1.00 |
| OTU_2004 | SET 1 | 47246 | Firmicutes | Clostridia | Clostridiales | Ruminococcaceae | Ruminiclostridium | [Clostridium] viride | 1.00 |
| OTU_2005 | SET 1 | 500632 | Firmicutes | Clostridia | Clostridiales | Lachnospiraceae | Tyzzerella | Tyzzerella nexilis DSM 1787 | 1.00 |
| OTU_2655 | SET 1 | 44749 | Firmicutes | Clostridia | Clostridiales | Ruminococcaceae | Sporobacter | Sporobacter termitidis | 1.00 |
| OTU_1548 | SET 1 | 626937 | Firmicutes | Clostridia | Clostridiales | Christensenellaceae | Christensenella | Christensenella minuta | 1.00 |
| OTU_1307 | SET 1 | 1776382 | Firmicutes | Clostridia | Clostridiales | Ruminococcaceae | Neglecta | Neglecta timonensis | 1.00 |
| OTU_1329 | SET 1 | 694434 | Firmicutes | Clostridia | Clostridiales | Gracilibacteraceae | Gracilibacter | Gracilibacter thermotolerans | 1.00 |
| OTU_1081 | SET 1 | 100176 | Firmicutes | Clostridia | Clostridiales | Ruminococcaceae | Papilibacter | Papilibacter cinnamivorans | 1.00 |
| OTU_2028 | SET 1 | 1515 | Firmicutes | Clostridia | Clostridiales | Ruminococcaceae | Ruminiclostridium | Ruminiclostridium thermocellum | 1.00 |
| OTU_1766 | SET 1 | 36849 | Firmicutes | Clostridia | Clostridiales | Clostridiaceae | Oxobacter | Oxobacter pfennigi | 1.00 |
| OTU_2219 | SET 1 | 301302 | Firmicutes | Clostridia | Clostridiales | Lachnospiraceae | Roseburia | Roseburia faecis | 1.00 |
| OTU_2117 | SET 1 | 879970 | Firmicutes | Clostridia | Clostridiales | Defluviitaleaceae | Defluviitalea | Defluviitalea saccharophila | 1.00 |
| OTU_410 | SET 1 | 655811 | Firmicutes | Tissierella | Tissierellales | Peptoniphilaceae | Anaerococcus | Anaerococcus vaginalis ATCC 51170 | 1.00 |
| OTU_1411 | SET 1 | 1096246 | Firmicutes | Clostridia | Clostridiales | Clostridiaceae | Hungatella | Hungatella effluvii | 1.00 |
| OTU_2567 | SET 1 | 264463 | Firmicutes | Clostridia | Clostridiales | Lachnospiraceae | Anaerosporobacter | Anaerosporobacter mobilis | 1.00 |
| OTU_864 | SET 1 | 1532 | Firmicutes | Clostridia | Clostridiales | Lachnospiraceae | Blautia | Blautia coccoides | 1.00 |
| OTU_2001 | SET 1 | 29375 | Firmicutes | Clostridia | Clostridiales | Lachnospiraceae | Lachnoclostridium | [Clostridium] xylanolyticum | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1535 | SET 1 | 285 | Proteobacteria | Betaproteobacteria | Burkholderiales | Comamonadaceae | Comamonas | Comamonas testosteroni | 1.00 |
| OTU_2111 | SET 1 | 995 | Bacteroidetes | Sphingobacteri | Sphingobacteriales | Sphingobacteriaceae | Solitalea | Solitalea canadensis | 1.00 |
| OTU_978 | SET 1 | 242750 | Bacteroidetes | Bacteroidia | Bacteroidales | Prevotellaceae | Prevotella | Prevotella bergensis | 1.00 |
| OTU_765 | SET 1 | 1007096 | Firmicutes | Clostridia | Clostridiales | Oscillospiraceae | Oscillibacter | Oscillibacter ruminantium GH1 | 1.00 |
| OTU_2419 | SET 1 | 29539 | Actinobacteria | Thermoleophil | Thermoleophilales | Thermoleophilaceae | Thermoleophilum | Thermoleophilum album | 1.00 |
| OTU_2853 | SET 1 | 1432052 | Firmicutes | Clostridia | Clostridiales | Lachanospiraceae | Eisenbergiella | Eisenbergiella tayi | 1.00 |
| OTU_1220 | SET 1 | 1673717 | Firmicutes | Clostridia | Clostridiales | Ruminocaceae | Anaeromassilibactillus | Anaeramassilibacillus senegalensis | 1.00 |
| OTU_850 | SET 1 | 168384 | Firmicutes | Clostridia | Clostridiales | Lachnospiraceae | Marvinbryantia | Marvinbryanta formatexigens | 1.00 |
| OTU_777 | SET 1 | 39492 | Firmicutes | Clostridia | Clostridiales | Ruminococcaceae | Ruminiclostridum | [Eubacterium] siraeum | 0.50 |
| OTU_713 | SET 1 | 1535 | Firmicutes | Clostridia | Clostridiales | Ruminoeoccaceae | Ruminiclostridum | [Clostridium] leptum | 0.63 |
| OTU_2973 | SET 1 | 622312 | Firmicutes | Clostridia | Clostridiales | Lachnospiraceae | Roseburia | Roseburia inulinvarans DSM 16841 | 1.00 |
| OTU_1324 | SET 1 | 36849 | Firmicutes | Clostridia | Clostridiales | Clostridiaceae | Oxobacter | Oxobacter pfennigii | 1.00 |
| OTU_1061 | SET 1 | 84026 | Firmicutes | Clostridia | Clostridiales | Ruminoeoccaceae | Ruminiclostridum | [Clostridium] methylpentosum | 1.00 |
| OTU_3167 | SET 1 | 622312 | Firmicutes | Clostridia | Clostridiales | Lachnospiraceae | Roseburia | Roseburia inulinvarans DSM 16841 | 0.72 |
| OTU_1337 | SET 1 | 1796636 | Firmicutes | Clostridia | Clostridiales | Lachnospiraceae | Frisingicoccus | Frisingicoccus caecimuris | 1.00 |
| OTU_2731 | SET 1 | 214851 | Firmicutes | Clostridia | Clostridiales | Ruminoeoccaceae | Subdoligranalum | Subdoligranalum variabile | 1.00 |
| OTU_2654 | SET 1 | 100176 | Firmicutes | Clostridia | Clostridiales | Ruminococcaceae | Papillibacter | Papillibacter cinnamivorans | 1.00 |
| OTU_2807 | SET 1 | 1337051 | Firmicutes | Clostridia | Clostridiales | Lachnospiraceae | Murimonas | Murimonas intestini | 1.00 |
| OTU_3041 | SET 1 | 328814 | Bacteroidetes | Bacteroidia | Bacteroidales | Rikenellaceae | Alistipes | Alistipes shahii | 0.65 |
| OTU_1861 | SET 1 | 28446 | Firmicutes | Clostridia | Clostridiales | Lachnospiraceae | Tyzzerella | [Clostridium] propionicum | 1.00 |
| OTU_1726 | SET 1 | 1776382 | Firmicutes | Clostridia | Clostridiales | Ruminococcaceae | Neglecta | Neglecta timonensis | 1.00 |
| OTU_2618 | SET 1 | 1796620 | Firmicutes | Clostridia | Clostridiales | Ruminococcaceae | Acutalibacter | Acutalibacter muris | 1.00 |
| OTU_2484 | SET 1 | 1492 | Firmicutes | Clostridia | Clostridiales | Clostridiaceae | Clostridium | Clostridium butyricum | 1.00 |
| OTU_1378 | SET 1 | 694434 | Firmicutes | Clostridia | Clostridiales | Gracilibacteraceae | Gracilibacter | Gracilibacter thermotolerans JW/YJK-S1 | 1.00 |
| OTU_2645 | SET 1 | 820 | Bacteroidetes | Bacteroidia | Bacteroidales | Bacteroidaceae | Bacteroides | Bacteroides uniformis | 1.00 |
| OTU_1258 | SET 1 | 213810 | Firmicutes | Clostridia | Clostridiales | Ruminococcaceae | Ruminococcus | Ruminococcus champanellensis 18P13 - JCM 17042 | 1.00 |
| OTU_1899 | SET 1 | 853 | Firmicutes | Clostridia | Clostridiales | Ruminococcaceae | Faecalibacterium | Faecalibacterium prausnitzii | 1.00 |
| OTU_1999 | SET 1 | 44749 | Firmicutes | Clostridia | Clostridiales | Ruminococcaceae | Sporobacter | Sporobacter termitidis | 1.00 |
| OTU_2796 | SET 1 | 29375 | Firmicutes | Clostridia | Clostridiales | Lachnospiraceae | Lachnoclastridium | [Clostridium] xylanolyticum | 1.00 |
| OTU_2614 | SET 1 | 39496 | Firmicutes | Clostridia | Clostridiales | Eubacteriaceae | Eubacterium | Eubacterium ventriosum | 1.00 |
| OTU_522 | SET 1 | 169435 | Firmicutes | Clostridia | Clostridiales | Ruminococcaceae | Anaerotruncus | Anaerotruncus colihominis | 0.55 |
| OTU_2071 | SET 1 | 52786 | Firmicutes | Clostridia | Clostridiales | Ruminococcaceae | Anaerofilum | Anaerofilum agile | 1.00 |
| OTU_1859 | SET 1 | 1535 | Firmicutes | Clostridia | Clostridiales | Ruminococcaceae | Ruminiclostridium | [Clostridium] leptum | 1.00 |
| OTU_2913 | SET 1 | 39492 | Firmicutes | Clostridia | Clostridiales | Ruminococcaceac | Ruminiclostridium | [Eubacterium] siraeum | 1.00 |
| OTU_3126 | SET 1 | 39497 | Firmicutes | Clostridia | Clostridiales | Eubacteriaceae | Eubacterium | Eubacterium xylanophilum | 1.00 |
| OTU_2123 | SET 1 | 44749 | Firmicutes | Clostridia | Clostridiales | Ruminococcaceae | Sporobacter | Sporobacter termitidis | 1.00 |
| OTU_2676 | SET 1 | 1549 | Firmicutes | Clostridia | Clostridiales | Ruminococcaceae | Ruminiclostridium | [Clostridium] sporosphaeroides | 1.00 |
| OTU_2118 | SET 1 | 1796618 | Firmicutes | Clostridia | Clostridiales | Lachnospiraceae | Cuneatibacter | Cuneatibacter caecimuris | 1.00 |
| OTU_1091 | SET 1 | 582 | Proteobacteria | Gammaproteobacteria | Enterobacterales | Morganellaceae | Morganella | Morganella morganii | 1.00 |
| OTU_1800 | SET 1 | 160404 | Firmicutes | Clostridia | Clostridiales | Lachnospiraceae | Tyzzerella | [Clostridium] lactatifermentans | 1.00 |
| OTU_1190 | SET 1 | 213810 | Firmicutes | Clostridia | Clostridiales | Ruminococcaceae | Ruminococcus | Ruminococcus champanellensis 18P13 = JCM 17042 | 1.00 |
| OTU_2220 | SET 1 | 40519 | Firmicutes | Clostridia | Clostridiales | Ruminococcaceae | Ruminococcus | Ruminococcus callidus | 1.00 |
| OTU_373 | SET 1 | 46507 | Firmicutes | Tissierellia | unclassified. NA | unclassified. NA | unclassified. NA | [Bacteroides] coagulans | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1094 | SET 1 | 694434 | Firmicutes | Clostridia | Clostridiales | Gracilibacteraceae | Gracilibacter | Gracilibacter thermotolerans JW/YJL-S1 | 1.00 |
| OTU_1473 | SET 1 | 109327 | Firmicutes | Clostridia | Clostridiales | Clostridiales Family XIII. Incertae Sedis | Anaerovorax | Anaerovorax odorimutans | 1.00 |
| OTU_2273 | SET 1 | 1531 | Firmicutes | Clostridia | Clostridiales | Lachnospiraceae | Lachnoclostridium | [Clostridium] clostridioforme | 1.00 |
| OTU_210 | SET 1 | 1382 | Actinobacteria | Coriobacteriia | Coriobacteriales | Atopobiaceae | Atopobium | Atopobium parvulum | 1.00 |
| OTU_2632 | SET 1 | 853 | Firmicutes | Clostridia | Clostridiales | Ruminococcaceae | Faecalibacterium | Faecalibacterium prausnitzii | 0.75 |
| OTU_2850 | SET 1 | 33039 | Firmicutes | Clostridia | Clostridiales | Lachnospiraceae | Blautia | [Ruminococcus] torques | 1.00 |
| OTU_2808 | SET 1 | 1432052 | Firmicutes | Clostridia | Clostridiales | Lachnospiraceae | Eisenbergiella | Eisenbergiella tayi | 1.00 |
| OTU_754 | SET 1 | 311460 | Firmicutes | Bacilli | Bacillales | Bacillaceae | Anoxybacillus | Anoxybacillus rupiensis | 1.00 |
| OTU_1278 | SET 1 | 1264 | Firmicutes | Clostridia | Clostridiales | Ruminococcaceae | Ruminococcus | Ruminococcus albus | 1.00 |
| OTU_972 | SET 1 | 582 | Proteobacteria | Gammaproteobacteria | Enterobacterales | Morganellaceae | Morganella | Morganella morganii | 0.50 |
| OTU_3152 | SET 1 | 301302 | Firmicutes | Clostridia | Clostridiales | Lachnospiraceae | Roseburia | Roseburia faecis | 1.00 |
| OTU_177 | SET 1 | 230143 | Actinobacteria | Actinobacteria | Bifidobacteriales | Bifidobacteriaceae | Scardovia | Scardovia wiggsiae | 1.00 |
| OTU_802 | SET 1 | 216935 | Tenericutes | Mollicutes | Entomoplasmatales | Spiroplasmataceae | Spiroplasma | Spiroplasma culicicola | 1.00 |
| OTU_445 | SET 1 | 853 | Firmicutes | Clostridia | Clostridiales | Ruminococcaceae | Faecalibacterium | Faecalibacterium prausnitzii | 1.00 |
| OTU_1973 | SET 1 | 1337051 | Firmicutes | Clostridia | Clostridiales | Lachnospiraceae | Murimonas | Murimonas intestini | 1.00 |
| OTU_1650 | SET 1 | 84026 | Firmicutes | Clostridia | Clostridiales | Ruminococcaceae | Ruminiclostridium | [Clostridium] methylpentosum | 1.00 |
| OTU_1782 | SET 1 | 539 | Proteobacteria | Betaproteobacteria | Neisseriales | Neisseriaceae | Eikenella | Eikenella corrodens | 1.00 |
| OTU_310 | SET 1 | 35519 | Firmicutes | Clostridia | Clostridiales | Clostridiales Family XIII. Incertae Sedis | Mogibacterium | Mogibacterium timidum | 1.00 |
| OTU_2045 | SET 1 | 1681 | Actinobacteria | Actinobacteria | Bifidobacteriales | Bifidobacteriaceae | Bifidobacterium | Bifidobacterium bifidum | 1.00 |
| OTU_3178 | SET 1 | 328813 | Bacteroidetes | Bacteroidia | Bacteroidales | Rikenellaceae | Alistipes | Alistipes onderdonkii | 1.00 |
| OTU_1468 | SET 1 | 214853 | Firmicutes | Clostridia | Clostridiales | Eubacteriaceae | Anaerofustis | Anaerofustis stercorihominis | 1.00 |
| OTU_2798 | SET 1 | 154046 | Firmicutes | Clostridia | Clostridiales | Clostridiaceae | Hungatella | Hungatella hathewayi | 1.00 |
| OTU_799 | SET 1 | 169435 | Firmicutes | Clostridia | Clostridiales | Ruminococcaceae | Anaerotruncus | Anaerotruncus colihominis | 0.55 |
| OTU_1365 | SET 1 | 39495 | Firmicutes | Clostridia | Clostridiales | Eubacteriaceae | Eubacterium | Eubacterium uniforme | 1.00 |
| OTU_1773 | SET 1 | 1297102 | Firmicutes | Clostridia | Clostridiales | unclassified. NA | Intestinimonas | Intestinimonas butyriciproducens | 1.00 |
| OTU_3011 | SET 1 | 290054 | Firmicutes | Clostridia | Clostridiales | Eubacteriaceae | Eubacterium | Eubacterium coprostanoligenes | 1.00 |
| OTU_1433 | SET 1 | 109327 | Firmicutes | Clostridia | Clostridiales | Clostridiales Family XIII. Incertae Sedis | Anaerovorax | Anaerovorax odorimutans | 1.00 |
| OTU_1863 | SET 1 | 89014 | Firmicutes | Clostridia | Clostridiales | Lachnospiraceae | Blautia | Blautia luti | 1.00 |
| OTU_2270 | SET 1 | 33043 | Firmicutes | Clostridia | Clostridiales | Lachnospiraceae | Coprococcus | Coprococcus eutactus | 1.00 |
| OTU_2596 | SET 1 | 216933 | Tenericutes | Mollicutes | Entomoplasmatales | Spiroplasmataceae | Spiroplasma | Spiroplasma chrysopicola | 1.00 |
| OTU_826 | SET 1 | 537007 | Firmicutes | Clostridia | Clostridiales | Lachnospiraceae | Blautia | Blautia hansenii DSM 20583 | 1.00 |
| OTU_2844 | SET 1 | 1121115 | Firmicutes | Clostridia | Clostridiales | Lachnospiraceae | Blautia | Blautia wexlerae DSM 19850 | 0.55 |
| OTU_2120 | SET 1 | 1585974 | Firmicutes | Clostridia | Clostridiales | Clostridiaceae | Beduini | Beduini massiliensis | 1.00 |
| OTU_2927 | SET 1 | 29466 | Firmicutes | Negativicutes | Veillonellales | Veillonellaceae | Veillonella | Veillonella parvula | 1.00 |
| OTU_2750 | SET 1 | 290052 | Firmicutes | Clostridia | Clostridiales | Ruminococcaceae | Acetivibrio | Acetivibrio ethanolgignens | 1.00 |
| OTU_2621 | SET 1 | 1796646 | Bacteroidetes | Bacteroidia | Bacteroidales | Porphyromonadaceae | Muribaculum | Muribaculum intestinale | 1.00 |
| OTU_1996 | SET 1 | 1363 | Firmicutes | Bacilli | Lactobacillales | Streptococcaceae | Lactococcus | Lactococcus garvieae | 1.00 |
| OTU_1877 | SET 1 | 54291 | Proteobacteria | Gammaproteobacteria | Enterobacterales | Enterobacteriaceae | Raoultella | Raoultella ornithinolytica | 1.00 |
| OTU_3051 | SET 1 | 411467 | Firmicutes | Clostridia | Clostridiales | unclassified. NA | Pseudoflavonifractor | Pseudoflavonifractor capillosus ATCC 29799 | 1.00 |
| OTU_2033 | SET 1 | 292800 | Firmicutes | Clostridia | Clostridiales | unclassified. NA | Flavonifractor | Flavonifractor plautii | 1.00 |
| OTU_2000 | SET 1 | 270498 | Firmicutes | Clostridia | Closiridiales | Catabacteriaceae | Catabacter | Catabacter hongkongensis | 1.00 |
| OTU_945 | SET 1 | 214856 | Bacteriodetes | Bacteroidia | Bacteroidales | Rikenellaceae | Alistipes | Alistipes finegoldii | 0.70 |
| OTU_1636 | SET 1 | 142877 | Firmicutes | Clostridia | Clostridiales | Peptococcaceae | Desulfitobacterium | Desulfitobacterium metallireducens | 1.00 |
| OTU_2027 | SET 1 | 341220 | Firmicutes | Clostridia | Clostridiales | Clostridiaceae | Lactonifactor | Lactonifactor longoviformis | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_3205 | SET 1 | 820 | Bacteriodetes | Bacteroidia | Bacteroidales | Bacteroidaceae | Bacteroides | Bacteroides uniformis | 1.00 |
| OTU_1174 | SET 1 | 109327 | Firmicutes | Clostridia | Clostridiales | Clostridiales Family XIII, Incertae Sedis | Anaerovorax | Anaerovorax odorimutans | 1.00 |
| OTU_1866 | SET 1 | 133926 | Actinobacteria | Coriobacteriia | Coriobacteriales | Atopobiaceae | Olsenella | Olsenella uli | 1.00 |
| OTU_2265 | SET 1 | 1583 | Firmicutes | Bacilli | Lactobacillales | Leuconostocaceae | Weissella | Weissella confusa | 1.00 |
| OTU_2518 | SET 1 | 84026 | Firmicutes | Clostridia | Clostridiales | Ruminococcaceae | Ruminiclostridium | [Clostridium] methylpentosum | 1.00 |
| OTU_2874 | SET 1 | 209880 | Firmicutes | Negativicutes | Veillonellales | Veillonellaceae | Allisonella | Allisonella histaminiformans | 1.00 |
| OTU_2877 | SET 1 | 179628 | Firmicutes | Clostridia | Clostridiales | Clostridiaceae | Clostridium | Clostridium colicanis | 1.00 |
| OTU_3077 | SET 1 | 100176 | Firmicutes | Clostridia | Clostridiales | Ruminococcaceae | Papillibacter | Papillibacter cinnamivorans | 1.00 |
| OTU_980 | SET 1 | 1776382 | Firmicutes | Clostridia | Clostridiales | Ruminococcaceae | Neglecta | Neglecta timonensis | 1.00 |
| OTU_1101 | SET 1 | 1510 | Firmicutes | Clostridia | Clostridiales | Lachnospiraceae | Ruminiclostridium | [Clostridium] stercorarium | 1.00 |
| OTU_1962 | SET 1 | 84030 | Firmicutes | Clostridia | Clostridiales | Lachnospiraceae | Lachnoclostridium | [Clostridium] saccharolyticum | 1.00 |
| OTU_2309 | SET 1 | 166486 | Firmicutes | Clostridia | Clostridiales | Lachnospiraceae | Roseburia | Roseburia intestinalis | 0.50 |
| OTU_2282 | SET 1 | 1531 | Firmicutes | Clostridia | Clostridiales | Lachnospiraceae | Lachnoclostridium | [Clostridium] clostridioforme | 1.00 |
| OTU_2151 | SET 1 | 1544 | Firmicutes | Clostridia | Clostridiales | Lachnospiraceae | Lachnoclostridium | [Clostridium] oroticum | 1.00 |
| OTU_1068 | SET 1 | 2741 | Firmicutes | Clostridia | Clostridiales | Peptococcaceae | Peptococcus | Peptococcus niger | 1.00 |
| OTU_2427 | SET 1 | 213810 | Firmicutes | Clostridia | Clostridiales | Ruminococcaceae | Ruminococcus | Ruminococcus champanellensis 18P13 = JCM 17042 | 1.00 |
| OTU_1148 | SET 1 | 169435 | Firmicutes | Clostridia | Clostridiales | Ruminococcaceae | Anaerotruncus | Anaerotruncus colihominis | 0.55 |
| OTU_919 | SET 1 | 1297424 | Firmicutes | Clostridia | Clostridiales | Ruminococcaceae | Anaerobacterium | Anaerobacterium chartisolvens | 1.00 |
| OTU_1222 | SET 1 | 871665 | Firmicutes | Clostridia | Clostridiales | Lachnospiraceae | Blautia | Blautia faecis | 0.63 |
| OTU_2569 | SET 1 | 84026 | Firmicutes | Clostridia | Clostridiales | Ruminococcaceae | Ruminiclostridium | [Clostridium] methylpentosum | 1.00 |
| OTU_1049 | SET 1 | 1673717 | Firmicutes | Clostridia | Clostridiales | Ruminococcaceae | Anaeromassilibacillus | Anaeromassilibacillus senegalensis | 1.00 |
| OTU_1496 | SET 1 | 54291 | Proteobacteria | Gammaproteobacteria | Enterobacterales | Enterobacteriaceae | Raoultella | Raoultella ornithinolytica | 1.00 |
| OTU_948 | SET 1 | 28446 | Firmicutes | Clostridia | Clostridiales | Lachnospiraceae | Tyzzerella | [Clostridium] propionicum | 1.00 |
| OTU_914 | SET 1 | 1121102 | Proteobacteria | Epsilonproteobacteria | Campylobacterales | Campylobacteraceae | Campylobacter | Campylobacter ureolyticus DSM 20703 | 1.00 |
| OTU_1342 | SET 1 | 69473 | Tenericutes | Mollicutes | Acholeplasmatales | Acholeplasmataceae | Acholeplasma | Acholeplasma vituli | 1.00 |
| OTU_2210 | SET 1 | 1298596 | Firmicutes | Clostridia | Clostridiales | Ruminococcaceae | Ruminococcus | Ruminococcus faecis JCM 15917 | 1.00 |
| OTU_1706 | SET 1 | 1007096 | Firmicutes | Clostridia | Clostridiales | Oscillospiraceae | Oscillibacter | Oscillibacter ruminantium GH1 | 1.00 |
| OTU_2656 | SET 1 | 105612 | Firmicutes | Bacilli | Lactobacillales | Lactobacillaceae | Lactobacillus | Lactobacillus algidus | 1.00 |
| OTU_909 | SET 1 | 1852367 | Firmicutes | Clostridia | Clostridiales | Clostridiales Family XIII, Incertae Sedis | Ihubacter | Ihubacter massiliensis | 1.00 |
| OTU_1964 | SET 1 | 1796615 | Firmicutes | Clostridia | Clostridiales | Lachnospiraceae | Blautia | Blautia caecimuris | 1.00 |
| OTU_1234 | SET 1 | 39492 | Firmicutes | Clostridia | Clostridiales | Ruminococcaceae | Ruminiclostridium | [Eubacterium] siraeum | 1.00 |
| OTU_501 | SET 1 | 682400 | Firmicutes | Clostridia | Clostridiales | unclassified. NA | Natranaerovirga | Natranaerovirga pectinivora | 1.00 |
| OTU_2939 | SET 1 | 820 | Bacteroidetes | Bacteroidia | Bacteroidales | Bacteroidaceae | Bacteroides | Bacteroides uniformis | 1.00 |
| OTU_556 | SET 1 | 39777 | Firmicutes | Negativicutes | Veillonellales | Veillonellaceae | Veillonella | Veillonella atypica | 0.63 |
| OTU_1093 | SET 1 | 1776382 | Firmicutes | Clostridia | Clostridiales | Ruminococcaceae | Neglecta | Neglecta timonensis | 0.50 |
| OTU_1198 | SET 1 | 1417852 | Firmicutes | Clostridia | Clostridiales | unclassified. NA | Flintibacter | Flintibacter butyricus | 1.00 |
| OTU_2650 | SET 1 | 56774 | Firmicutes | Clostridia | Clostridiales | Clostridiales Family XIII, Incertae Sedis | unclassified. NA | [Eubacterium] infirmum | 1.00 |
| OTU_1338 | SET 1 | 84026 | Firmicutes | Clostridia | Clostridiales | Ruminococcaceae | Ruminiclostridium | [Clostridium] methylpentosum | 1.00 |
| OTU_2434 | SET 1 | 1298596 | Firmicutes | Clostridia | Clostridiales | Ruminococcaceae | Ruminococcus | Ruminococcus faecis JCM 15917 | 1.00 |
| OTU_1197 | SET 1 | 29353 | Firmicutes | Clostridia | Clostridiales | Ruminococcaceae | Ruminiclostridium | [Clostridium] aldrichii | 1.00 |
| OTU_433 | SET 1 | 1579 | Firmicutes | Bacilli | Lactobacillales | Lactobacillaceae | Lactobacillus | Lactobacillus acidophilus | 1.00 |
| OTU_394 | SET 1 | 163665 | Bacteroidetes | Bacteroidia | Bacteroidales | Porphyromonadaceae | Dysgonomonas | Dysgonomonas mossii | 1.00 |
| OTU_2748 | SET 1 | 47246 | Firmicutes | Clostridia | Clostridiales | Ruminococcaceae | Ruminiclostridium | [Clostridium] viride | 1.00 |
| OTU_2251 | SET 1 | 53443 | Firmicutes | Clostridia | Clostridiales | Lachnospiraceae | Blautia | Blautia hydrogenotrophica | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1272 | SET 1 | 261299 | Firmicutes | Clostridia | Clostridiales | Peptostreptococcaceae | Intestinibacter | Intestinibacter bartlettii | 0.59 |
| OTU_1388 | SET 1 | 1302 | Firmicutes | Bacilli | Lactobacillales | Streptococcaceae | Streptococcus | Streptococcus gordonii | 1.00 |
| OTU_2677 | SET 1 | 1150298 | Firmicutes | Clostridia | Clostridiales | Lachnospiraceae | Fusicatenibacter | Fusicatenibacter saccharivorans | 1.00 |
| OTU_464 | SET 1 | 938289 | Firmicutes | Clostridia | Clostridiales | unclassified. NA | Levyella | Levyella massiliensis | 1.00 |
| OTU_1462 | SET 1 | 288966 | Firmicutes | Clostridia | Clostridiales | Clostridiaceae | Lutispora | Lutispora thermophila | 1.00 |
| OTU_1871 | SET 1 | 292800 | Firmicutes | Clostridia | Clostridiales | unclassified NA | Flavonifractor | Flavonifractor plautii | 1.00 |
| OTU_1649 | SET 1 | 288966 | Firmicutes | Clostridia | Clostridiales | Clostridiaceae | Lutispora | Lutispora thermophila | 1.00 |
| OTU_2063 | SET 1 | 328814 | Bacteroidetes | Bacteroidia | Bacteroidales | Rikenellaceae | Alistipes | Alistipes shahii | 1.00 |
| OTU_2525 | SET 1 | 169435 | Firmicutes | Clostridia | Clostridiales | Ruminococcaceae | Anaerotruncus | Anaerotruncus colihominis | 1.00 |
| OTU_2422 | SET 1 | 1852367 | Firmicutes | Clostridia | Clostridiales | Clostridiales Family XIII, Incertae Sedis | Ihubacter | Ihubacter massiliensis | 1.00 |
| OTU_1697 | SET 1 | 44749 | Firmicutes | Clostridia | Clostridiales | Ruminococcaceae | Sporobacter | Sporobacter termitidis | 1.00 |
| OTU_3061 | SET 1 | 53342 | Firmicutes | Clostridia | Clostridiales | Clostridiaceae | Caloramator | Caloramator proteoclasticus | 1.00 |
| OTU_2213 | SET 1 | 358742 | Firmicutes | Clostridia | Clostridiales | Lachnospiraceae | Lachnoclostridium | [Clostridium] aldenense | 1.00 |
| OTU_1302 | SET 1 | 48256 | Firmicutes | Clostridia | Clostridiales | Ruminococcaceae | Ruminiclostridium | [Clostridium] hungatei | 1.00 |
| OTU_811 | SET 1 | 55779 | Firmicutes | Clostridia | Thermoanaerobacterales | Thermoanaerobacteraceae | Moorella | Moorella glycerini | 0.55 |
| OTU_3114 | SET 1 | 762984 | Bacteroidetes | Bacteroidia | Bacteroidales | Bacteroidaceae | Bacteroides | Bacteroides clarus YIT 12056 | 1.00 |
| OTU_2828 | SET 1 | 471875 | Firmicutes | Clostridia | Clostridiales | Ruminococcaceae | Ruminococcus | Ruminococcus lactoris ATCC 29176 | 1.00 |
| OTU_2542 | SET 1 | 258515 | Firmicutes | Clostridia | Clostridiales | Ruminococcaceae | Acetanaerobacterium | Acetanaerobacterium elongatum | 1.00 |
| OTU_3143 | SET 1 | 53443 | Firmicutes | Clostridia | Clostridiales | Lachnospiraceae | Blautia | Blautia hydrogenotrophica | 1.00 |
| OTU_2311 | SET 1 | 817 | Bacteroidetes | Bacteroidia | Bacteroidales | Bacteroidaceae | Bacteroides | Bacteroides fragilis | 1.00 |
| OTU_1605 | SET 1 | 169435 | Firmicutes | Clostridia | Clostridiales | Ruminococcaceae | Anaerotruncus | Anaerotruncus colihominis | 1.00 |
| OTU_1881 | SET 1 | 214853 | Firmicutes | Clostridia | Clostridiales | Eubacteriaceae | Anaerofustis | Anaerofustis stercorihominis | 1.00 |
| OTU_1924 | SET 1 | 007096 | Firmicutes | Clostridia | Clostridiales | Oscillospiraceae | Oscillibacter | Oscillibacter ruminantium GH1 | 1.00 |
| OTU_2816 | SET 1 | 154046 | Firmicutes | Clostridia | Clostridiales | Clostridiaceae | Hungatella | Hungatella hathewayi | 1.00 |
| OTU_534 | SET 1 | 938278 | Firmicutes | Clostridia | Clostridiales | Clostridiales Family XIII, Incertae Sedis | Casaltella | Casaltella massiliensis | 1.00 |
| OTU_2825 | SET 1 | 1796613 | Bacteroidetes | Bacteroidia | Bacteroidales | Bacteroidaceae | Bacteroides | Bacteroides caecimuris | 0.68 |
| OTU_2142 | SET 1 | 341220 | Firmicutes | Clostridia | Clostridiales | Clostridiaceae | Lactonifactor | Lactonifactor longoviformis | 1.00 |
| OTU_1605 | SET 1 | 1841867 | Firmicutes | Clostridia | Clostridiales | Ruminococcaceae | Phocea | Phocea massiliensis | 1.00 |
| OTU_377 | SET 1 | 1118857 | Firmicutes | Tissierellia | Tissierellales | Peptoniphilaceae | Peptoniphilus | Peptoniphilus grossensis ph 5 | 0.50 |
| OTU_315 | SET 1 | 1077144 | Actinobacteria | Actinobacteria | Cory nebacteriales | Dietziaceae | Dietzia | Dietzia alimentaria 72 | 1.00 |
| OTU_2544 | SET 1 | 1737 | Firmicutes | Clostridia | Clostridiales | Peptostreptococcaceae | Paeniclostridium | [Eubacterium] tenue | 1.00 |
| OTU_2858 | SET 1 | 1121308 | Firmicutes | Clostridia | Clostridiales | Peptostreptococcaceae | Clostridioides | Clostridioides difficle ATCC 9689 - DSM 1296 | 1.00 |
| OTU_557 | SET 1 | 1796646 | Bacteroidetes | Bacteroidia | Bacteroidales | Porphyromonadaceae | Muribaculum | Muribaculum intestinale | 1.00 |
| OTU_1059 | SET 1 | 411467 | Firmicutes | Clostridia | Clostridiales | unclassified. NA | Pseudoflavonifactor | Pseudoflavonifractor capillosus ATCC 29799 | 1.00 |
| OTU_2020 | SET 1 | 218205 | Firmicutes | Clostridia | Clostridiales | Eubacteriaceae | Garciella | Garciella nitratireducens | 1.00 |
| OTU_931 | SET 1 | 1121298 | Firmicutes | Clostridia | Clostridiales | Clostridiaceae | Clostridium | Clostridium amylolyticum | 1.00 |
| OTU_1695 | SET 1 | 684066 | Bacilli | Bacilli | Lactobacillales | Streptococcaceae | Streptococcus | Streptococcus lactarius | 1.00 |
| OTU_1981 | SET 1 | 258515 | Firmicutes | Clostridia | Clostridiales | Ruminococcaceae | Acetanaerobacterium | Acetanaerobacterium elongatum | 1.00 |
| OTU_2600 | SET 1 | 649756 | Firmicutes | Clostridia | Clostridiales | Lachnospiraceae | Anaerostipes | Anaerostipes hadrus | 1.00 |
| OTU_1887 | SET 1 | 433659 | Actinobacteria | Actinobacteria | Propionibacteriales | Nocardiodaceae | Nocardioides | Nocardioides mesophilus | 1.00 |
| OTU_2058 | SET 1 | 52699 | Actinobacteria | Actinobacteria | Propionibacteriales | Nocardiodaceae | Aeromicrobium | Aeromicrobium fastidiosum | 1.00 |
| OTU_2235 | SET 1 | 204516 | Bacteroidetes | Bacteroidia | Bacteroidales | Bacteroidaceae | Bacteroides | Bacteroides massiliensis | 1.00 |
| OTU_1005 | SET 1 | 234908 | Proteobacteria | Betaproteobacteria | Burkholderiales | Sutterellaceae | Sutterella | Sutterella stercoricanis | 1.00 |
| OTU_1910 | SET 1 | 706562 | Firmicutes | Bacilli | Lactobacillales | Lactobacillaceae | Lactobacillus | Lactobacillus rogosae | 0.55 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_3085 | SET 1 | 253257 | Firmicutes | Clostridia | Clostridiales | Lachnospiraceae | Lachnoclostridium | [Clostridium] amygdalinum | 0.50 |
| OTU_1583 | SET 1 | 84026 | Firmicutes | Clostridia | Clostridiales | Ruminococcaceae | Ruminiclostridium | [Clostridium] methylpentosum | 1.00 |
| OTU_2308 | SET 1 | 39496 | Firmicutes | Clostridia | Clostridiales | Eubacteriaceae | Eubacterium | Eubacterium ventriosum | 1.00 |
| OTU_643 | SET 1 | 84026 | Firmicutes | Clostridia | Clostridiales | Ruminococcaceae | Ruminiclostridium | [Clostridium] methylpentosum | 0.65 |
| OTU_1191 | SET 1 | 115544 | Firmicutes | Clostridia | Clostridiales | Lachnospiraceae | Parasporobacterium | Parasporobacterium paucivorans | 1.00 |
| OTU_1997 | SET 1 | 84030 | Firmicutes | Clostridia | Clostridiales | Lachnospiraceae | Lachnoclostridium | [Clostridium] saccharolyticum | 1.00 |
| OTU_3166 | SET 1 | 706562 | Firmicutes | Bacilli | Lactobacillales | Lactobacillaceae | Lactobacillus | Lactobacillus rogosae | 0.68 |
| OTU_1406 | SET 1 | 501571 | Firmicutes | Clostridia | Clostridiales | Clostridiaceae | Butyricicoccus | Butyricicoccus pullicaecorum | 1.00 |
| OTU_3047 | SET 1 | 1509 | Firmicutes | Clostridia | Clostridiales | Clostridiaceae | Clostridium | Clostridium sporogenes | 1.00 |
| OTU_2916 | SET 1 | 328812 | Bacteroidetes | Bacteroidia | Bacteroidales | Porphyromonadaceae | Parabacteroides | Parabacteroides goldsteinii | 0.59 |
| OTU_276 | SET 1 | 1280 | Firmicutes | Bacilli | Bacillales | Staphylococcaceae | Staphylococcus | Staphylococcus aureus | 0.50 |
| OTU_2864 | SET 1 | 1121115 | Firmicutes | Clostridia | Clostridiales | Lachnospiraceae | Blautia | Blautia wexlerae DSM 19850 | 1.00 |
| OTU_3131 | SET 1 | 762984 | Bacteroidetes | Bacteroidia | Bacteroidales | Bacteroidaceae | Bacteroides | Bacteroides clarus YIT 12056 | 1.00 |
| OTU_414 | SET 1 | 147802 | Firmicutes | Bacilli | Lactobacillales | Lactobacillaceae | Lactobacillus | Lactobacillus iners | 1.00 |
| OTU_790 | SET 1 | 58134 | Firmicutes | Clostridia | Clostridiales | Lachnospiraceae | Lachnoclostridium | [Desulfotomaculum] guttoideum | 1.00 |
| OTU_891 | SET 1 | 1335613 | Actinobacteria | Coriobacteriia | Eggerthellales | Eggerthellaceae | Gordonibacter | Gordonibacter urolithinfaciens | 1.00 |
| OTU_2009 | SET 1 | 1531 | Firmicutes | Clostridia | Clostridiales | Lachnospiraceae | Lachnoclostridium | [Clostridium] clostridioforme | 0.63 |
| OTU_1870 | SET 1 | 745368 | Firmicutes | Clostridia | Clostridiales | Ruminococcaceae | Gemmiger | Gemmiger formicilis | 0.50 |
| OTU_1175 | SET 1 | 52786 | Firmicutes | Clostridia | Clostridiales | Ruminococcaceae | Anaerofilum | Anaerofilum agile | 1.00 |
| OTU_1395 | SET 1 | 328814 | Bacteroidetes | Bacteroidia | Bacteroidales | Rikenellaceae | Alistipes | Alistipes shahii | 0.63 |
| OTU_1236 | SET 1 | 891 | Proteobacteria | Deltaproteobacteria | Desulfuromonadales | Desulfuromonadaceae | Desulfuromonas | Desulfuromonas acetoxidans | 1.00 |
| OTU_2197 | SET 1 | 585394 | Firmicutes | Clostridia | Clostridiales | Lachnospiraceae | Roseburia | Roseburia hominis A2-183 | 1.00 |
| OTU_487 | SET 1 | 1582 | Firmicutes | Bacilli | Lactobacillales | Lactobacillaceae | Lactobacillus | Lactobacillus casei | 1.00 |
| OTU_964 | SET 1 | 235931 | Firmicutes | Clostridia | Clostridiales | Eubacteriaceae | Alkalibacter | Alkalibacter saccharofermentans | 1.00 |
| OTU_3184 | SET 1 | 308994 | Firmicutes | Negativicutes | Veillonellales | Veillonellaceae | Dialister | Dialister propionicifaciens | 1.00 |
| OTU_226 | SET 1 | 29466 | Firmicutes | Negativicutes | Veillonellales | Veillonellaceae | Veillonella | Veillonella parvula | 1.00 |
| OTU_1037 | SET 1 | 1589 | Firmicutes | Bacilli | Lactobacillales | Lactobacillaceae | Lactobacillus | Lactobacillus pentosus | 1.00 |
| OTU_1021 | SET 1 | 626937 | Firmicutes | Clostridia | Clostridiales | Christensenellaceae | Christensenella | Christensenella minuta | 1.00 |
| OTU_1288 | SET 1 | 264463 | Firmicutes | Clostridia | Clostridiales | Lachnospiraceae | Anaerosporobacter | Anaerosporobacter mobilis | 1.00 |
| OTU_2276 | SET 1 | 1682 | Actinobacteria | Actinobacteria | Bifidobacteriales | Bifidobacteriaceae | Bifidobacterium | Bifidobacterium longum subsp. infantis | 1.00 |
| OTU_695 | SET 1 | 1736 | Firmicutes | Clostridia | Clostridiales | Eubacteriaceae | Eubactecium | Eubactecium limosum | 1.00 |
| OTU_111 | SET 1 | 28129 | Bacteroidetes | Bacteroidia | Bacteroidales | Prevotellaceae | Prevotella | Prevotella denticola | 1.00 |
| OTU_1899 | SET 1 | 301302 | Firmicutes | Clostridia | Clostridiales | Lachnospiraceae | Roseburia | Roseburia faecis | 1.00 |
| OTU_2162 | SET 1 | 160404 | Firmicutes | Clostridia | Clostridiales | Lachnospiraceae | Tyzzerella | [Clostridium] lactatifermentans | 1.00 |
| OTU_1053 | SET 1 | 178001 | Firmicutes | Bacilli | Lactobacillales | Leuconostocaceae | Leuconostoc | Leuconostoc inhae | 1.00 |
| OTU_2698 | SET 1 | 29375 | Firmicutes | Clostridia | Clostridiales | Lachnospiraceae | Lachnoclostridium | [Clostridium] xylanolyticum | 1.00 |
| OTU_934 | SET 1 | 1509 | Firmicutes | Clostridia | Clostridiales | Clostridiaceae | Clostridium | Clostridium sporogenes | 1.00 |
| OTU_1194 | SET 1 | 551788 | Firmicutes | Clostridia | Clostridiales | Caldicoprobacteraceae | Caldicoprobacter | Caldicoprobacter oshimai | 1.00 |
| OTU_1580 | SET 1 | 84026 | Firmicutes | Clostridia | Clostridiales | Ruminococcaceae | Ruminiclostridium | [Clostridium] methylpentosum | 1.00 |
| OTU_645 | SET 1 | 2051 | Actinobacteria | Actinobacteria | Actinomycetales | Actinomycetaceae | Mobiluncus | Mobiluncus curtisii | 1.00 |
| OTU_1319 | SET 1 | 856 | Fusobacteria | Fusobacteriia | Fusobacteriales | Fusobacteriaceae | Fusobacterium | Fusobacterium varium | 1.00 |
| OTU_1738 | SET 1 | 118562 | Cyanobacteria | unclassified. NA | Oscillatoriales | Microcoleaceae | Arthrospira | Arthrospira platensis | 1.00 |
| OTU_2168 | SET 1 | 214856 | Bacteroidetes | Bacteroidia | Bacteroidales | Rikenellaceae | Alistipes | Alistipes finegoldii | 1.00 |
| OTU_1503 | SET 1 | 1302 | Firmicutes | Bacilli | Lactobacillales | Streptococcaceae | Streptococcus | Streptococcus gordonii | 1.00 |
| OTU_1185 | SET 1 | 292800 | Firmicutes | Clostridia | Clostridiales | unclassified. NA | Flavonifractor | Flavonifractor plautii | 1.00 |
| OTU_2365 | SET 1 | 101070 | Firmicutes | Bacilli | Bacillales | Planococcaceae | Rummeliibacillus | Rummeliibacillus pycnus | 1.00 |
| OTU_1822 | SET 1 | 515619 | Firmicutes | Clostridia | Clostridiales | Lachnospiraceae | Myxococcus | [Eubacterium rectale] ATCC 33656 | 0.55 |
| OTU_463 | SET 1 | 40215 | Proteobacteria | Gammaproteobacteria | Pseudomonadales | Moraxellaceae | Acinetobacter | Acinetobacter junii | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_3029 | SET 1 | 745368 | Firmicutes | Clostridia | Clostridiales | Ruminococcaceae | Gemmiger | Gemmiger formicilis | 1.00 |
| OTU_2649 | SET 1 | 187979 | Negativicutes | Negativicutes | Selenomonadales | Selenomonadaceae | Mitsuokella | Mitsuokella jalaludinii | 1.00 |
| OTU_2666 | SET 1 | 82979 | Proteobacteria | Gammaproteobacteria | Enterobacterales | Budviciaceae | Budvicia | Budvicia aquatica | 1.00 |
| OTU_2895 | SET 1 | 154046 | Firmicutes | Clostridia | Clostridiales | Clostridiaceae | Hungatella | Hungatella hathewayi | 1.00 |
| OTU_3020 | SET 1 | 29363 | Firmicutes | Clostridia | Clostridiales | Clostridiaceae | Clostridium | [Clostridium] lactatifermentans | 1.00 |
| OTU_3163 | SET 1 | 160404 | Firmicutes | Clostridia | Clostridiales | Lachnospiraceae | Tyzzerella | [Clostridium] paraputrificum | 1.00 |
| OTU_1357 | SET 1 | 1776391 | Firmicutes | Clostridia | Clostridiales | Peptostreptococcaceae | Romboutsia | Romboutsia timonensis | 1.00 |
| OTU_1550 | SET 1 | 1285191 | Firmicutes | Clostridia | Clostridiales | Peptococcaceae | Desulfotomaculum | Desulfotomaculum intricatum | 1.00 |
| OTU_2275 | SET 1 | 84112 | Actinobacteria | Coriobacteriia | Eggerthellales | Eggerthellaceae | Eggerthella | Eggerthella lenta | 1.00 |
| OTU_1828 | SET 1 | 46503 | Bacteroidetes | Bacteroidia | Bacteroidales | Porphyromonadaceae | Parabacteroides | Parabacteroides merdae | 1.00 |
| OTU_1647 | SET 1 | 157688 | Fusobacteria | Fusobacteriia | Fusobacteriales | Leptotrichiaceae | Leptotrichia | Leptotrichia hofstadii | 1.00 |
| OTU_425 | SET 1 | 38304 | Actinobacteria | Actinobacteria | Corynebacteriales | Corynebacteriaceae | Corynebacterium | Corynebacterium tuberculostearicum | 1.00 |
| OTU_3121 | SET 1 | 109624 | Firmicutes | Clostridia | Clostridiales | Clostridiaceae | Hungatella | Hungatella effluvii | 1.00 |
| OTU_2982 | SET 1 | 105841 | Firmicutes | Clostridia | Clostridiales | Lachnospiraceae | Anaerostipes | Anaerostipes caccae | 1.00 |
| OTU_2929 | SET 1 | 292800 | Firmicutes | Clostridia | Clostridiales | unclassified. NA | Flavonifractor | Flavonifractor plautii | 1.00 |
| OTU_2019 | SET 1 | 1515 | Firmicutes | Clostridia | Clostridiales | Ruminococcaceae | Ruminiclostridium | Ruminiclostridium thermocellum | 1.00 |
| OTU_508 | SET 1 | 1417852 | Firmicutes | Clostridia | Clostridiales | unclassified. NA | Flintibacter | Flintibacter butyricus | 1.00 |
| OTU_1664 | SET 1 | 1852367 | Firmicutes | Clostridia | Clostridiales | Clostridiales Family XIII. Incertae Sedis | Ihubacter | Ihubacter massiliensis | 1.00 |
| OTU_1854 | SET 1 | 259063 | Firmicutes | Clostridia | Clostridiales | Lacinospiraceae | Anaerocolumna | Anaerocolumna jejuensis | 1.00 |
| OTU_2847 | SET 1 | 36850 | Firmicutes | Clostridia | Clostridiales | Clostridiaceae | Clostridium | Clostridium quinii | 1.00 |
| OTU_3191 | SET 1 | 341694 | Firmicutes | Clostridia | Clostridiales | Peptostreptococcaceae | Peptostreptococcus | Peptostreptococcus stomatis | 1.00 |
| OTU_3208 | SET 1 | 287 | Proteobacteria | Gammaproteobacteria | Pseudomonadales | Pseudomonadaceae | Pseudomonas | Pseudomonas aeruginosa | 1.00 |
| OTU_2253 | SET 1 | 75612 | Proteobacteria | Gammaproteobacteria | Pseudomonadales | Pseudomonadaceae | Pseudomonas | Pseudomonas mandelii | 1.00 |
| OTU_2511 | SET 1 | 901 | Proteobacteria | Deltaproteobacteria | Desulfovibrionales | Desulfovibrionaceae | Desulfovibrio | Desulfovibrio piger | 1.00 |
| OTU_2002 | SET 1 | 1417852 | Firmicutes | Clostridia | Clostridiales | unclassified. NA | Flintibacter | Flintibacter butyricus | 1.00 |
| OTU_2524 | SET 1 | 818 | Bacteroidetes | Bacteroidia | Bacteroidales | Bacteroidaceae | Bacteroides | Bacteroides thetaiotaomicron | 1.00 |
| OTU_2530 | SET 1 | 371674 | Firmicutes | Clostridia | Clostridiales | Lachnospiraceae | Moryella | Moryella indoligenes | 1.00 |
| OTU_2536 | SET 1 | 338188 | Bacteroidetes | Bacteroidia | Bacteroidales | Bacteroidaceae | Bacteroides | Bacteroides finegoldii | 1.00 |
| OTU_2608 | SET 1 | 69825 | Firmicutes | Clostridia | Clostridiales | Lachnospiraceae | Lachnoclostridium | [Clostridium] indolis | 1.00 |
| OTU_568 | SET 1 | 88164 | Firmicutes | Bacilli | Lactobacillales | Lactobacillaceae | Lactobacillus | Lactobacillus fornicalis | 1.00 |
| OTU_2872 | SET 1 | 1121115 | Firmicutes | Clostridia | Clostridiales | Lachnospiraceae | Blautia | Blautia wexlerae DSM 19850 | 1.00 |
| OTU_816 | SET 1 | 588581 | Firmicutes | Clostridia | Clostridiales | Ruminococcaceae | Ruminiclostridium | [Clostridium] papyrosolvens DSM 2782 | 1.00 |
| OTU_1060 | SET 1 | 351091 | Firmicutes | Clostridia | Clostridiales | Oscillospiraceae | Oscillibacter | Oscillibacter valericigenes | 1.00 |
| OTU_1193 | SET 1 | 676965 | Firmicutes | Clostridia | Thermoanaerobacterales | Thermoanaerobacteraceae | Moorella | Moorella humiferrea | 1.00 |
| OTU_1639 | SET 1 | 358742 | Firmicutes | Clostridia | Clostridiales | Lachnospiraceae | Lachnoclostridium | [Clostridium] aldenense | 1.00 |
| OTU_1727 | SET 1 | 84026 | Firmicutes | Clostridia | Clostridiales | Ruminococcaceae | Ruminiclostridium | [Clostridium] methylpentosum | 1.00 |
| OTU_221 | SET 1 | 546271 | Firmicutes | Negativicutes | Selenomonadales | Selenomonadaceae | Selenomonas | Selenomonas sputigena ATCC 35185 | 1.00 |
| OTU_2468 | SET 1 | 1515 | Firmicutes | Clostridia | Clostridiales | Ruminococcaceae | Ruminiclostridium | Ruminiclostridium thermocellum | 1.00 |
| OTU_3057 | SET 1 | 47246 | Firmicutes | Clostridia | Clostridiales | Ruminococcaceae | Ruminiclostridium | [Clostridium] viride | 1.00 |
| OTU_3093 | SET 1 | 1236512 | Bacteroidetes | Bacteroidia | Bacteroidales | Bacteroidaceae | Bacteroides | Bacteroides rodentium JCM 16496 | 1.00 |
| OTU_3098 | SET 1 | 40518 | Firmicutes | Clostridia | Clostridiales | Ruminococcaceae | Ruminococcus | Ruminococcus bromii | 1.00 |
| OTU_732 | SET 1 | 1318465 | Tenericutes | Mollicutes | Acholeplasmatales | Acholeplasmataceae | Acholeplasma | Acholeplasma brassicae 0502 | 1.00 |
| OTU_837 | SET 1 | 178338 | Firmicutes | Tissierellia | unclassified. NA | unclassified. NA | Sedimentibacter | Sedimentibacter hongkongensis | 1.00 |
| OTU_871 | SET 1 | 154046 | Firmicutes | Clostridia | Clostridiales | Clostridiaceae | Hungatella | Hungatella hathewayi | 1.00 |
| OTU_923 | SET 1 | 328813 | Bacteroidetes | Bacteroidia | Bacteroidales | Rikenellaceae | Alistipes | Alistipes onderdonkii | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_991 | SET 1 | 264463 | Firmicutes | Clostridia | Clostridiales | Lachnospiraceae | Anaerosporobacter | Anaerosporobacter mobilis | 1.00 |
| OTU_768 | SET 1 | 862517 | Firmicutes | Tissierellia | Tissierellales | Peptoniphilaceae | Peptoniphilus | Peptoniphilus duerdenii ATCC BAA-1640 | 1.00 |
| OTU_1251 | SET 1 | 157687 | Fusobacteria | Fusobacteriia | Fusobacteriales | Leptotrichiaceae | Leptotrichia | Leptotrichia wadei | 1.00 |
| OTU_160 | SET 1 | 158 | Spitochaetes | Spirochaetia | Spirochaetales | Spirochaetaceae | Treponema | Treponema denticola | 1.00 |
| OTU_1633 | SET 1 | 1841867 | Firmicutes | Clostridia | Clostridiales | Ruminococcaceae | Phocea | Phocea massiliensis | 1.00 |
| OTU_2294 | SET 1 | 29466 | Firmicutes | Negativicutes | Veillonellales | Veillonellaceae | Veillonella | Veillonella parvula | 1.00 |
| OTU_2993 | SET 1 | 84026 | Firmicutes | Clostridia | Clostridiales | Ruminococcaceae | Ruminiclostridium | [Clostridium] methylpentosum | 1.00 |
| OTU_926 | SET 1 | 51048 | Proteobacteria | Gammaproteobacteria | Pasteurellales | Pasteurellaceae | Actinobacillus | Actinobacillus porcinus | 1.00 |
| OTU_16 | SET 1 | 1583331 | Bacteroidetes | Bacteroidia | Bacteroidales | Porphyromonadaceae | Porphyromonas | Porphyromonas pasteri | 1.00 |
| OTU_1170 | SET 1 | 411467 | Firmicutes | Clostridia | Clostridiales | unclassified. NA | Pseudoflavonifractor | Pseudoflavonifractor capillosus ATCC 29799 | 1.00 |
| OTU_1566 | SET 1 | 169435 | Firmicutes | Clostridia | Clostridiales | Ruminococcaceae | Anaerotruncus | Anaerotruncus colihominis | 1.00 |
| OTU_863 | SET 1 | 529 | Proteobacteria | Alphaproteobacteria | Rhizobiales | Brucellaceae | Ochrobactrum | Ochrobactrum anthropi | 1.00 |
| OTU_3206 | SET 1 | 1349822 | Bacteroidetes | Bacteroidia | Bacteroidales | Porphyromonadaceae | Coprobacter | Coprobacter fastidiosus NSB1 | 1.00 |
| OTU_1518 | SET 1 | 288966 | Firmicutes | Clostridia | Clostridiales | Clostridiaceae | Lutispora | Lutispora thermophila | 1.00 |
| OTU_1678 | SET 1 | 901 | Proteobacteria | Deltaproteobacteria | Desulfovibrionales | Desulfovibrionaceae | Desulfovibrio | Desulfovibrio piger | 1.00 |
| OTU_2086 | SET 1 | 290052 | Firmicutes | Clostridia | Clostridiales | Ruminococcaceae | Acetivibrio | Acetivibrio ethanolgignens | 1.00 |
| OTU_2560 | SET 1 | 1535 | Firmicutes | Clostridia | Clostridiales | Ruminococcaceae | Ruminiclostridium | [Clostridium] leptum | 1.00 |
| OTU_2976 | SET 1 | 516633 | Firmicutes | Clostridia | Clostridiales | Lachnospiraceae | Blautia | Blautia glucerasea | 1.00 |
| OTU_3190 | SET 1 | 706562 | Firmicutes | Bacilli | Lactobacillales | Lactobacillaceae | Lactobacillus | Lactobacillus rogosae | 1.00 |
| OTU_3195 | SET 1 | 820 | Bacteroidetes | Bacteroidia | Bacteroidales | Bacteroidaceae | Bacteroides | Bacteroides uniformis | 1.00 |
| OTU_625 | SET 1 | 888745 | Firmicutes | Bacilli | Lactobacillales | Streptococcaceae | Streptococcus | Streptococcus agalactiae ATCC 13813 | 1.00 |
| OTU_1063 | SET 1 | 214851 | Firmicutes | Clostridia | Clostridiales | Ruminococcaceae | Subdoligranulum | Subdoligranulum variabile | 1.00 |
| OTU_1865 | SET 1 | 626937 | Firmicutes | Clostridia | Clostridiales | Christensenellaceae | Christensenella | Christensenella minuta | 1.00 |
| OTU_1926 | SET 1 | 1732 | Firmicutes | Clostridia | Clostridiales | Eubacteriaceae | Eubacterium | Eubacterium oxidoreducens | 1.00 |
| OTU_3050 | SET 1 | 100176 | Firmicutes | Clostridia | Clostridiales | Ruminococcaceae | Papillibacter | Papillibacter cinnamivorans | 1.00 |
| OTU_993 | SET 1 | 308994 | Firmicutes | Negativicutes | Veillonellales | Veillonellaceae | Dialister | Dialister propionicifaciens | 1.00 |
| OTU_2923 | SET 1 | 89014 | Firmicutes | Clostridia | Clostridiales | Lachnospiraceae | Blautia | Blautia luti | 0.59 |
| OTU_3040 | SET 1 | 357276 | Bacteroidetes | Bacteroidia | Bacteroidales | Bacteroidaceae | Bacteroides | Bacteroides dorei | 0.55 |
| OTU_2300 | SET 1 | 169435 | Firmicutes | Clostridia | Clostridiales | Ruminococcaceae | Anaerotruncus | Anaerotruncus colihominis | 1.00 |
| OTU_940 | SET 1 | 394340 | Actinobacteria | Coriobacteriia | Eggerthellales | Eggerthellaceae | Asaccharobacter | Asaccharobacter celatus | 0.55 |
| OTU_1116 | SET 1 | 40545 | Proteobacteria | Betaproteobacteria | Burkholderiales | Sutterellaceae | Sutterella | Sutterella wadsworthensis | 1.00 |
| OTU_1442 | SET 1 | 1841867 | Firmicutes | Clostridia | Clostridiales | Ruminococcaceae | Phocea | Phocea massiliensis | 1.00 |
| OTU_1656 | SET 1 | 855 | Fusobacteria | Fusobacteriia | Fusobacteriales | Fusobacteriaceae | Fusobacterium | Fusobacterium simiae | 1.00 |
| OTU_2376 | SET 1 | 357276 | Bacteroidetes | Bacteroidia | Bacteroidales | Bacteroidaceae | Bacteroides | Bacteroides dorei | 1.00 |
| OTU_2538 | SET 1 | 515619 | Firmicutes | Clostridia | Clostridiales | Lachnospiraceae | Myxococcus | Myxococcus dorei | 1.00 |
| OTU_2602 | SET 1 | 1619234 | Firmicutes | Clostridia | Clostridiales | Lachnospiraceae | Anaerobium | Anaerobium acetethylicum | 1.00 |
| OTU_2603 | SET 1 | 553973 | Firmicutes | Clostridia | Clostridiales | Lachnospiraceae | Lachnoclostridium | [Clostridium] hylemonae DSM 15053 | 1.00 |
| OTU_2604 | SET 1 | 21810 | Firmicutes | Clostridia | Clostridiales | Ruminococcaceae | Ruminococcus | Ruminococcus champanellensis 18P13 = JCM 17042 | 1.00 |
| OTU_1658 | SET 1 | 253257 | Firmicutes | Clostridia | Clostridiales | Lachnospiraceae | Lachnoclostridium | [Clostridium] amygdalinum | 1.00 |
| OTU_1188 | SET 1 | 938293 | Firmicutes | Tissierellia | Tissierellales | Peptoniphilaceae | Anaerococcus | Anaerococcus provenciensis | 1.00 |
| OTU_1374 | SET 1 | 93063 | Proteobacteria | Alphaproteobacteria | Sphingomonadales | Sphingomonadaceae | Sphingomonas | Sphingomonas aquatilis | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_1558 | SET 1 | 1796646 | Bacteroidetes | Bacteroidia | Bacteroidales | Porphyromonadaceae | Muribaculum | Muribaculum intestinale | 1.00 |
| OTU_2232 | SET 1 | 708634 | Proteobacteria | Betaproteobacteria | Burkholderiales | unclassified. NA | Aquabacterium | Aquabacterium limnoticum | 1.00 |
| OTU_2563 | SET 1 | 179995 | Proteobacteria | Gammaproteobacteria | Aeromonadales | Succinivibrionaceae | Anaerobiospirillum | Anaerobiospirillum thomasii | 1.00 |
| OTU_745 | SET 1 | 35519 | Firmicutes | Clostridia | Clostridiales | Clostridiales Family XIII. Incertae Sedis | Mogibacterium | Mogibacterium timidum | 1.00 |
| OTU_1506 | SET 1 | 1351 | Firmicutes | Bacilli | Lactobacillales | Enterococcaceae | Enterococcus | Enterococcus faecalis | 1.00 |
| OTU_1114 | SET 1 | 476652 | Firmicutes | Clostridia | Clostridiales | Peptococcaceae | Desulfosporosinus | Desulfosporosinus acididurans | 1.00 |
| OTU_2029 | SET 1 | 141785 | Firmicutes | Clostridia | Clostridiales | unclassified. NA | Flintibacter | Flintibacter butyricus | 1.00 |
| OTU_439 | SET 1 | 1464038 | Firmicutes | Tisserella | unclassified. NA | unclassified. NA | Ezakiella | Ezakiella peruensis | 1.00 |
| OTU_1638 | SET 1 | 555088 | Firmicutes | Clostridia | Clostridiales | Syntrophomonadaceae | Dethiobacter | Dethiobacter alkaliphilus AHT 1 | 1.00 |
| OTU_1740 | SET 1 | 44749 | Firmicutes | Clostridia | Clostridiales | Ruminococcaceae | Sporobacter | Sporobacter termitidis | 1.00 |
| OTU_1725 | SET 1 | 1841867 | Firmicutes | Clostridia | Clostridiales | Ruminococcaceae | Phocea | Phocea massiliensis | 1.00 |
| OTU_2319 | SET 1 | 166486 | Firmicutes | Clostridia | Clostridiales | Lachnospiraceae | Roseburia | Roseburia intestinalis | 1.00 |
| OTU_2322 | SET 1 | 237576 | Firmicutes | Clostridia | Clostridiales | Ruminococcaceae | Oribacterium | Oribacterium sinus | 1.00 |
| OTU_1301 | SET 1 | 1776263 | Firmicutes | Clostridia | Clostridiales | Lachnospiraceae | Neglecta | Neglecta timonensis | 1.00 |
| OTU_1328 | SET 1 | 358742 | Firmicutes | Clostridia | Clostridiales | Lachnospiraceae | Lachnoclostridium | [Clostridium] aldenense | 1.00 |
| OTU_1579 | SET 1 | 1515 | Firmicutes | Clostridia | Clostridiales | Ruminococcaceae | Ruminiclostridium | Ruminiclostridium thermocellum | 1.00 |
| OTU_1889 | SET 1 | 879566 | Firmicutes | Clostridia | Clostridiales | Lachnospiraceae | Acetatifactor | Acetatifactor muris | 1.00 |
| OTU_2460 | SET 1 | 1852371 | Actinobacteria | Coriobacteriia | Eggerthellales | Eggerthellaceae | Raoultibacter | Raoultibacter massiliensis | 1.00 |
| OTU_830 | SET 1 | 404403 | Firmicutes | Clostridia | Clostridiales | unclassified. NA | Howardella | Howardella ureilytica | 1.00 |
| OTU_1173 | SET 1 | 1852367 | Firmicutes | Clostridia | Clostridiales | Clostridiales Family XIII. Incertae Sedis | Ihubacter | Ihubacter massiliensis | 1.00 |
| OTU_2007 | SET 1 | 253314 | Firmicutes | Clostridia | Clostridiales | Ruminococcaceae | Ruminiclostridium | [Clostridium] straminisolvens | 1.00 |
| OTU_1836 | SET 1 | 328814 | Bacteroidetes | Bacteroidia | Bacteroidales | Rikenellaceae | Alistipes | Alistipes shahii | 1.00 |
| OTU_2353 | SET 1 | 742727 | Bacteroidetes | Bacteroidia | Bacteroidales | Bacteroidaceae | Bacteroides | Bacteroides oleiciplenus YIT 12058 | 0.50 |
| OTU_1178 | SET 1 | 253314 | Firmicutes | Clostridia | Clostridiales | Ruminococcaceae | Ruminiclostridium | [Clostridium] straminisolvens | 1.00 |
| OTU_1463 | SET 1 | 626937 | Firmicutes | Clostridia | Clostridiales | Christensenellaceae | Christensenella | Christensenella minuta | 1.00 |
| OTU_1977 | SET 1 | 1377 | Firmicutes | Bacilli | Lactobacillales | Aerococcaceae | Aerococcus | Aerococcus viridans | 1.00 |
| OTU_2610 | SET 1 | 588581 | Firmicutes | Clostridia | Clostridiales | Ruminococcaceae | Ruminiclostridium | [Clostridium] papyrosolvens DSM 2782 | 1.00 |
| OTU_2611 | SET 1 | 1531 | Firmicutes | Clostridia | Clostridiales | Lachnospiraceae | Lachnoclostridium | [Clostridium] clostridioforme | 1.00 |
| OTU_2612 | SET 1 | 35830 | Firmicutes | Clostridia | Clostridiales | Ruminococcaceae | Acetivibrio | Acetivibrio cellulolyticus | 1.00 |
| OTU_2615 | SET 1 | 84026 | Firmicutes | Clostridia | Clostridiales | Ruminococcaceae | Ruminiclostridium | [Clostridium] methylpentosum | 1.00 |
| OTU_2619 | SET 1 | 100176 | Firmicutes | Clostridia | elostridiales | Ruminococcaceae | Papillibacter | Papillibacter cinnamivorans | 1.00 |
| OTU_2799 | SET 1 | 626947 | Proteobacteria | Betaproteobacteria | Burkholderiales | Sutterellaceae | Parasutterella | Parasutterella secunda | 1.00 |
| OTU_3001 | SET 1 | 1298596 | Firmicutes | Clostridia | Clostridiales | Ruminococcaceae | Ruminococcus | Ruminococcus faecis JCM 15917 | 1.00 |
| OTU_3036 | SET 1 | 438033 | Firmicutes | Clostridia | Clostridiales | Ruminococcaceae | Ruminococcus | Ruminococcus gauvreauii | 1.00 |
| OTU_726 | SET 1 | 1732 | Firmicutes | Bacteroidia | Bacteroidales | Eubacteriaceae | Eubacterium | Eubacterium oxidoreducens | 1.00 |
| OTU_138 | SET 1 | 997353 | Bacteroidetes | Bacteroidia | Bacteroidales | Prevotellaceae | Prevotella | Prevotella pallens AICC 700821 | 1.00 |
| OTU_1325 | SET 1 | 1432052 | Firmicutes | Clostridia | Clostridiales | Lachnospiraceae | Eisenbergiella | Eisenbergiella tayi | 1.00 |
| OTU_1561 | SET 1 | 649756 | Firmicutes | Clostridia | Clostridiales | Lachnospiraceae | Anaerostipes | Anaerostipes hadrus | 1.00 |
| OTU_512 | SET 1 | 33043 | Firmicutes | Clostridia | Clostridiales | Lachnospiraceae | Coprococcus | Coprococcus eutactus | 1.00 |
| OTU_2968 | SET 1 | 218538 | Firmicutes | Negativicutes | Veillonellales | Veillonellaceae | Dialister | Dialister invisus | 0.50 |
| OTU_1308 | SET 1 | 214856 | Bacteroidetes | Bacteroidia | Bacteroidales | Rikenellaceae | Alistipes | Alistipes finegoldii | 1.00 |
| OTU_1057 | SET 1 | 83771 | Proteobacteria | Gammaproteobacteria | Aeromonadales | Succinivibrionaceae | Succinivibrio | Succinivibrio dextrinosolvens | 1.00 |

TABLE 1-continued

| OTUs | Set | TAX_id | Phylum | Class | Order | Family | Genus | Species | $e_i$ |
|---|---|---|---|---|---|---|---|---|---|
| OTU_1547 | SET 1 | 671218 | Bacteroidetes | Bacteroidia | Bacteroidales | Prevotellaceae | Alloprevotella | Alloprevotella rava | 1.00 |
| OTU_2298 | SET 1 | 1605 | Firmicutes | Bacilli | Lactobacillales | Lactobacillaceae | Lactobacillus | Lactobacillus animalis | 1.00 |
| OTU_2915 | SET 1 | 28111 | Bacteroidetes | Bacteroidia | Bacteroidales | Bacteroidaceae | Bacteroides | Bacteroides eggerthii | 1.00 |
| OTU_461 | SET 1 | 131109 | Actinobacteria | Actinobacteria | Actinomycetales | Actinomycetaceae | Actinomyces | Actinomyces bowdenii | 1.00 |
| OTU_959 | SET 1 | 1302 | Finctilcut | Bacilli | Lactobacillales | Streptococcaceae | Streptococcus | Streptococcus gordonii | 1.00 |
| OTU_2069 | SET 1 | 46609 | Firmicutes | Clostridia | Clostridiales | Clostridiaceae | Clostridium | Clostridium pascui | 1.00 |
| OTU_3092 | SET 1 | 1297617 | Firmicutes | Clostridia | Clostridiales | unclassified. NA | Intestinimonas | Intestinimonas butyriciproducens | 1.00 |
| OTU_1371 | SET 1 | 690567 | Firmicutes | Clostridia | Clostridiales | Syntrophomonadaceae | Syntrophomonas | Syntrophomonas zehnderi OL-4 | 1.00 |
| OTU_2008 | SET 1 | 46206 | Firmicutes | Clostridia | Clostridiales | Lachnospiraceae | Pseudobutyrivibrio | Pseudobutyrivibrio ruminis | 1.00 |
| OTU_874 | SET 1 | 155615 | Fusobacteria | Fusobacteriia | Fusobacteriales | Fusobacteriaceae | Fusobacterium | Fusobacterium nucleatum subsp. vincentii | 0.50 |
| OTU_1382 | SET 1 | 333367 | Firmicutes | Clostridia | Clostridiales | Lachnospiraceae | Lachnoclostridium | [Clostridium] asparagiforme | 1.00 |
| OTU_2065 | SET 1 | 84026 | Firmicutes | Clostridia | Clostridiales | Ruminococcaceae | Ruminiclostridium | [Clostridium] methylpentosum | 1.00 |
| OTU_1569 | SET 1 | 51616 | Firmicutes | Clostridia | Clostridiales | Peptococcaceae | Desulfitobacterium | Desulfitobacterium chlororespireans | 1.00 |
| OTU_2838 | SET 1 | 1298596 | Firmicutes | Clostridia | Clostridiales | Ruminococcaceae | Ruminococcus | Ruminococcus faecis JCM 15917 | 0.50 |
| OTU_1890 | SET 1 | 1796620 | Firmicutes | Clostridia | Clostridiales | Ruminococcaceae | Acutalibacter | Acutalibacter muris | 1.00 |
| OTU_112 | SET 1 | 40542 | Fusobacteria | Fusobacteriia | Fusobacteriales | Leptotrichiaceae | Leptotrichia | Leptotrichia buccalis | 1.00 |
| OTU_2136 | SET 1 | 396504 | Firmicutes | Clostridia | Clostridiales | Ruminococcaceae | Ruminiclostridium | [Clostridium] sufflavum | 1.00 |
| OTU_1280 | SET 1 | 169435 | Firmicutes | Clostridia | Clostridiales | Ruminococcaceae | Anaerotruncus | Anaerotruncus colihominis | 1.00 |
| OTU_88 | SET 1 | 203 | Proteobacteria | Epsilonproteobacteria | Campylobacterales | Campylobacteraceae | Campylobacter | Campylobacter rectus | 1.00 |
| OTU_3193 | SET 1 | 328814 | Bacteroidetes | Bacteroidia | Bacteroidales | Rikenellaceae | Alistipes | Alistipes shahii | 1.00 |
| OTU_810 | SET 1 | 294 | Proteobacteria | Gammaproteobacteria | Pseudomonadales | Pseudomonadaceae | Pseudomonas | Pseudomonas fluorescens | 1.00 |
| OTU_2803 | SET 1 | 411467 | Firmicutes | Clostridia | Clostridiales | unclassified. NA | Pseudoflavonifractor | Pseudoflavonifractor capillosus ATCC 29799 | 1.00 |
| OTU_2813 | SET 1 | 1605 | Firmicutes | Bacilli | Lactobacillales | Lactobacillaceae | Lactobacillus | Lactobacillus animalis | 1.00 |
| OTU_3096 | SET 1 | 169435 | Firmicutes | Clostridia | Clostridiales | Ruminococcaceae | Anaerotruncus | Anaerotruncus colihominis | 1.00 |
| OTU_2955 | SET 1 | 1034346 | Firmicutes | Erysipelotrichales | Erysipelotrichales | Erysipelotrichaceae | Dielma | Dielma fastidiosa | 1.00 |
| OTU_395 | SET 1 | 156456 | Firmicutes | Negativicutes | Veillonellales | Veillonellaceae | Anaeroglobus | Anaeroglobus geminatus | 1.00 |
| OTU_3097 | SET 1 | 169435 | Firmicutes | Clostridia | Clostridiales | Ruminococcaceae | Anaerotruncus | Anaerotruncus colihominis | 1.00 |
| OTU_819 | SET 1 | 80866 | Proteobacteria | Betaproteobacteria | Burkholderiales | Conamonadaceae | Delftia | Delftia acidovorans | 1.00 |
| OTU_1299 | SET 1 | 358742 | Firmicutes | Clostridia | Clostridiales | Lachnospiraceae | Lachnoclostridium | [Clostridium] aldenense | 0.59 |
| OTU_3058 | SET 1 | 84076 | Firmicutes | Clostridia | Clostridiales | Ruminococcaceae | Ruminiclostridium | [Clostridium] methylpentosum | 1.00 |
| OTU_915 | SET 1 | 1796646 | Bacteroidetes | Bacteroidia | Bacteroidales | Porphyromonadaceae | Muribaculum | Muribaculum intestinale | 1.00 |
| OTU_2561 | SET 1 | 44749 | Firmicutes | Clostridia | Clostridiales | Ruminococcaceae | Sporobacter | Sporobacter termitidis | 1.00 |
| OTU_1857 | SET 1 | 84026 | Firmicutes | Clostridia | Clostridiales | Ruminococcaceae | Ruminiclostridium | [Clostridium] methylpentosum | 1.00 |
| OTU_887 | SET 1 | 84030 | Firmicutes | Clostridia | Clostridiales | Lachnospiraceae | Lachnoclostridium | [Clostridium] saccharolyticum | 1.00 |
| OTU_1593 | SET 1 | 264463 | Firmicutes | Clostridia | Clostridiales | Lachnospiraceae | Anaerosporobacter | Anaerosporobacter mobilis | 1.00 |
| OTU_2096 | SET 1 | 820 | Bacteroidetes | Bacteroidia | Bacteroidales | Bacteroidaceae | Bacteroides | Bacteroides uniformis | 1.00 |
| OTU_1572 | SET 1 | 169435 | Firmicutes | Clostridia | Clostridiales | Ruminococcaceae | Anaerotruncus | Anaerotruncus colihominis | 1.00 |
| OTU_2402 | SET 1 | 853 | Firmicutes | Clostridia | Clostridiales | Ruminococcaceae | Faecalibacterium | Faecalibacterium prausnitzii | 1.00 |
| OTU_64 | SET 1 | 554406 | Fusobacteria | Fusobacteriia | Fusobacteriales | Leptotrichiaceae | Leptotrichia | Leptotrichia hongkongensis | 1.00 |
| OTU_1306 | SET 1 | 290054 | Firmicutes | Clostridia | Clostridiales | Eubacteriaceae | Eubacterium | Eubacterium coprostanoligenes | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_197 | SET 1 | 796942 | Firmicutes | Clostridia | Clostridiales | Lachnospiraceae | Stomatobaculum | Stomatobaculum longum | 1.00 |
| OTU_2572 | SET 1 | 1605 | Firmicutes | Bacilli | Lactobacillales | Lachnospiraceae | Lactobacillus | Lactobacillus animalis | 1.00 |
| OTU_296 | SET 1 | 1002367 | Bactero | Bacteroidia | Bacteroidales | Prevotellaceae | Prevotella | Prevotella stercorea DSM 18206 | 0.55 |
| OTU_1711 | SET 1 | 29347 | Firmicutes | Clostridia | Clostridiales | Lachnospiraceae | Lachnoclostridium | [Clostridium] scindens | 1.00 |
| OTU_254 | SET 1 | 796944 | Firmicutes | Clostridia | Clostridiales | Lachnospiraceae | Oribacterium | Oribacterium asaccharolyticum ACB7 | 1.00 |
| OTU_139 | SET 1 | 61592 | Actinobacteria | Actinobacteria | Corynebacteriales | Corynebacteriaceae | Corynebacterium | Corynebacterium durum | 1.00 |
| OTU_1332 | SET 1 | 1841857 | Bacteroidetes | Bacteroidia | Bacteroidales | Odoribacteraceae | Culturomica | Culturomica massiliensis | 1.00 |
| OTU_565 | SET 1 | 487175 | Proteobacteria | Betaproteobacteria | Burkholderiales | Sulterelaceae | Parasutterella | Parasutterella excrementihominis | 1.00 |
| OTU_569 | SET 1 | 45851 | Firmicutes | Clostridia | Clostridiales | Lachnospiraceae | Butyrivibrio | Butyrivibrio crossotus | 1.00 |
| OTU_1956 | SET 1 | 69825 | Firmicutes | Clostridia | Clostridiales | Lachnospiraceae | Lachnoclostridium | [Clostridium] indolis | 1.00 |
| OTU_1733 | SET 1 | 1050201 | Firmicutes | Erysipelotrichia | Erysipelotrichales | Erysipelotrichaceae | Allobaculum | Allobaculum stercoricanis DSM 13633 | 1.00 |
| OTU_3144 | SET 1 | 818 | Bacteroidetes | Bacteroidia | Bacteroidales | Bacteroidaceae | Bacteroides | Bacteroides thetaiotaomicron | 1.00 |
| OTU_8 | SET 1 | 762948 | Actinobacteria | Actinobacteria | Micrococcales | Micrococcaceae | Rothia | Rothia dentocariosa ATCC 17931 | 0.63 |
| OTU_325 | SET 1 | 137732 | Firmicutes | Bacilli | Lactobacillales | Carnobacteriaceae | Granulicatella | Granulicatella elegans | 1.00 |
| OTU_1651 | SET 1 | 1034346 | Firmicutes | Erysipelotrichia | Erysipelotrichales | Erysipelotrichaceae | Dielma | Dielma fastidiosa | 1.00 |
| OTU_3198 | SET 1 | 1211819 | Firmicutes | Erysipelotrichia | Erysipelotrichales | Erysipelotrichaceae | Holdemania | Holdemania massiliensis AP2 | 1.00 |
| OTU_1093 | SET 1 | 1531 | Firmicutes | Clostridia | Clostridiales | Lachnospiraceae | Lachnoclostridium | [Clostridium] clostridioforme | 1.00 |
| OTU_2160 | SET 1 | 1019 | Bacteroidetes | Flavobacteria | Flavobacteriales | Flavobacteriaceae | Capnocytophaga | Capnocytophaga sputigena | 1.00 |
| OTU_1655 | SET 1 | 288966 | Firmicutes | Clostridia | Clostridiales | Clostridiaceae | Lutispora | Lutispora thermophila | 1.00 |
| OTU_1269 | SET 1 | 74426 | Actinobacteria | Coriobacteria | Coriobacteriales | Coriobacteriaceae | Collinsella | Collinsella aerofaciens | 1.00 |
| OTU_1781 | SET 1 | 272548 | Actinobacteria | Actinobacteria | Actinomycetales | Actinomycetaceae | Actinomyces | Actinomyces dentalis | 1.00 |
| OTU_1825 | SET 1 | 39777 | Firmicutes | Negativicutes | Veillonellales | Veillonellaceae | Veillonella | Veillonella atypica | 1.00 |
| OTU_2240 | SET 1 | 46503 | Bacteroidetes | Bacteroidia | Bacteroidales | Porphyromonadaceae | Parabacteroides | Parabacteroides merdae | 1.00 |
| OTU_3124 | SET 1 | 1717 | Actinobacteria | Actinobacteria | Corynebacteriales | Corynebacteriaceae | Corynebacterium | Corynebacterium diphtheriae | 1.00 |
| OTU_3151 | SET 1 | 84112 | Actinobacteria | Coriobacteriia | Eggerthellales | Eggerthellaceae | Eggerthella | Eggerthella lenta | 1.00 |
| OTU_728 | SET 1 | 384636 | Bacteroidetes | Bacteroidia | Bacteroidales | Bacteroidaceae | Bacteroides | Bacteroides xylanolyticus | 1.00 |
| OTU_939 | SET 1 | 216940 | Tenericutes | Mollicutes | Entomoplasmatales | Spiroplasmataceae | Spiroplasma | Spiroplasma lampyridicola | 1.00 |
| OTU_947 | SET 1 | 2087 | Tenericutes | Mollicutes | Anacroplasmatales | Anacroplasmataceae | Anaeroplasma | Anaeroplasma abactoclasticum | 1.00 |
| OTU_1036 | SET 1 | 1796646 | Bacteroidetes | Bacteroidia | Bacteroidales | Porphyromonadaceae | Muribaculum | Muribaculum intestinale | 1.00 |
| OTU_2880 | SET 1 | 45634 | Firmicutes | Bacilli | Lactobacillales | Streptococcaceae | Streptococcus | Streptococcus cristatus | 1.00 |
| OTU_1594 | SET 1 | 89014 | Firmicutes | Clostridia | Clostridiales | Lachnospiraceae | Blautia | Blautia luti | 1.00 |
| OTU_1852 | SET 1 | 253257 | Firmicutes | Clostridia | Clostridiales | Lachnospiraceae | Lachnoclostridium | [Clostridium] amygdalinum | 1.00 |
| OTU_969 | SET 1 | 466107 | Proteobacteria | Deltaproteobacteria | Desulfovibrionales | Desulfovibrionaceae | Desulfovibrio | Desulfovibrio litoralis | 0.50 |
| OTU_2702 | SET 1 | 871665 | Firmicutes | Clostridia | Clostridiales | Lachnospiraceae | Blautia | Blautia faecis | 1.00 |
| OTU_1134 | SET 1 | 938293 | Firmicutes | Tissierellia | Tissierellales | Peptoniphilaceae | Anaerococcus | Anaerococcus provenciensis | 1.00 |
| OTU_1264 | SET 1 | 29466 | Firmicutes | Negativicutes | Veillonellales | Veillonellaceae | Veillonella | Veillonella parvula | 1.00 |
| OTU_1355 | SET 1 | 1689 | Actinobacteria | Actinobacteria | Bifidobacteriales | Bifidobacteriaceae | Bifidobacterium | Bifidobacterium dentium | 1.00 |
| OTU_1422 | SET 1 | 47678 | Bacteroidetes | Bacteroidia | Bacteroidales | Bacteroidaceae | Bacteroides | Bacteroides caccae | 1.00 |
| OTU_1431 | SET 1 | 259063 | Firmicutes | Clostridia | Clostridiales | Lachnospiraceae | Anaerocolumna | Anaerocolumna jejuensis | 1.00 |
| OTU_1504 | SET 1 | 879566 | Firmicutes | Clostridia | Clostridiales | Lachnospiraceae | Acetifactor | Acetifactor muris | 1.00 |
| OTU_1683 | SET 1 | 1583331 | Bacteroidetes | Bacteroidia | Bacteroidales | Porphyromonadaceae | Porphyromonas | Porphyromonas pasteri | 1.00 |
| OTU_2053 | SET 1 | 575 | Proteobacteria | Gammaproteobacteria | Enterobacterales | Enterobacteriaceae | Raoultella | Raoultella planticola | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_235 | SET 1 | 979627 | Firmicutes | Clostridia | Clostridiales | Lachnospiraceae | Lachnoanaerobaculum | Lachnoanaerobaculum orale | 1.00 |
| OTU_2479 | SET 1 | 33033 | Firmicutes | Tissierellia | Tissierellales | Peptoniphilaceae | Parvimonas | Parvimonas micra | 1.00 |
| OTU_2881 | SET 1 | 51048 | Proteobacteria | Gammaproteobacteria | Pasteurellales | Pasteurellaceae | Actinobacillus | Actinobacillus porcinus | 1.00 |
| OTU_304 | SET 1 | 840 | Bacteroidetes | Bacteroidia | Bacteroidales | Prevotellaceae | Prevotella | Prevotella loescheii | 1.00 |
| OTU_330 | SET 1 | 1583331 | Bacteroidetes | Bacteroidia | Bacteroidales | Porphyromonadaceae | Porphyromonas | Porphyromonas pasteri | 1.00 |
| OTU_1036 | SET 1 | 1796646 | Bacteroidetes | Bacteroidia | Bacteroidales | Porphyromonadaceae | Muribaculum | Muribaculum intestinale | 1.00 |
| OTU_2880 | SET 1 | 45634 | Firmicutes | Bacilli | Lactobacillales | Streptococcaceae | Streptococcus | Streptococcus cristatus | 1.00 |
| OTU_1594 | SET 1 | 89014 | Firmicutes | Clostridia | Clostridiales | Lachnospiraceae | Blautia | Blautia luti | 1.00 |
| OTU_1852 | SET 1 | 253257 | Firmicutes | Clostridia | Clostridiales | Lachnospiraceae | Lachnoclostridium | [Clostridium] amygdalinum | 1.00 |
| OTU_969 | SET 1 | 466107 | Proteobacteria | Deltaproteobacteria | Desulfovibrionales | Desulfovibrionaceae | Desulfovibrio | Desulfovibrio litoralis | 0.50 |
| OTU_2702 | SET 1 | 871665 | Firmicutes | Clostridia | Clostridiales | Lachnospiraceae | Blautia | Blautia faecis | 1.00 |
| OTU_1134 | SET 1 | 938293 | Firmicutes | Tissierellia | Tissierellales | Peptoniphilaceae | Anaerococcus | Anaerococcus provenciensis | 1.00 |
| OTU_1264 | SET 1 | 29466 | Firmicutes | Negativicutes | Veillonellales | Veillonellaceae | Veillonella | eillonella parvula | 1.00 |
| OTU_1355 | SET 1 | 1689 | Actinobacteria | Actinobacteria | Bifidobacteriales | Bifidobacteriaceae | Bifidobacterium | Bifidobacterium dentium | 1.00 |
| OTU_1422 | SET 1 | 47678 | Bacteroidetes | Bacteroidia | Bacteroidales | Bacteroidaceae | Bacteroides | Bacteroides caccae | 1.00 |
| OTU_1431 | SET 1 | 259063 | Firmicutes | Clostridia | Clostridiales | Lachnospiraceae | Anaerocolumna | Anaerocolumna jejuensis | 1.00 |
| OTU_1504 | SET 1 | 879566 | Firmicutes | Clostridia | Clostridiales | Lachnospiraceae | Acetatifactor | Acetatifactor muris | 1.00 |
| OTU_1683 | SET 1 | 1583331 | Bacteroidetes | Bacteroidia | Bacteroidales | Porphyromonadaceae | Porphyromonas | Porphyromonas pasteri | 1.00 |
| OTU_2053 | SET 1 | 575 | Proteobacteria | Gammaproteobacteria | Enterobacterales | Enterobacteriaceae | Raoultella | Raoultella planticola | 1.00 |
| OTU_235 | SET 1 | 979627 | Firmicutes | Clostridia | Clostridiales | Lachnospiraceae | Lachnoanaerobaculum | Lachnoanaerobaculum orale | 1.00 |
| OTU_2479 | SET 1 | 33033 | Firmicutes | Tissierellia | Tissierellales | Peptoniphilaceae | Parvimonas | Parvimonas micra | 1.00 |
| OTU_2881 | SET 1 | 51048 | Proteobacteria | Gammaproteobacteria | Pasteurellales | Pasteurellaceae | Actinobacillus | Actinobacillus porcinus | 1.00 |
| OTU_304 | SET 1 | 840 | Bacteroidetes | Bacteroidia | Bacteroidales | Prevotellaceae | Prevotella | Prevotella loescheii | 1.00 |
| OTU_330 | SET 1 | 1583331 | Bacteroidetes | Bacteroidia | Bacteroidales | Porphyromonadaceae | Porphyromonas | Porphyromonas pasteri | 1.00 |
| OTU_383 | SET 1 | 1660 | Actinobacteria | Actinobacteria | Actinomycetales | Actinomycetaceae | Actinomyces | Actinomyces odontolyticus | 1.00 |
| OTU_549 | SET 1 | 29466 | Firmicutes | Negativicutes | Veillonellales | Veillonellaceae | Veillonella | Veillonella parvula | 1.00 |
| OTU_572 | SET 1 | 320502 | Firmicutes | Clostridia | Clostridiales | Ruminococcaceae | Ruminiclostridium | [Clostridium] alkalicellulosi | 1.00 |
| OTU_622 | SET 1 | 1236517 | Bacteroidetes | Bacteroidia | Bacteroidales | Prevotellaceae | Prevotella | Prevotella fusca JCM 17724 | 1.00 |
| OTU_743 | SET 1 | 617123 | Bacteroidetes | Bacteroidia | Bacteroidales | Porphyromonadaceae | Porphyromonas | Porphyromonas pasteri | 1.00 |
| OTU_2250 | SET 1 | 546 | Proteobacteria | Gammaproteobacteria | Enterobacterales | Enterobacteriaceae | Citrobacter | Citrobacter freundii | 1.00 |
| OTU_1367 | SET 1 | 1298596 | Firmicutes | Clostridia | Clostridiales | Ruminococcaceae | Ruminococcus | Ruminococcus faecis JCM 15917 | 1.00 |
| OTU_1067 | SET 1 | 1796646 | Bacteroidetes | Bacteroidia | Bacteroidales | Porphyromonadaceae | Muribaculum | Muribaculum intestinale | 1.00 |
| OTU_1072 | SET 1 | 358743 | Firmicutes | Clostridia | Clostridiales | Lachnospiraceae | Lachnoclostridium | [Clostridium] citroniae | 1.00 |
| OTU_1963 | SET 1 | 1050201 | Firmicutes | Erysipelotrichia | Erysipelotrichales | Erysipelotrichaceae | Allobaculum | Allobaculum stercoricanis DSM 13633 | 1.00 |
| OTU_1171 | SET 1 | 1264 | Firmicutes | Clostridia | Clostridiales | Ruminococcaceae | Ruminococcus | Ruminococcus albus | 1.00 |
| OTU_1895 | SET 1 | 471875 | Firmicutes | Clostridia | Clostridiales | Ruminococcaceae | Ruminococcus | Ruminococcus lactaris ATCC 29176 | 1.00 |
| OTU_211 | SET 1 | 28135 | Bacteroidetes | Bacteroidia | Bacteroidales | Prevotellaceae | Prevotella | Prevotella oris | 1.00 |
| OTU_2165 | SET 1 | 82171 | Proteobacteria | Deltaproteobacteria | Desulfovibrionales | Desulfovibrionaceae | Desulfovibrio | Desulfovibrio zostercae | 1.00 |
| OTU_2395 | SET 1 | 37658 | Firmicutes | Clostridia | Clostridiales | Lachnospiraceae | Lachnoclostridium | [Clostridium] populeti | 1.00 |
| OTU_2682 | SET 1 | 483 | Proteobacteria | Betaproteobacteria | Neisseriales | Neisseriaceae | Chromobacterium | Neisseria cinerea | 1.00 |
| OTU_2766 | SET 1 | 333367 | Firmicutes | Clostridia | Clostridiales | Lachnospiraceae | Lachnoclostridium | [Clostridium] asparagiforme | 1.00 |
| OTU_309 | SET 1 | 501496 | Bacteroidetes | Bacteroidia | Bacteroidales | Porphyromonadaceae | Porphyromonas | Porphyromonas bennonis | 1.00 |
| OTU_723 | SET 1 | 99656 | Firmicutes | Clostridia | Clostridiales | Lachnospiraceae | Lachnoclostridium | [Clostridium] fimetarium | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_973 | SET 1 | 1379 | Firmicutes | Bacilli | Bacillales | unclassified.NA | Gemella | Gemella haemolysans | 1.00 |
| OTU_1231 | SET 1 | 84032 | Firmicutes | Clostridia | Clostridiales | Ruminococcaceae | Ruminiclostridium | [Clostridium] thermosuccinogenes | 1.00 |
| OTU_2687 | SET 1 | 1236512 | Bacteroidetes | Bacteroidia | Bacteroidales | Bacteroidaceae | Bacteroides | Bacteroides rodentium JCM 16496 | 1.00 |
| OTU_2840 | SET 1 | 1297617 | Firmicutes | Clostridia | Clostridiales | unclassified.NA | Intestinimonas | Intestinimonas butyriciproducens | 1.00 |
| OTU_3053 | SET 1 | 411467 | Firmicutes | Clostridia | Clostridiales | unclassified.NA | Pseudoflavonifractor | Pseudoflavonifractor capillosus ATCC 29799 | 1.00 |
| OTU_3199 | SET 1 | 39483 | Firmicutes | Erysipelotrichia | Erysipelotrichales | Erysipelotrichaceae | Faecalitalea | Faecalitalea cylindroides | 1.00 |
| OTU_3207 | SET 1 | 46503 | Bacteroidetes | Bacteroidia | Bacteroidales | Porphyromonadaceae | Parabacteroides | Parabacteroides merdae | 1.00 |
| OTU_1427 | SET 1 | 879566 | Firmicutes | Clostridia | Clostridiales | Lachnospiraceae | Acetatifactor | Acetatifactor muris | 1.00 |
| OTU_901 | SET 1 | 1107316 | Proteobacteria | Betaproteobacteria | Neisseriales | Neisseriaceae | Neisseria | Neisseria oralis | 1.00 |
| OTU_1223 | SET 1 | 584 | Proteobacteria | Gammaproteobacteria | Enterobacterales | Morganellaceae | Proteus | Proteus mirabilis | 1.00 |
| OTU_1608 | SET 1 | 28124 | Bacteroidetes | Bacteroidia | Bacteroidales | Porphyromonadaceae | Porphyromonas | Porphyromonas endodontalis | 1.00 |
| OTU_1798 | SET 1 | 166486 | Firmicutes | Clostridia | Clostridiales | Lachnospiraceae | Roseburia | Roseburia intestinalis | 1.00 |
| OTU_2066 | SET 1 | 109327 | Firmicutes | Clostridia | Clostridiales | Clostridiales Family XIII. Incertae Sedis | Anaerovorax | Anaerovorax odorimutans | 1.00 |
| OTU_2280 | SET 1 | 1033744 | Firmicutes | Tissierellia | Tissierellales | Peptoniphilaceae | Peptoniphilus | Peptoniphilus senegalensis JC140 | 1.00 |
| OTU_2393 | SET 1 | 320502 | Firmicutes | Clostridia | Clostridiales | Ruminococcaceae | Ruminiclostridium | [Clostridium] alkalicellulosi | 1.00 |
| OTU_3125 | SET 1 | 901 | Proteobacteria | Deltaproteobacteria | Desulfovibrionales | Desulfovibrionaceae | Desulfovibrio | Desulfovibrio piger | 1.00 |
| OTU_1762 | SET 1 | 483 | Proteobacteria | Betaproteobacteria | Neisseriales | Neisseriaceae | Chromobacterium | Neisseria cinerea | 1.00 |
| OTU_2848 | SET 1 | 657309 | Bacteroidetes | Bacteroidia | Bacteroidales | Bacteroidaceae | Bacteroides | Bacteroides xylanisolvens XB1A | 1.00 |
| OTU_298 | SET 1 | 671218 | Bacteroidetes | Bacteroidia | Bacteroidales | Prevotellaceae | Alloprevotella | Alloprevotella rava | 1.00 |
| OTU_376 | SET 1 | 536441 | Bacteroidetes | Flavobacteria | Flavobacteriales | Flavobacteriaceae | Chryseobacterium | Chryseobacterium taklimakanense | 1.00 |
| OTU_571 | SET 1 | 873513 | Bacteroidetes | Bacteroidia | Bacteroidales | Prevotellaceae | Prevotella | Prevotella buccae ATCC 33574 | 1.00 |
| OTU_618 | SET 1 | 76123 | Bacteroidetes | Bacteroidia | Bacteroidales | Prevotellaceae | Prevotella | Prevotella enoeca | 1.00 |
| OTU_2595 | SET 1 | 1118060 | Actinobateria | Coriobacterriia | Coriobacteriales | Coriobacteriaceae | Enorma | Enorma massiliensis phI | 1.00 |
| OTU_266 | SET 1 | 89152 | Firmicutes | Clostridia | Clostridiales | Peptostreptococcaceae | Achromobacter | [Clostridium] hiranonis | 1.00 |
| OTU_514 | SET 1 | 888727 | Firmicutes | Clostridia | Clostridiales | Clostridiales Family XIII. Incertae Sedis | unclassified. N.A | Eubacterium sulci ATCC 35585 | 1.00 |
| OTU_94 | SET 1 | 76122 | Bacteroidetes | Bacteroidia | Bacteroidales | Prevotellaceae | Alloprevotella | Alloprevotella tannerae | 1.00 |
| OTU_2059 | SET 1 | 303 | Proteobacteria | Gammaproteobacteria | Pseudomonadales | Pseudomonadaceae | Pseudomonas | Pseudomonas putida | 1.00 |
| OTU_3060 | SET 1 | 1541 | Firmicutes | Clostridia | Clostridiales | Peptostreptococcaceae | Terrisporobacter | Terrisporobacter mayombei | 1.00 |
| OTU_1475 | SET 1 | 507751 | Tissierellia | Tissierellia | Tissierellales | Peptoniphilaceae | Peptoniphilus | Peptoniphilus koenoeneniae | 1.00 |
| OTU_1204 | SET 1 | 1796646 | Bacteroidetes | Bacteroidia | Bacteroidales | Porphyromonadaceae | Muribaculum | Muribaculum intestinale | 1.00 |
| OTU_1626 | SET 1 | 1796646 | Bacteroidetes | Bacteroidia | Bacteroidales | Porphyromonadaceae | Muribaculum | Muribaculum intestinale | 1.00 |
| OTU_3028 | SET 1 | 515620 | Firmicutes | Clostridia | Clostridiales | Eubacteriaceae | Eubacterium | [Eubacterium] eligens ATCC 27750 | 1.00 |
| OTU_1090 | SET 1 | 38302 | Actinobateria | Actinobacteria | Corynebacteriales | Corynebacteriaceae | Colynebacterium | Corynebacterium mycetoides | 1.00 |
| OTU_186 | SET 1 | 53419 | Spirochaetes | Spirochactia | Spirochaetales | Spirochaetaceae | Treponema | Treponema socranskii | 1.00 |
| OTU_2158 | SET 1 | 1796646 | Bacteroidetes | Bacteroidia | Bacteroidales | Porphyromonadaceae | Muribaculum | Muribaculum intestinale | 1.00 |
| OTU_2205 | SET 1 | 726 | Proteobacteria | Gammaproteobacteria | Pasteurellales | Pasteurellaceae | Haemophilus | Haemophilus haemolyticus | 1.00 |
| OTU_2345 | SET 1 | 328812 | Bacteroidetes | Bacteroidia | Bacteroidales | Porphyromonadaceae | Parabacteroides | Parabacteroides goldsteinii | 1.00 |
| OTU_1408 | SET 1 | 40324 | Proteobacteria | Gammaproteobacteria | Xanthomonadales | Xanthomonadaceae | Stenotrophomonas | Stenotrophomonas maltophilia | 1.00 |
| OTU_1476 | SET 1 | 1297617 | Firmicutes | Clostridia | Clostridiales | unclassified.N.A | Intestinimonas | Intestinimonas butyriciproducens | 1.00 |
| OTU_1731 | SET 1 | 555088 | Firmicutes | Clostridia | Clostridiales | Syntrophomonadaceae | Dethiobacter | Dethiobacter alkaliphilus AHT 1 | 1.00 |
| OTU_2082 | SET 1 | 901 | Proteobacteria | Deltaproteobacteria | Desulfovibrionales | Desulfovibrionaceae | Desulfovibrio | Desulfovibrio piger | 1.00 |

TABLE 1-continued

Operational taxonomic units of Sets 1-3

| OTUs | Set | TAX_id | Phylum | Class | Order | Family | Genus | Species | ei |
|---|---|---|---|---|---|---|---|---|---|
| OTU_2114 | SET 1 | 1796646 | Bacteroidetes | Bacteroidia | Bacteroidales | Porphyromonadaceae | Muribaculum | Muribaculum intestinale | 1.00 |
| OTU_2283 | SET 1 | 308994 | Firmicutes | Negativicutes | Veillonellales | Veillonellaceae | Dialister | Dialister propionicifaciens | 1.00 |
| OTU_238 | SET 1 | 1796646 | Bacteroidetes | Bacteroidia | Bacteroidales | Porphyromonadaceae | Muribaculum | Muribaculum intestinale | 1.00 |
| OTU_2517 | SET 1 | 29375 | Firmicutes | Clostridia | Clostridiales | Lachnospiraceae | Lachnoclostridium | [Clostridium] xylanolyticum | 1.00 |
| OTU_609 | SET 1 | 1796610 | Actinobacteria | Coriobacteria | Eggerthellales | Eggerthellaceae | Enterorhabdus | Enterorhabdus muris | 1.00 |
| OTU_1208 | SET 1 | 290052 | Firmicutes | Clostridia | Clostridiales | Ruminococcaceae | Acetivibrio | Acetivibrio ethanolgignens | 1.00 |
| OTU_1844 | SET 1 | 546 | Proteobacteria | Gammaproteobacteria | Enterobacteriales | Enterobacteriaceae | Citrobacter | Citrobacter freundii | 1.00 |
| OTU_1560 | SET 1 | 988946 | Cyanobacteria | unclassified.N.A | Nostocales | Symphyonemataceae | Loriellopsis | Loriellopsis cavernicola | 1.00 |
| OTU_1819 | SET 1 | 1605 | Firmicutes | Bacilli | Lactobacillales | Lactobacillaceae | Lactobacillus | Lactobacillus animalis | 1.00 |
| OTU_2423 | SET 1 | 166486 | Firmicutes | Clostridia | Clostridiales | Lachnospiraceae | Roseburia | Roseburia intestinalis | 1.00 |
| OTU_1517 | SET 1 | 160404 | Firmicutes | Clostridia | Clostridiales | Lachnospiraceae | Tyzzerella | [Clostridium] lactatifermentans | 1.00 |
| OTU_114 | SET 1 | 1853370 | Bacteroidetes | Bacteroidia | Bacteroidales | Prevotellaceae | Prevotellamassilia | Prevotellamssilia timonensis | 1.00 |
| OTU_1248 | SET 1 | 474960 | Firmicutes | Clostridia | Clostridiales | Ruminococcaceae | Hydrogenoanaerobacterium | Hydrogenoanaerobacterium saccarovorans | 1.00 |
| OTU_84 | SET 1 | 1017 | Bacteroidetes | Flavobacteriia | Flavobacteriales | Flavobacteriaceae | Capnocytophaga | Capnocytophaga gingivalis | 1.00 |
| OTU_1624 | SET 1 | 1168289 | Bacteroidetes | Bacteroidia | Bacteroidales | Marinilabiliaceae | Marinilabilia | Marinilabilia salmonicolor JCM 21150 | 1.00 |
| OTU_2918 | SET 1 | 246787 | Bacteroidetes | Bacteroidia | Bacteroidales | Bacteroidaceae | Bacteroides | Bacteroides cellulosilyticus | 1.00 |
| OTU_1293 | SET 1 | 76936 | Proteobacteria | Epsilonproteobacteria | Campylobacterales | Helicobacteraceae | Helicobacter | Helicobacter typhlonius | 1.00 |
| OTU_2664 | SET 1 | 94869 | Firmicutes | Clostridia | Clostridiales | Clostridiaceae | Clostridium | Clostridium gasigenes | 1.00 |
| OTU_2728 | SET 1 | 204516 | Bacteroidetes | Bacteroidia | Bacteroidales | Bacteroidaceae | Bacteroides | Bacteroides massiliensis | 1.00 |
| OTU_911 | SET 1 | 1161098 | Firmicutes | Tissierellia | Tissierellales | Peptoniphilaceae | Anaerococcus | Anaerococcus octavius NCTC 9810 | 1.00 |
| OTU_1930 | SET 1 | 28117 | Bacteroidetes | Bacteroidia | Bacteroidales | Rikenellaceae | Alistipes | Alistipes putredinis | 1.00 |
| OTU_1625 | SET 1 | 1002367 | Bacteroidetes | Bacteroidia | Bacteroidales | Prevotellaceae | Prevotella | Prevotella stercorea DSM 18206 | 1.00 |
| OTU_3162 | SET 1 | 261299 | Firmicutes | Clostridia | Clostridiales | Peptostreptococcaceae | Intestinibacter | Intestinibacter bartlettii | 1.00 |
| OTU_1255 | SET 1 | 46206 | Firmicutes | Clostridia | Clostridiales | Lachnospiraceae | Pseudobutyrivibrio | Pseudobutyrivibrio ruminis | 1.00 |
| OTU_2161 | SET 1 | 515619 | Firmicutes | Clostridia | Clostridiales | Lachnospiraceae | Myxococcus | [Eubacterium rectale] ATCC 33656 | 1.00 |
| OTU_2320 | SET 1 | 28118 | Bacteroidetes | Bacteroidia | Bacteroidales | Odoribacteraceae | Odoribacter | Odoribacter splanchnicus | 1.00 |
| OTU_2674 | SET 1 | 1531 | Firmicutes | Clostridia | Clostridiales | Lachnospiraceae | Lachnoclostridium | [Clostridium] clostridioforme | 1.00 |
| OTU_729 | SET 1 | 215580 | Proteobacteria | Betaproteobacteria | Burkholderiales | Comamonadaceae | Schlegelella | Schlegelella thermodepolymerans | 1.00 |
| OTU_730 | SET 1 | 1796646 | Bacteroidetes | Bacteroidia | Bacteroidales | Porphyromonadaceae | Muribaculum | Muribaculum intestinale | 1.00 |
| OTU_994 | SET 1 | 1125779 | Actinobacteria | Actinobacteria | Corynebacteriales | Corynebacteriaceae | Corynebacterium | Corynebacterium pyruviciproducens ATCC BAA-1742 | 1.00 |
| OTU_1282 | SET 1 | 84026 | Firmicutes | Clostridia | Clostridiales | Ruminococcaceae | Ruminiclostridium | [Clostridium] methylpentosum | 1.00 |
| OTU_1717 | SET 1 | 327575 | Bacteroidetes | Flavobacteriia | Flavobacterales | Flavobacteriaceae | Capnocytophaga | Capnocytophaga leadbetteri | 1.00 |
| OTU_2829 | SET 1 | 549 | Proteobacteria | Gammaproteobacteria | Enterobacterales | Erwiniaceae | Pantoea | Pantoea agglomerans | 1.00 |
| OTU_398 | SET 1 | 28123 | Bacteroidetes | Bacteroidia | Bacteroidales | Prevotellaceae | Prevotella | Prevotella denticola | 1.00 |
| OTU_971 | SET 1 | 483 | Proteobacteria | Betaproteobacteria | Neisseriales | Neisseriaceae | Chromobacterium | Neisseria cinerea | 1.00 |
| OTU_1659 | SET 1 | 1450648 | Firmicutes | Clostridia | Clostridiales | Clostridiaceae | Clostridium | Clostridium oryzae | 1.00 |
| OTU_881 | SET 1 | 214856 | Bacteroidetes | Bacteroidia | Bacteroidales | Rikenellaceae | Alistipes | Alistipes finegoldii | 1.00 |
| OTU_1581 | SET 1 | 264463 | Firmicutes | Clostridia | Clostridiales | Lachnospiraceae | Anaerosporobacter | Anaerosporobacter mobilis | 1.00 |
| OTU_2148 | SET 1 | 319644 | Firmicutes | Clostridia | Clostridiales | Ruminococcaceae | Saccharofermentans | Saccharofermentans acetigenes | 1.00 |
| OTU_2969 | SET 1 | 515619 | Firmicutes | Clostridia | Clostridiales | Lachnospiraceae | Myxococcus | [Eubacterium rectale] ATCC 33656 | 1.00 |
| OTU_717 | SET 1 | 478 | Proteobacteria | Gammaproteobacteria | Pseudomonadales | Moraxellaceae | Moraxella | Moraxella nonliquefaciens | 1.00 |

TABLE 2

| CAG Number | Unadjusted p-value | Response status | CAG Number | Taxonomy Level | Species | Genus | Family |
|---|---|---|---|---|---|---|---|
| CAG00720 | 0.017 | NR | CAG00720 | Species | Anaerotruncus colihominis | Anaerotruncus | Ruminococcaceae |
| CAG00124 | 0.018 | NR | CAG00124 | Species | Klebsiella varicola | Klebsiella | Enterobacteriaceae |
| CAG00011 | 0.035 | NR | CAG00011 | Species | Escherichia coli | Escherichia | Enterobacteriaceae |
| CAG00050 | 0.043 | NR | CAG00050 | Species | Bacteroides thetaiotaomicron | Bacteroides | Bacteroidaceae |
| CAG00834 | 0.047 | NR | CAG00834 | Species | Oxalobacter formigenes | Oxalobacter | Oxalobacteraceae |
| CAG00426 | 0.06 | NR | CAG00426 | Species | Paraprevotella clara | Paraprevotella | Prevotellaceae |
| CAG01272 | 0.06 | NR | CAG01272 | Species | Adlercreutzia equolifaciens | Adlercreutzia | Eggerthellaceae |
| CAG01320 | 0.066 | NR | CAG01320 | Species | Clostridium bolteae | Lachnoclostridium | Lachnospiraceae |
| CAG00012 | 0.069 | NR | CAG00012 | Species | Klebsiella pneumoniae | Klebsiella | Enterobacteriaceae |
| CAG00826 | 0.089 | NR | CAG00826 | Genus | unclassified Clostridium | Clostridium | Clostridiaceae |
| CAG00117 | 0.692 | NR | CAG00117 | Species | Parabacteroides merdae | Parabacteroides | Porphyromonadaceae |
| CAG00093 | 0.116 | NR | CAG00093 | Species | Klebsiella quasipneumoniae | Klebsiella | Enterobacteriaceae |
| CAG00114 | 0.116 | NR | CAG00114 | Genus | unclassified Lachnoclostridium | Lachnoclostridium | Lachnospiraceae |
| CAG00161 | 0.116 | NR | CAG00161 | Species | Bacteroides coprocola | Bacteroides | Bacteroidaceae |
| CAG00163 | 0.116 | NR | CAG00163 | Species | Prevotella sp. CAG255 | Prevotella | Prevotellaceae |
| CAG00256 | 0.116 | NR | CAG00256 | Family | unclassified Lachnospiraceae | unclassified Lachnospiraceae | Lachnospiraceae |
| CAG00462 | 0.116 | NR | CAG00462 | Species | Streptococcus pasteurianus | Streptococcus | Streptococcaceae |
| CAG00815 | 0.116 | NR | CAG00815 | Species | Lactococcus lactis | Lactococcus | Streptococcaceae |
| CAG00817 | 0.116 | NR | CAG00817 | Order | unclassified Clostridiales | unclassified Clostridiales | unclassified Clostridiales |
| CAG00010_2 | 0.116 | NR | CAG00010_2 | NA | unclassified | unclassified | unclassified |
| CAG01203 | 0.116 | NR | CAG01203 | Species | Streptococcus mutans | Streptococcus | Streptococcaceae |
| CAG00949 | 0.12 | NR | CAG00949 | species | Ruminococcaceae bacterium D16 | unclassified Ruminococcaceae | Ruminococcaceae |
| CAG00775 | 0.13 | NR | CAG00775 | Species | Firmicutes bacterium CAG:102 | unclassified Firmicutes | unclassified Firmicutes |
| CAG00931 | 0.131 | NR | CAG00931 | Genus | unclassified Oscillibacter | Oscillibacter | Oscillospiraceae |
| CAG01263 | 0.154 | NR | CAG01263 | Species | Clostridium clostridioforme | Lachnoclostridium | Lachnospiraceae |
| CAG00086 | 0.154 | NR | CAG00086 | Species | Bacteroides massiliensis | Bacteroides | Bacteroidaceae |
| CAG00113 | 0.157 | NR | CAG00113 | Species | Clostridium scindens | Lachnoclostridium | Lachnospiraceae |
| CAG01323 | 0.165 | NR | CAG01323 | Species | Parabacteroides merdae | Parabacteroides | Porphyromonadaceae |
| CAG00502 | 0.184 | NR | CAG00502 | Species | Eubacterium sp. CAG:161 | Eubacterium | Eubacteriaceae |
| CAG00254 | 0.193 | NR | CAG00254 | Species | Ruminococcus gnavus | Blautia | Lachnospiraceae |
| CAG01264 | 0.197 | NR | CAG01264 | Species | Clostridium clostridioforme | Lachnoclostridium | Lachnospiraceae |
| CAG00327 | 0.009 | R | CAG00327 | Family | unclassified Ruminococcaceae | unclassified Ruminococcaceae | Ruminococcaceae |
| CAG00659 | 0.017 | R | CAG00659 | Order | unclassified Clostridiales | unclassified Clostridiales | unclassified Clostridiales |
| CAG00492 | 0.034 | R | CAG00492 | Genus | unclassified Faecalibacterium | Faecalibacterium | Ruminococcaceae |
| CAG00518 | 0.034 | R | CAG00518 | Genus | unclassified Faecalibacterium | Faecalibacterium | Ruminococcaceae |
| CAG01146 | 0.034 | R | CAG01146 | Genus | unclassified Oscillibacter | Oscillibacter | Oscillospiraceae |
| CAG00079 | 0.038 | R | CAG00079 | Species | Clostridium sp. CAG:7 | unclassified Clostridiales | unclassified Clostridiales |
| CAG00393 | 0.048 | R | CAG00393 | Species | Eubacterium sp. CAG:86 | Eubacterium | Eubacteriaceae |
| CAG00766 | 0.065 | R | CAG00766 | Species | Firmicutes bacterium CAG:176 | unclassified Firmicutes | unclassified Firmicutes |
| CAG00095 | 0.065 | R | CAG00095 | Species | Akkermansia sp. CAG:344 | Akkermansia | Akkermansiaceae |
| CAG00010_1 | 0.065 | R | CAG00010_1 | Order | unclassified Clostridiales | unclassified Clostridiales | unclassified Clostridiales |
| CAG00342 | 0.065 | R | CAG00342 | Species | Bifidobacterium pseudocatenulatum | Bifidobacterium | Bifidobacteriaceae |
| CAG00303 | 0.065 | R | CAG00303 | Order | unclassified Clostridiales | unclassified Clostridiales | unclassified Clostridiales |
| CAG00337 | 0.065 | R | CAG00337 | Genus | unclassified Faecalibacterium | Faecalibacterium | Ruminococcaceae |
| CAG00381 | 0.065 | R | CAG00381 | Species | Clostridium sp. CAG:242 | unclassified Clostridiales | unclassified Clostridiales |
| CA600559 | 0.065 | R | CA600559 | Family | unclassified Clostridiales | unclassified Clostridiales | unclassified Clostridiales |
| CAG00570 | 0.065 | R | CAG00570 | NA | unclassified | unclassified | unclassified |
| CAG00635 | 0.065 | R | CAG00635 | Species | Bifidobacterium bifidum | Bifidobacterium | Bifidobacteriaceae |

TABLE 2-continued

| CAG Number | Unadjusted p-value | Response status | CAG Number | Taxonomy Level | Species | Genus | Family |
|---|---|---|---|---|---|---|---|
| CAG00636 | 0.065 | R | CAG00636 | Genus | unclassified *Roseburia* | *Roseburia* | Lachnospiraceae |
| CAG00660 | 0.065 | R | CAG00660 | Species | *Alistipes timonensis* | *Alistipes* | Rikenellaceae |
| CAG00669 | 0.065 | R | CAG00669 | Species | unclassified Firmicutes | unclassified Firmicutes | unclassified Firmicutes |
| CAG00708 | 0.065 | R | CAG00708 | Species | *Alistipes senegalensis* | *Alistipes* | Rikenellaceae |
| CAG00773 | 0.065 | R | CAG00773 | Genus | unclassified Firmicutes | unclassified Firmicutes | unclassified Firmicutes |
| CAG00807 | 0.065 | R | CAG00807 | Genus | unclassified *Holdemanella* | *Holdemanella* | Erysipelotrichaceae |
| CAG00880 | 0.065 | R | CAG00880 | Species | *Subdoligranulum* sp. CAG:314 | *Subdoligranulum* | Ruminococcaceae |
| CAG00907 | 0.065 | R | CAG00907 | Family | unclassified Clostridiales | unclassified Clostridiales | unclassified Clostridiales |
| CAG01086 | 0.065 | R | CAG01086 | Genus | unclassified Firmicutes | unclassified Firmicutes | unclassified Firmicutes |
| CAG01215 | 0.065 | R | CAG01215 | Family | unclassified Clostridiales | unclassified Clostridiales | unclassified Clostridiales |
| CAG01277 | 0.065 | R | CAG01277 | Genus | unclassified Clostridiales | unclassified Clostridiales | unclassified Clostridiales |
| CAG01308 | 0.065 | R | CAG01308 | Genus | unclassified Firmicutes | unclassified Firmicutes | unclassified Firmicutes |
| CAG00577 | 0.073 | R | CAG00577 | Species | *Faecalibacterium prausnitzii* 3 (L2-6) | *Faecalibacterium* | Ruminococcaceae |
| CAG00506 | 0.083 | R | CAG00506 | Genus | unclassified Ruminococcaceae | unclassified Ruminococcaceae | Ruminococcaceae |
| CAG00852 | 0.087 | R | CAG00852 | Species | *Clostridium spiroforme* | *Erysipelatoclostridium* | Erysipelotrichaceae |
| CAG01046 | 0.091 | R | CAG01046 | Genus | unclassified *Intestinimonas* | *Intestinimonas* | unclassified Clostridiales |
| CAG00320 | 0.092 | R | CAG00320 | Species | *Phascolarctobacterium* sp. CAG:207 | *Phascolarctobacterium* | Acidaminococcaceae |
| CAG00619 | 0.097 | R | CAG00619 | Genus | unclassified *Faecalibacterium* | *Faecalibacterium* | Ruminococcaceae |
| CAG01366 | 0.098 | R | CAG01366 | Species | *Streptococcus parasanguinis* | *Streptococcus* | Streptococcaceae |
| CAG00509 | 0.1 | R | CAG00509 | Order | unclassified Firmicutes | unclassified Firmicutes | unclassified Firmicutes |
| CAG00441 | 0.104 | R | CAG00441 | Genus | unclassified *Blautia* | *Blautia* | Lachnospiraceae |
| CAG00249 | 0.106 | R | CAG00249 | Species | *Clostridium leptum* | *Ruminiclostridium* | Ruminococcaceae |
| CAG50003 | 0.12 | R | CAG50003 | Genus | unclassified Clostridiales | unclassified Clostridiales | unclassified Clostridiales |
| CAG00039 | 0.121 | R | CAG00039 | Order | unclassified Firmicutes | unclassified Firmicutes | unclassified Firmicutes |
| CAG00127 | 0.121 | R | CAG00127 | Family | unclassified Lachnospiraceae | unclassified Lachnospiraceae | Lachnospiraceae |
| CAG00854 | 0.121 | R | CAG00854 | Family | unclassified Ruminococcaceae | unclassified Ruminococcaceae | Ruminococcaceae |
| CAG00166 | 0.121 | R | CAG00166 | Order | unclassified Clostridiales | unclassified Clostridiales | unclassified Clostridiales |
| CAG00272 | 0.121 | R | CAG00272 | Species | *Faecalibacterium* 5 (sp. CAG:74) | *Faecalibacterium* | Ruminococcaceae |
| CAG00294 | 0.121 | R | CAG00294 | Genus | unclassified Firmicutes | unclassified Firmicutes | Runanococcaceae |
| CAG00367 | 0.121 | R | CAG00367 | Species | Firmicutes bacterium CAG:170 | unclassified Firmicutes | unclassified Firmicutes |
| CAG00445 | 0.121 | R | CAG00445 | Order | unclassified Clostridiales | unclassified Clostridiales | unclassified Clostridiales |
| CAG00452 | 0.121 | R | CAG00452 | Species | *Clostridium* sp. CAG:167 | unclassified Clostridiales | unclassified Clostridiales |
| CAG00497 | 0.121 | R | CAG00497 | Genus | unclassified Firmicutes | unclassified Firmicutes | unclassified Firmicutes |
| CAG00505 | 0.121 | R | CAG00505 | Genus | unclassified Firmicutes | unclassified Firmicutes | unclassified Firmicutes |
| CAG00721 | 0.121 | R | CAG00721 | NA | unclassified | *Methanobrevibacter* | Methanobacteriaceae |
| CAG00624 | 0.121 | R | CAG00624 | Species | *Methanobrevibacter smithii* 1 | unclassified Firmicutes | unclassified Firmicutes |
| CAG00648 | 0.121 | R | CAG00648 | Phylum | unclassified Firmicutes | *Eubacterium* | Eubacteriaceae |
| CAG00735 | 0.121 | R | CAG00735 | Genus | unclassified *Eubacterium* | *Eubacterium* | Eubacteriaceae |
| CAG00770 | 0.121 | R | CAG00770 | Genus | unclassified *Eubacterium* | unclassified Eggerthellaceae | Eggerthellaceae |
| CAG00812 | 0.121 | R | CAG00812 | Family | unclassified Eggerthellaceae | *Catenibacterium* | Erysipelotrichaceae |
| CAG00861 | 0.121 | R | CAG00861 | Species | *Catenibacterium* sp. CAG:290 | *Oscillibacter* | Oscillospiraceae |
| CAG00863 | 0.121 | R | CAG00863 | Species | *Oscillibacter* sp. CAG:241 | unclassified Firmicutes | unclassified Firmicutes |
| CAG00925 | 0.121 | R | CAG00925 | Genus | unclassified Firmicutes | unclassified | unclassified |
| CAG00934 | 0.121 | R | CAG00934 | NA | unclassified | unclassified Clostridiales | unclassified Clostridiales |
| CAG01003 | 0.121 | R | CAG01003 | Order | unclassified Clostridiales | unclassified Ruminococcaceae | Ruminococcaceae |
| CAG01325 | 1.121 | R | CAG01325 | Family | unclassified Ruminococcaceae | *Lachnoclostridium* | Lachnospiraceae |
| CAG02021 | 0.121 | R | CAG02021 | Genus | unclassified *Lachnoclostridium* | unclassified | unclassified |
| CAG01349 | 0.121 | R | CAG01349 | NA | unclassified | unclassified Clostridiales | unclassified Clostridiales |
| CAG01350 | 0.121 | R | CAG01350 | Order | unclassified Clostridiales | unclassified Clostridiales | unclassified Clostridiales |

TABLE 2-continued

| CAG Number | Unadjusted p-value | Response status | CAG Number | Taxonomy Level | Species | Genus | Family |
|---|---|---|---|---|---|---|---|
| CAG01402 | 0.121 | R | CAG01402 | Species | Turicibacter sp. H121 | Turicibacter | Erysipelotrichaceae |
| CAG01403 | 0.121 | R | CAG01403 | Species | Bacteroides stercorirosoris | Bacteroides | Bacteroidaceae |
| CAG01551 | 0.121 | R | CAG01551 | Genus | unclassified Oscillibacter | Oscillibacter | Oscillospiraceae |
| CAG01028 | 0.13 | R | CAG01028 | Species | Ruminococcaceae bacterium 1 1158 | unclassified Ruminococcaceae | Ruminococcaceae |
| CAG00121 | 0.134 | R | CAG00121 | Species | Bacteroides finegoldii | Bacteroides | Bacteroidaceae |
| CAG00670 | 0.134 | R | CAG00670 | Genus | unclassified Firmicutes | unclassified Firmicutes | unclassified Firmicutes |
| CAG00324 | 0.137 | R | CAG00324 | Species | Firmicutes bacterium CAG:94 | unclassified Firmicutes | unclassified Firmicutes |
| CAG00218 | 0.143 | R | CAG00218 | Species | Barnesiella intestinihominis | Barnesiella | Porphyromonadaceae |
| CAG00755 | 0.143 | R | CAG00755 | Genus | unclassified Faecalibacterium | Faecalibacterium | Ruminococcaceae |
| CAG00560 | 0.175 | R | CAG00560 | Genus | unclassified Subdoligranulum | Subdoligranulum | Ruminococcaceae |
| CAG00259 | 0.177 | R | CAG00259 | Genus | unclassified Firmicutes | unclassified Firmicutes | unclassified Firmicutes |
| CAG01039 | 0.177 | R | CAG01039 | Genus | unclassified Faecalibacterium | Faecalibacterium | Ruminococcaceae |
| CAG00239 | 0.183 | R | CAG00239 | Species | Flavonifractor plautii | Flavonifractor | unclassified Clostridiales |
| CAG00112 | 0.184 | R | CAG00112 | Species | Blautia sp. CAG:52 | Blautia | Lachnospiraceae |
| CAG00697 | 0.196 | R | CAG00697 | Genus | unclassified Hungatella | Hungatella | Clostridiaceae |
| CAG00595 | 0.201 | R | CAG00595 | Order | unclassified Clostridiales | unclassified Clostridiales | unclassified Clostridiales |
| CAG00629 | 0.213 | R | CAG00629 | Species | Firmicutes bacterium CAG:124 | unclassified Firmicutes | unclassified Firmicutes |
| CAG00549 | 0.219 | R | CAG00549 | Species | Bifidobacterium longum | Bifidobacterium | Bifidobacteriaceae |
| CAG00328 | 0.221 | R | CAG00328 | Species | Alistipes indistinctus | Alistipes | Rikenellaceae |
| CAG00760 | 0.222 | R | CAG00760 | Species | Ruminococcus sp. CAG:177 | Ruminococcus | Ruminococcaceae |
| CAG00031 | 0.222 | R | CAG00031 | NA | unclassified | unclassified | unclassified |
| CAG00102 | 0.222 | R | CAG00102 | Genus | unclassified Clostridiales | unclassified Clostridiales | unclassified Clostridiales |
| CAG00130 | 0.222 | R | CAG00130 | Species | Weissella confusa | Weissella | Leuconostocaceae |
| CAG00134 | 0.222 | R | CAG00134 | Species | Cloacibacillus porcorum | Cloacibacillus | Synergistaceae |
| CAG00145 | 0.222 | R | CAG00145 | Genus | unclassified Clostridiales | unclassified Clostridiales | unclassified Clostridiales |
| CAG00200 | 0.222 | R | CAG00200 | Genus | unclassified Flavonifractor | Flavonifractor | unclassified Clostridiales |
| CAG00179 | 0.222 | R | CAG00179 | Species | Blautia sp. CAG:237 | Blautia | Lachnospiraceae |
| CAG00183 | 0.222 | R | CAG00183 | Species | Ruminococcus sp. CAG:60 | Ruminococcus | Ruminococcaceae |
| CAG00198 | 0.222 | R | CAG00198 | NA | unclassified | unclassified | unclassified |
| CAG00214 | 0.222 | R | CAG00214 | Species | Prevotella corporis | Prevotella | Prevotellaceae |
| CAG00261 | 0.222 | R | CAG00261 | Genus | unclassified Oscillibacter | Oscillibacter | Oscillospiraceae |
| CAG00241 | 0.222 | R | CAG00241 | Species | Anaerotruncus sp. CAG:390 | Anaerotruncus | Ruminococcaceae |
| CAG00363 | 0.222 | R | CAG00363 | Genus | unclassified Intestinimonas | Intestinimonas | unclassified Clostridiales |
| CAG00373 | 0.222 | R | CAG00373 | Genus | unclassified Oscillibacter | Oscillibacter | Oscillospiraceae |
| CAG00436 | 0.222 | R | CAG00436 | Species | Clostridium sp. CAG:299 | unclassified Clostridiales | unclassified Clostridiales |
| CAG00470 | 0.222 | R | CAG00470 | Family | unclassified Ruminococcaceae | unclassified Ruminococcaceae | Ruminococcaceae |
| CAG00541 | 0.222 | R | CAG00541 | Species | Dorea sp. CAG:105 | Dorea | Lachnospiraceae |
| CAG00542 | 0.222 | R | CAG00542 | Species | Butyrivibrio crossotus | Butyrivibrio | Lachnospiraceae |
| CAG00644 | 0.222 | R | CAG00644 | Species | Clostridium sp. CAG:226 | unclassified Clostridiales | unclassified Clostridiales |
| CAG00658 | 0.222 | R | CAG00658 | Genus | unclassified Firmicutes | unclassified Firmicutes | unclassified Firmicutes |
| CAG00676 | 0.222 | R | CAG00676 | Genus | unclassified Clostridiales | unclassified Clostridiales | unclassified Clostridiales |
| CAG00698 | 0.222 | R | CAG00698 | Genus | unclassified Ruminococcus | Ruminococcus | Ruminococcaceae |
| CAG00703 | 0.222 | R | CAG00703 | Species | Candidatus Methanomassiliicoccus intestinalis | Methanomassiliicoccus | Methanomassiliicoccaceae |
| CAG00831 | 0.222 | R | CAG00831 | Genus | unclassified Firmicutes | unclassified Firmicutes | unclassified Firmicutes |
| CAG00841 | 0.222 | R | CAG00841 | Species | Firmicutes bacterium CAG:345 | unclassified Firmicutes | unclassified Firmicutes |
| CAG00850 | 0.222 | R | CAG00850 | Genus | unclassified Blautia | Blautia | Lachnospiraceae |
| CAG00851 | 0.222 | R | CAG00851 | Genus | unclassified Firmicutes | unclassified Firmicutes | unclassified Firmicutes |
| CAG00048_1 | 0.222 | R | CAG00048_1 | Order | unclassified Clostridiales | unclassified Clostridiales | unclassified Clostridiales |
| CAG00866 | 0.222 | R | CAG00866 | Genus | unclassified Firmicutes | unclassified Firmicutes | unclassified Firmicutes |
| CAG00892 | 0.222 | R | CAG00892 | Phylum | unclassified Firmicutes | unclassified Firmicutes | unclassified Firmicutes |

TABLE 2-continued

| CAG Number | Unadjusted p-value | Response status | CAG Number | Species | Taxonomy Level | Genus | Family |
|---|---|---|---|---|---|---|---|
| CAG00959 | 0.222 | R | CAG00959 | unclassified Alistipes | Genus | Alistipes | Rikenellaceae |
| CAG00965 | 0.222 | R | CAG00965 | unclassified Firmicutes | Genus | unclassified Firmicutes | unclassified Firmicutes |
| CAG00988 | 0.222 | R | CAG00988 | Clostridium sp. CAG:349 | Species | unclassified Clostridiales | unclassified Clostridiales |
| CAG01047 | 0.222 | R | CAG01047 | unclassified Clostridiales Family XIII. Incertae Sedis | Family | unclassified Closbidiales Family XIII. Incertae Sedis | Clostridiales Family XIII Incertae Sedis |
| CAG01075 | 0.222 | R | CAG01075 | unclassified Clostridiales | Order | unclassified Clostridiales | unclassified Clostridiales |
| CAG01099 | 0.222 | R | CAG01099 | Raoultella ornithinelytica | Species | Raoultella | Enterobacteriaceae |
| CAG01108 | 0.222 | R | CAG01108 | Clostridium sp. CAG:798 | Species | unclassified Clostridiales | unclassified Clostridiales |
| CAG01145 | 0.222 | R | CAG01145 | unclassified Bacteroides | Genus | Bacteroides | Bacteroidaceae |
| CAG01156 | 0.222 | R | CAG01156 | unclassified Eubacterium | Genus | Eubacterium | Eubacteriaceae |
| CAG01169 | 0.222 | R | CAG01169 | unclassified Ruminococcaceae | Family | unclassified Ruminococcaceae | Ruminococcaceae |
| CAG01240 | 0.222 | R | CAG01240 | Parabacteroides gordonii | Species | Parabacteroides | Porphyromonadaceae |
| CAG00068_2 | 0.222 | R | CAG00068_2 | unclassified Porphyromonas | Genus | Porphyromonas | Porphyromonadaceae |
| CAG01372 | 0.222 | R | CAG01372 | unclassified Oscillibacter | Genus | Oscillibacter | Oscillospiraceae |
| CAG01394 | 0.222 | R | CAG01394 | unclassified Blautia | Genus | Blautia | Lachnospiraceae |
| CAG00052 | 0.225 | R | CAG00052 | Parabacteroides goldsteinii | Species | Parabacteroides | Porphyromonadaceae |
| CAG00116 | 0.225 | R | CAG00116 | Bacteroides nordii | Species | Bacteroides | Bacteroidaceae |
| CAG00429 | 0.225 | R | CAG00429 | Eubacterium sp. CAG:248 | Species | Eubacterium | Eubacteriaceae |
| CAG00702 | 0.24 | R | CAG00702 | Bifidobacterium adolescentis | Species | Bifidobacterium | Bifidobacteriaceae |
| CAG00309 | 0.243 | R | CAG00309 | Alistipes onderdonkii | Species | Alistipes | Rikenellaceae |
| CAG01637 | 0.259 | R | CAG01637 | Firmicutes bacterium CAG:65 | Species | unclassified Firmicutes | unclassified Firmicutes |
| CAG01051 | 0.265 | R | CAG01051 | unclassified Oscillibacter | Genus | Oscillibacter | Oscillospiraceae |
| CAG00792 | 0.265 | R | CAG00792 | Firmicutes bacterium CAG:65 | Species | unclassified Firmicutes | unclassified Firmicutes |
| CAG00208 | 0.266 | R | CAG00208 | Faecalibacterium 8 | Species | Faecalibacterium | Ruminococcaceae |
| CAG01700 | 0.279 | R | CAG01700 | unclassified Ruminococcaceae | Family | unclassified Ruminococcaceae | Ruminococcaceae |
| CAG01371 | 0.279 | R | CAG01371 | Escherichia coli | Species | Escherichia | Enterobacteriaceae |
| CAG00653 | 0.29 | R | CAG00653 | Eubacterium siraeum | Species | Ruminiclostridium | Ruminococcaceae |
| CAG00520 | 0.29 | R | CAG00520 | Firmicutes bacterium CAG:56 | Species | unclassified Firmicutes | unclassified Firmicutes |
| CAG00273 | 0.311 | R | CAG00273 | Blautia sp. CAG:37 | Species | Blautia | Lachnospiraceae |

TABLE 2A

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG00327 | V1.FI20_GL0119476 | SEQ ID NO: 877 |
| CAG00327 | V1.UC26-4_GL0088915 | SEQ ID NO: 878 |
| CAG00327 | V1.FI17_GL0037272 | SEQ ID NO: 879 |
| CAG00327 | V1.FI17_GL0078727 | SEQ ID NO: 880 |
| CAG00327 | O2.UC24-2_GL0094271 | SEQ ID NO: 881 |
| CAG00327 | V1.FI17_GL0207542 | SEQ ID NO: 882 |
| CAG00327 | MH0348_GL0074623 | SEQ ID NO: 883 |
| CAG00327 | MH0348_GL0010939 | SEQ ID NO: 884 |
| CAG00327 | MH0373_GL0012294 | SEQ ID NO: 885 |
| CAG00327 | MH0448_GL0074435 | SEQ ID NO: 886 |
| CAG00327 | V1.UC26-4_GL0005764 | SEQ ID NO: 887 |
| CAG00327 | O2.UC52-0_GL0057691 | SEQ ID NO: 888 |
| CAG00327 | V1.UC26-4_GL0145819 | SEQ ID NO: 889 |
| CAG00327 | V1.FI17_GL0032281 | SEQ ID NO: 890 |
| CAG00327 | V1.UC26-4_GL0185580 | SEQ ID NO: 891 |
| CAG00327 | V1.FI17_GL0175729 | SEQ ID NO: 892 |
| CAG00327 | V1.UC26-4_GL0030591 | SEQ ID NO: 893 |
| CAG00327 | MH0343_GL0081662 | SEQ ID NO: 894 |
| CAG00327 | MH0348_GL0118307 | SEQ ID NO: 895 |
| CAG00327 | V1.UC26-4_GL0004865 | SEQ ID NO: 896 |
| CAG00327 | V1.UC26-4_GL0083941 | SEQ ID NO: 897 |
| CAG00327 | V1.UC26-4_GL0101656 | SEQ ID NO: 898 |
| CAG00327 | MH0348_GL0087364 | SEQ ID NO: 899 |
| CAG00327 | V1.FI17_GL0122971 | SEQ ID NO: 900 |
| CAG00327 | MH0372_GL0069396 | SEQ ID NO: 901 |
| CAG00327 | MH0366_GL0119156 | SEQ ID NO: 902 |
| CAG00327 | MH0372_GL0071516 | SEQ ID NO: 903 |
| CAG00327 | MH0348_GL0064411 | SEQ ID NO: 904 |
| CAG00327 | MH0343_GL0166170 | SEQ ID NO: 905 |
| CAG00327 | V1.UC26-4_GL0076251 | SEQ ID NO: 906 |
| CAG00327 | MH0343_GL0092435 | SEQ ID NO: 907 |
| CAG00327 | V1.FI17_GL0016953 | SEQ ID NO: 908 |
| CAG00327 | V1.UC26-4_GL0143205 | SEQ ID NO: 909 |
| CAG00327 | MH0372_GL0055320 | SEQ ID NO: 910 |
| CAG00327 | V1.UC26-4_GL0055452 | SEQ ID NO: 911 |
| CAG00327 | MH0348_GL0106302 | SEQ ID NO: 912 |
| CAG00327 | MH0372_GL0097771 | SEQ ID NO: 913 |
| CAG00327 | 764062976-stool1_revised_scaffold12924_1_gene147101 | SEQ ID NO: 914 |
| CAG00327 | O2.UC48-1_GL0017424 | SEQ ID NO: 915 |
| CAG00327 | O2.UC48-1_GL0207849 | SEQ ID NO: 916 |
| CAG00327 | V1.FI17_GL0115124 | SEQ ID NO: 917 |
| CAG00327 | MH0203_GL0130549 | SEQ ID NO: 918 |
| CAG00327 | V1.UC26-4_GL0093892 | SEQ ID NO: 919 |
| CAG00327 | MH0348_GL0072323 | SEQ ID NO: 920 |
| CAG00327 | MH0348_GL0058041 | SEQ ID NO: 921 |
| CAG00327 | 764062976-stool1_revised_scaffold30750_1_gene162103 | SEQ ID NO: 922 |
| CAG00327 | 764062976-stool1_revised_scaffold4128_1_gene64730 | SEQ ID NO: 923 |
| CAG00327 | MH0343_GL0169255 | SEQ ID NO: 924 |
| CAG00327 | MH0343_GL0093310 | SEQ ID NO: 925 |
| CAG00327 | V1.UC26-4_GL0016002 | SEQ ID NO: 926 |
| CAG00659 | O2.UC48-0_GL0168719 | SEQ ID NO: 927 |
| CAG00659 | V1.UC55-0_GL0148491 | SEQ ID NO: 928 |
| CAG00659 | V1.UC55-0_GL0157646 | SEQ ID NO: 929 |
| CAG00659 | O2.UC48-0_GL0022850 | SEQ ID NO: 930 |
| CAG00659 | V1.UC55-0_GL0065136 | SEQ ID NO: 931 |
| CAG00659 | V1.UC55-0_GL0003249 | SEQ ID NO: 932 |
| CAG00659 | O2.UC48-0_GL0232704 | SEQ ID NO: 933 |
| CAG00659 | V1.UC55-0_GL0081417 | SEQ ID NO: 934 |
| CAG00659 | V1.UC55-0_GL0120641 | SEQ ID NO: 935 |
| CAG00659 | V1.UC55-0_GL0068968 | SEQ ID NO: 936 |
| CAG00659 | V1.UC55-0_GL0134495 | SEQ ID NO: 937 |
| CAG00659 | O2.UC48-0_GL0312586 | SEQ ID NO: 938 |
| CAG00659 | V1.UC55-0_GL0136172 | SEQ ID NO: 939 |
| CAG00659 | V1.UC55-0_GL0132419 | SEQ ID NO: 940 |
| CAG00659 | V1.UC55-0_GL0141266 | SEQ ID NO: 941 |
| CAG00659 | V1.UC55-0_GL0038453 | SEQ ID NO: 942 |
| CAG00659 | O2.UC48-0_GL0001916 | SEQ ID NO: 943 |
| CAG00659 | V1.UC55-0_GL0168942 | SEQ ID NO: 944 |
| CAG00659 | V1.UC55-0_GL0011960 | SEQ ID NO: 945 |
| CAG00659 | O2.UC48-0_GL0003471 | SEQ ID NO: 946 |
| CAG00659 | V1.UC55-0_GL0028121 | SEQ ID NO: 947 |
| CAG00659 | O2.UC48-0_GL0286932 | SEQ ID NO: 948 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG00659 | V1.UC55-0_GL0085245 | SEQ ID NO: 949 |
| CAG00659 | V1.UC55-0_GL0230349 | SEQ ID NO: 950 |
| CAG00659 | V1.UC55-0_GL0020063 | SEQ ID NO: 951 |
| CAG00659 | V1.UC55-0_GL0185502 | SEQ ID NO: 952 |
| CAG00659 | O2.UC48-0_GL0167135 | SEQ ID NO: 953 |
| CAG00659 | V1.UC55-0_GL0188691 | SEQ ID NO: 954 |
| CAG00659 | V1.UC55-0_GL0039924 | SEQ ID NO: 955 |
| CAG00659 | O2.UC48-0_GL0301463 | SEQ ID NO: 956 |
| CAG00659 | V1.UC55-0_GL0135343 | SEQ ID NO: 957 |
| CAG00659 | O2.UC48-0_GL0045674 | SEQ ID NO: 958 |
| CAG00659 | V1.UC55-0_GL0250090 | SEQ ID NO: 959 |
| CAG00659 | V1.UC55-0_GL0100024 | SEQ ID NO: 960 |
| CAG00659 | V1.UC55-0_GL0027986 | SEQ ID NO: 961 |
| CAG00659 | V1.UC55-0_GL0144487 | SEQ ID NO: 962 |
| CAG00659 | O2.UC48-0_GL0091878 | SEQ ID NO: 963 |
| CAG00659 | V1.UC55-0_GL0027028 | SEQ ID NO: 964 |
| CAG00659 | O2.UC48-0_GL0166121 | SEQ ID NO: 965 |
| CAG00659 | V1.UC55-0_GL0002100 | SEQ ID NO: 966 |
| CAG00659 | V1.UC55-0_GL0248648 | SEQ ID NO: 967 |
| CAG00659 | V1.UC55-0_GL0200340 | SEQ ID NO: 968 |
| CAG00659 | V1.UC55-0_GL0184665 | SEQ ID NO: 969 |
| CAG00659 | V1.UC55-0_GL0206589 | SEQ ID NO: 970 |
| CAG00659 | V1.UC55-0_GL0195608 | SEQ ID NO: 971 |
| CAG00659 | V1.UC55-0_GL0195112 | SEQ ID NO: 972 |
| CAG00659 | O2.UC48-0_GL0293274 | SEQ ID NO: 973 |
| CAG00659 | V1.UC55-0_GL0148492 | SEQ ID NO: 974 |
| CAG00659 | V1.UC55-0_GL0095333 | SEQ ID NO: 975 |
| CAG00659 | O2.UC48-0_GL0215527 | SEQ ID NO: 976 |
| CAG00492 | V1.FI17_GL0043088 | SEQ ID NO: 977 |
| CAG00492 | MH0348_GL0110975 | SEQ ID NO: 978 |
| CAG00492 | MH0348_GL0058897 | SEQ ID NO: 979 |
| CAG00492 | MH0348_GL0129512 | SEQ ID NO: 980 |
| CAG00492 | V1.CD46-0_GL0039934 | SEQ ID NO: 981 |
| CAG00492 | V1.CD46-0_GL0064253 | SEQ ID NO: 982 |
| CAG00492 | V1.CD46-0_GL0117608 | SEQ ID NO: 983 |
| CAG00492 | V1.FI08_GL0017847 | SEQ ID NO: 984 |
| CAG00492 | MH0373_GL0129260 | SEQ ID NO: 985 |
| CAG00492 | V1.CD46-0_GL0075229 | SEQ ID NO: 986 |
| CAG00492 | V1.CD46-0_GL0136740 | SEQ ID NO: 987 |
| CAG00492 | MH0348_GL0008929 | SEQ ID NO: 988 |
| CAG00492 | V1.CD46-0_GL0135816 | SEQ ID NO: 989 |
| CAG00492 | V1.CD46-0_GL0068552 | SEQ ID NO: 990 |
| CAG00492 | V1.CD46-0_GL0077963 | SEQ ID NO: 991 |
| CAG00492 | MH0348_GL0074142 | SEQ ID NO: 992 |
| CAG00492 | V1.FI08_GL0104771 | SEQ ID NO: 993 |
| CAG00492 | V1.FI17_GL0153167 | SEQ ID NO: 994 |
| CAG00492 | MH0348_GL0055971 | SEQ ID NO: 995 |
| CAG00492 | V1.FI08_GL0146851 | SEQ ID NO: 996 |
| CAG00492 | V1.FI08_GL0053807 | SEQ ID NO: 997 |
| CAG00492 | V1.CD46-0_GL0112049 | SEQ ID NO: 998 |
| CAG00492 | V1.CD46-0_GL0089014 | SEQ ID NO: 999 |
| CAG00492 | MH0348_GL0053234 | SEQ ID NO: 1000 |
| CAG00492 | V1.FI08_GL0145379 | SEQ ID NO: 1001 |
| CAG00492 | V1.FI08_GL0165033 | SEQ ID NO: 1002 |
| CAG00492 | V1.FI08_GL0008571 | SEQ ID NO: 1003 |
| CAG00492 | V1.FI08_GL0166887 | SEQ ID NO: 1004 |
| CAG00492 | V1.FI17_GL0066347 | SEQ ID NO: 1005 |
| CAG00492 | MH0348_GL0136454 | SEQ ID NO: 1006 |
| CAG00492 | V1.FI08_GL0087488 | SEQ ID NO: 1007 |
| CAG00492 | MH0348_GL0023440 | SEQ ID NO: 1008 |
| CAG00492 | V1.FI08_GL0138599 | SEQ ID NO: 1009 |
| CAG00492 | V1.FI08_GL0073194 | SEQ ID NO: 1010 |
| CAG00492 | V1.FI08_GL0127100 | SEQ ID NO: 1011 |
| CAG00492 | MH0348_GL0136728 | SEQ ID NO: 1012 |
| CAG00492 | V1.FI08_GL0073404 | SEQ ID NO: 1013 |
| CAG00492 | MH0348_GL0118964 | SEQ ID NO: 1014 |
| CAG00492 | V1.FI08_GL0131066 | SEQ ID NO: 1015 |
| CAG00492 | V1.FI08_GL0136903 | SEQ ID NO: 1016 |
| CAG00492 | V1.CD46-0_GL0141031 | SEQ ID NO: 1017 |
| CAG00492 | MH0348_GL0074552 | SEQ ID NO: 1018 |
| CAG00492 | MH0373_GL0093766 | SEQ ID NO: 1019 |
| CAG00492 | V1.FI17_GL0041765 | SEQ ID NO: 1020 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00492 | V1.FI08_GL0036958 | SEQ ID NO: 1021 |
| CAG00492 | V1.FI08_GL0034796 | SEQ ID NO: 1022 |
| CAG00492 | V1.FI08_GL0141490 | SEQ ID NO: 1023 |
| CAG00492 | MH0348_GL0038049 | SEQ ID NO: 1024 |
| CAG00492 | V1.CD46-0_GL0006897 | SEQ ID NO: 1025 |
| CAG00492 | MH0348_GL0128273 | SEQ ID NO: 1026 |
| CAG00518 | V1.FI17_GL0223127 | SEQ ID NO: 1027 |
| CAG00518 | V1.FI17_GL0056536 | SEQ ID NO: 1028 |
| CAG00518 | V1.FI17_GL0151283 | SEQ ID NO: 1029 |
| CAG00518 | V1.FI17_GL0105002 | SEQ ID NO: 1030 |
| CAG00518 | V1.FI17_GL0034777 | SEQ ID NO: 1031 |
| CAG00518 | V1.FI17_GL0056308 | SEQ ID NO: 1032 |
| CAG00518 | V1.FI17_GL0174918 | SEQ ID NO: 1033 |
| CAG00518 | V1.FI17_GL0222796 | SEQ ID NO: 1034 |
| CAG00518 | V1.FI17_GL0067073 | SEQ ID NO: 1035 |
| CAG00518 | V1.FI17_GL0178176 | SEQ ID NO: 1036 |
| CAG00518 | V1.FI17_GL0179703 | SEQ ID NO: 1037 |
| CAG00518 | V1.FI17_GL0189443 | SEQ ID NO: 1038 |
| CAG00518 | V1.FI17_GL0084116 | SEQ ID NO: 1039 |
| CAG00518 | V1.FI17_GL0170320 | SEQ ID NO: 1040 |
| CAG00518 | V1.FI17_GL0172798 | SEQ ID NO: 1041 |
| CAG00518 | V1.FI17_GL0080116 | SEQ ID NO: 1042 |
| CAG00518 | V1.FI17_GL0064860 | SEQ ID NO: 1043 |
| CAG00518 | V1.FI17_GL0005908 | SEQ ID NO: 1044 |
| CAG00518 | V1.FI17_GL0081029 | SEQ ID NO: 1045 |
| CAG00518 | V1.FI17_GL0123216 | SEQ ID NO: 1046 |
| CAG00518 | V1.FI17_GL0049498 | SEQ ID NO: 1047 |
| CAG00518 | V1.FI17_GL0096107 | SEQ ID NO: 1048 |
| CAG00518 | V1.FI17_GL0145670 | SEQ ID NO: 1049 |
| CAG00518 | V1.FI17_GL0095433 | SEQ ID NO: 1050 |
| CAG00518 | V1.FI17_GL0098541 | SEQ ID NO: 1051 |
| CAG00518 | V1.FI17_GL0213327 | SEQ ID NO: 1052 |
| CAG00518 | V1.FI17_GL0026647 | SEQ ID NO: 1053 |
| CAG00518 | V1.FI17_GL0130881 | SEQ ID NO: 1054 |
| CAG00518 | V1.FI17_GL0119514 | SEQ ID NO: 1055 |
| CAG00518 | V1.FI17_GL0152624 | SEQ ID NO: 1056 |
| CAG00518 | V1.FI17_GL0230043 | SEQ ID NO: 1057 |
| CAG00518 | V1.FI17_GL0084105 | SEQ ID NO: 1058 |
| CAG00518 | V1.FI17_GL0054899 | SEQ ID NO: 1059 |
| CAG00518 | V1.FI17_GL0090574 | SEQ ID NO: 1060 |
| CAG00518 | V1.FI17_GL0214395 | SEQ ID NO: 1061 |
| CAG00518 | V1.FI17_GL0220845 | SEQ ID NO: 1062 |
| CAG00518 | V1.FI17_GL0050024 | SEQ ID NO: 1063 |
| CAG00518 | V1.FI17_GL0207008 | SEQ ID NO: 1064 |
| CAG00518 | V1.FI17_GL0147404 | SEQ ID NO: 1065 |
| CAG00518 | V1.FI17_GL0175176 | SEQ ID NO: 1066 |
| CAG00518 | V1.FI17_GL0023173 | SEQ ID NO: 1067 |
| CAG00518 | V1.FI17_GL0177478 | SEQ ID NO: 1068 |
| CAG00518 | V1.FI17_GL0061078 | SEQ ID NO: 1069 |
| CAG00518 | V1.FI17_GL0039499 | SEQ ID NO: 1070 |
| CAG00518 | V1.FI17_GL0091846 | SEQ ID NO: 1071 |
| CAG00518 | V1.FI17_GL0224471 | SEQ ID NO: 1072 |
| CAG00518 | V1.FI17_GL0118783 | SEQ ID NO: 1073 |
| CAG00518 | V1.FI17_GL0056307 | SEQ ID NO: 1074 |
| CAG00518 | V1.FI17_GL0088351 | SEQ ID NO: 1075 |
| CAG00518 | V1.FI17_GL0073252 | SEQ ID NO: 1076 |
| CAG01146 | V1.FI28_GL0195377 | SEQ ID NO: 1077 |
| CAG01146 | O2.UC49-0_GL0025609 | SEQ ID NO: 1078 |
| CAG01146 | V1.UC38-4_GL0044141 | SEQ ID NO: 1079 |
| CAG01146 | V1.UC38-4_GL0021935 | SEQ ID NO: 1080 |
| CAG01146 | O2.UC35-1_GL0026285 | SEQ ID NO: 1081 |
| CAG01146 | V1.FI06_GL0004599 | SEQ ID NO: 1082 |
| CAG01146 | V1.UC38-4_GL0034407 | SEQ ID NO: 1083 |
| CAG01146 | V1.UC38-4_GL0057326 | SEQ ID NO: 1084 |
| CAG01146 | O2.UC36-1_GL0134634 | SEQ ID NO: 1085 |
| CAG01146 | V1.UC38-4_GL0088839 | SEQ ID NO: 1086 |
| CAG01146 | V1.FI34_GL0143132 | SEQ ID NO: 1087 |
| CAG01146 | V1.UC38-0_GL0106709 | SEQ ID NO: 1088 |
| CAG01146 | V1.UC38-4_GL0027899 | SEQ ID NO: 1089 |
| CAG01146 | V1.FI06_GL0061656 | SEQ ID NO: 1090 |
| CAG01146 | O2.UC35-1_GL0054016 | SEQ ID NO: 1091 |
| CAG01146 | V1.UC38-0_GL0104749 | SEQ ID NO: 1092 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG01146 | V1.UC38-4_GL0045647 | SEQ ID NO: 1093 |
| CAG01146 | V1.UC38-4_GL0072341 | SEQ ID NO: 1094 |
| CAG01146 | V1.UC38-0_GL0057730 | SEQ ID NO: 1095 |
| CAG01146 | V1.FI28_GL0124663 | SEQ ID NO: 1096 |
| CAG01146 | V1.UC38-0_GL0040549 | SEQ ID NO: 1097 |
| CAG01146 | V1.FI06_GL0139057 | SEQ ID NO: 1098 |
| CAG01146 | O2.UC35-1_GL0063806 | SEQ ID NO: 1099 |
| CAG01146 | V1.UC38-0_GL0149389 | SEQ ID NO: 1100 |
| CAG01146 | V1.UC38-4_GL0071470 | SEQ ID NO: 1101 |
| CAG01146 | V1.FI06_GL0051314 | SEQ ID NO: 1102 |
| CAG01146 | O2.UC35-1_GL0076721 | SEQ ID NO: 1103 |
| CAG01146 | V1.UC38-4_GL0050715 | SEQ ID NO: 1104 |
| CAG01146 | V1.FI28_GL0211259 | SEQ ID NO: 1105 |
| CAG01146 | V1.UC11-0_GL0036916 | SEQ ID NO: 1106 |
| CAG01146 | V1.UC38-0_GL0052356 | SEQ ID NO: 1107 |
| CAG01146 | V1.UC38-4_GL0065035 | SEQ ID NO: 1108 |
| CAG01146 | O2.UC49-0_GL0018610 | SEQ ID NO: 1109 |
| CAG01146 | V1.UC38-4_GL0056319 | SEQ ID NO: 1110 |
| CAG01146 | O2.UC49-0_GL0158507 | SEQ ID NO: 1111 |
| CAG01146 | V1.UC38-0_GL0073167 | SEQ ID NO: 1112 |
| CAG01146 | O2.UC35-1_GL0026564 | SEQ ID NO: 1113 |
| CAG01146 | V1.UC38-4_GL0006756 | SEQ ID NO: 1114 |
| CAG01146 | V1.FI28_GL0051866 | SEQ ID NO: 1115 |
| CAG01146 | V1.UC38-0_GL0081759 | SEQ ID NO: 1116 |
| CAG01146 | V1.UC11-0_GL0026546 | SEQ ID NO: 1117 |
| CAG01146 | V1.UC38-4_GL0091721 | SEQ ID NO: 1118 |
| CAG01146 | V1.FI28_GL0206130 | SEQ ID NO: 1119 |
| CAG01146 | V1.UC38-0_GL0013101 | SEQ ID NO: 1120 |
| CAG01146 | V1.UC38-4_GL0061996 | SEQ ID NO: 1121 |
| CAG01146 | V1.UC38-4_GL0142563 | SEQ ID NO: 1122 |
| CAG01146 | V1.UC38-4_GL0156200 | SEQ ID NO: 1123 |
| CAG01146 | V1.FI06_GL0070368 | SEQ ID NO: 1124 |
| CAG01146 | V1.UC38-4_GL0162695 | SEQ ID NO: 1125 |
| CAG01146 | O2.UC11-1_GL0117762 | SEQ ID NO: 1126 |
| CAG00079 | N017A_GL0059153 | SEQ ID NO: 1127 |
| CAG00079 | SZEY-104A_GL0060090 | SEQ ID NO: 1128 |
| CAG00079 | MH0020_GL0000529 | SEQ ID NO: 1129 |
| CAG00079 | MH0301_GL0097161 | SEQ ID NO: 1130 |
| CAG00079 | MH0006_GL0148832 | SEQ ID NO: 1131 |
| CAG00079 | MH0006_GL0157059 | SEQ ID NO: 1132 |
| CAG00079 | MH0087_GL0033669 | SEQ ID NO: 1133 |
| CAG00079 | MH0087_GL0001927 | SEQ ID NO: 1134 |
| CAG00079 | MH0006_GL0200708 | SEQ ID NO: 1135 |
| CAG00079 | MH0006_GL0085266 | SEQ ID NO: 1136 |
| CAG00079 | V1.CD11-0_GL0023861 | SEQ ID NO: 1137 |
| CAG00079 | MH0087_GL0026189 | SEQ ID NO: 1138 |
| CAG00079 | MH0020_GL0009728 | SEQ ID NO: 1139 |
| CAG00079 | MH0305_GL0021042 | SEQ ID NO: 1140 |
| CAG00079 | MH0087_GL0014945 | SEQ ID NO: 1141 |
| CAG00079 | MH0087_GL0048780 | SEQ ID NO: 1142 |
| CAG00079 | MH0087_GL0025847 | SEQ ID NO: 1143 |
| CAG00079 | MH0109_GL0086398 | SEQ ID NO: 1144 |
| CAG00079 | SZEY-64A_GL0001256 | SEQ ID NO: 1145 |
| CAG00079 | MH0006_GL0111726 | SEQ ID NO: 1146 |
| CAG00079 | MH0420_GL0006194 | SEQ ID NO: 1147 |
| CAG00079 | MH0074_GL0014285 | SEQ ID NO: 1148 |
| CAG00079 | MH0006_GL0100867 | SEQ ID NO: 1149 |
| CAG00079 | SZEY-78A_GL0051586 | SEQ ID NO: 1150 |
| CAG00079 | MH0087_GL0041527 | SEQ ID NO: 1151 |
| CAG00079 | MH0274_GL0125787 | SEQ ID NO: 1152 |
| CAG00079 | MH0087_GL0010722 | SEQ ID NO: 1153 |
| CAG00079 | MH0006_GL0161952 | SEQ ID NO: 1154 |
| CAG00079 | MH0087_GL0047637 | SEQ ID NO: 1155 |
| CAG00079 | MH0166_GL0060041 | SEQ ID NO: 1156 |
| CAG00079 | MH0301_GL0099557 | SEQ ID NO: 1157 |
| CAG00079 | MH0109_GL0002384 | SEQ ID NO: 1158 |
| CAG00079 | MH0166_GL0024801 | SEQ ID NO: 1159 |
| CAG00079 | T2D-2A_GL0025065 | SEQ ID NO: 1160 |
| CAG00079 | MH0087_GL0018284 | SEQ ID NO: 1161 |
| CAG00079 | MH0020_GL0029215 | SEQ ID NO: 1162 |
| CAG00079 | MH0006_GL0081754 | SEQ ID NO: 1163 |
| CAG00079 | MH0087_GL0001908 | SEQ ID NO: 1164 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00079 | MH0088_GL0109554 | SEQ ID NO: 1165 |
| CAG00079 | MH0006_GL0140990 | SEQ ID NO: 1166 |
| CAG00079 | MH0119_GL0032882 | SEQ ID NO: 1167 |
| CAG00079 | MH0020_GL0051592 | SEQ ID NO: 1168 |
| CAG00079 | MH0222_GL0069273 | SEQ ID NO: 1169 |
| CAG00079 | MH0109_GL0040568 | SEQ ID NO: 1170 |
| CAG00079 | MH0006_GL0159123 | SEQ ID NO: 1171 |
| CAG00079 | MH0006_GL0117755 | SEQ ID NO: 1172 |
| CAG00079 | T2D-10A_GL0041736 | SEQ ID NO: 1173 |
| CAG00079 | MH0020_GL0022084 | SEQ ID NO: 1174 |
| CAG00079 | MH0006_GL0169081 | SEQ ID NO: 1175 |
| CAG00079 | MH0020_GL0045499 | SEQ ID NO: 1176 |
| CAG00393 | MH0455_GL0014920 | SEQ ID NO: 1177 |
| CAG00393 | MH0010_GL0006771 | SEQ ID NO: 1178 |
| CAG00393 | MH0010_GL0019638 | SEQ ID NO: 1179 |
| CAG00393 | 764285508-stool1_revised_scaffold26788_1_gene82388 | SEQ ID NO: 1180 |
| CAG00393 | MH0010_GL0008861 | SEQ ID NO: 1181 |
| CAG00393 | MH0010_GL0038429 | SEQ ID NO: 1182 |
| CAG00393 | MH0010_GL0039855 | SEQ ID NO: 1183 |
| CAG00393 | MH0451_GL0172720 | SEQ ID NO: 1184 |
| CAG00393 | O2.UC58-2_GL0156633 | SEQ ID NO: 1185 |
| CAG00393 | MH0010_GL0035092 | SEQ ID NO: 1186 |
| CAG00393 | MH0412_GL0061734 | SEQ ID NO: 1187 |
| CAG00393 | MH0021_GL0029491 | SEQ ID NO: 1188 |
| CAG00393 | MH0010_GL0027185 | SEQ ID NO: 1189 |
| CAG00393 | MH0076_GL0069584 | SEQ ID NO: 1190 |
| CAG00393 | MH0076_GL0023849 | SEQ ID NO: 1191 |
| CAG00393 | MH0010_GL0004096 | SEQ ID NO: 1192 |
| CAG00393 | MH0010_GL0043784 | SEQ ID NO: 1193 |
| CAG00393 | MH0010_GL0039245 | SEQ ID NO: 1194 |
| CAG00393 | O2.UC40-1_GL0172758 | SEQ ID NO: 1195 |
| CAG00393 | MH0010_GL0000174 | SEQ ID NO: 1196 |
| CAG00393 | MH0010_GL0044855 | SEQ ID NO: 1197 |
| CAG00393 | MH0010_GL0016776 | SEQ ID NO: 1198 |
| CAG00393 | MH0010_GL0017732 | SEQ ID NO: 1199 |
| CAG00393 | T2D-54A_GL0005082 | SEQ ID NO: 1200 |
| CAG00393 | MH0010_GL0007485 | SEQ ID NO: 1201 |
| CAG00393 | DLM008_GL0038553 | SEQ ID NO: 1202 |
| CAG00393 | MH0345_GL0003914 | SEQ ID NO: 1203 |
| CAG00393 | MH0010_GL0018041 | SEQ ID NO: 1204 |
| CAG00393 | MH0010_GL0029248 | SEQ ID NO: 1205 |
| CAG00393 | MH0316_GL0156730 | SEQ ID NO: 1206 |
| CAG00393 | O2.UC14-2_GL0059182 | SEQ ID NO: 1207 |
| CAG00393 | NLF013_GL0025166 | SEQ ID NO: 1208 |
| CAG00393 | T2D-149A_GL0031274 | SEQ ID NO: 1209 |
| CAG00393 | MH0148_GL0152134 | SEQ ID NO: 1210 |
| CAG00393 | MH0224_GL0195949 | SEQ ID NO: 1211 |
| CAG00393 | MH0454_GL0222405 | SEQ ID NO: 1212 |
| CAG00393 | MH0094_GL0112338 | SEQ ID NO: 1213 |
| CAG00393 | MH0010_GL0011210 | SEQ ID NO: 1214 |
| CAG00393 | MH0010_GL0028548 | SEQ ID NO: 1215 |
| CAG00393 | MH0010_GL0015291 | SEQ ID NO: 1216 |
| CAG00393 | MH0345_GL0126419 | SEQ ID NO: 1217 |
| CAG00393 | O2.UC14-2_GL0085563 | SEQ ID NO: 1218 |
| CAG00393 | NOF008_GL0002843 | SEQ ID NO: 1219 |
| CAG00393 | MH0234_GL0001308 | SEQ ID NO: 1220 |
| CAG00393 | MH0010_GL0029233 | SEQ ID NO: 1221 |
| CAG00393 | MH0115_GL0015508 | SEQ ID NO: 1222 |
| CAG00393 | MH0010_GL0035190 | SEQ ID NO: 1223 |
| CAG00393 | MH0010_GL0017083 | SEQ ID NO: 1224 |
| CAG00393 | MH0276_GL0232709 | SEQ ID NO: 1225 |
| CAG00393 | MH0021_GL0021690 | SEQ ID NO: 1226 |
| CAG00766 | 763901136-stool1_revised_scaffold25610_1_gene21731 | SEQ ID NO: 1227 |
| CAG00766 | MH0012_GL0082825 | SEQ ID NO: 1228 |
| CAG00766 | MH0012_GL0213577 | SEQ ID NO: 1229 |
| CAG00766 | MH0224_GL0006730 | SEQ ID NO: 1230 |
| CAG00766 | MH0012_GL0215773 | SEQ ID NO: 1231 |
| CAG00766 | MH0142_GL0028426 | SEQ ID NO: 1232 |
| CAG00766 | MH0118_GL0100408 | SEQ ID NO: 1233 |
| CAG00766 | MH0185_GL0091951 | SEQ ID NO: 1234 |
| CAG00766 | MH0012_GL0000190 | SEQ ID NO: 1235 |
| CAG00766 | MH0438_GL0006701 | SEQ ID NO: 1236 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00766 | MH0280_GL0150979 | SEQ ID NO: 1237 |
| CAG00766 | MH0012_GL0069123 | SEQ ID NO: 1238 |
| CAG00766 | MH0053_GL0026412 | SEQ ID NO: 1239 |
| CAG00766 | MH0012_GL0226816 | SEQ ID NO: 1240 |
| CAG00766 | 765701615-stool1_revised_scaffold24399_1_gene45416 | SEQ ID NO: 1241 |
| CAG00766 | MH0117_GL0073357 | SEQ ID NO: 1242 |
| CAG00766 | MH0142_GL0001380 | SEQ ID NO: 1243 |
| CAG00766 | MH0378_GL0128532 | SEQ ID NO: 1244 |
| CAG00766 | MH0329_GL0162954 | SEQ ID NO: 1245 |
| CAG00766 | MH0004_GL0025979 | SEQ ID NO: 1246 |
| CAG00766 | MH0012_GL0129416 | SEQ ID NO: 1247 |
| CAG00766 | MH0012_GL0070480 | SEQ ID NO: 1248 |
| CAG00766 | MH0446_GL0199336 | SEQ ID NO: 1249 |
| CAG00766 | O2.UC47-1_GL0073293 | SEQ ID NO: 1250 |
| CAG00766 | O2.UC57-0_GL0047837 | SEQ ID NO: 1251 |
| CAG00766 | MH0142_GL0077412 | SEQ ID NO: 1252 |
| CAG00766 | MH0204_GL0111428 | SEQ ID NO: 1253 |
| CAG00766 | MH0104_GL0101995 | SEQ ID NO: 1254 |
| CAG00766 | MH0220_GL0102755 | SEQ ID NO: 1255 |
| CAG00766 | MH0144_GL0113742 | SEQ ID NO: 1256 |
| CAG00766 | MH0454_GL0245294 | SEQ ID NO: 1257 |
| CAG00766 | V1.FI14_GL0156093 | SEQ ID NO: 1258 |
| CAG00766 | V1.FI07_GL0136264 | SEQ ID NO: 1259 |
| CAG00766 | MH0006_GL0193781 | SEQ ID NO: 1260 |
| CAG00766 | MH0012_GL0200508 | SEQ ID NO: 1261 |
| CAG00766 | MH0012_GL0166994 | SEQ ID NO: 1262 |
| CAG00766 | MH0012_GL0228079 | SEQ ID NO: 1263 |
| CAG00766 | MH0383_GL0051378 | SEQ ID NO: 1264 |
| CAG00766 | MH0193_GL0073874 | SEQ ID NO: 1265 |
| CAG00766 | MH0012_GL0082824 | SEQ ID NO: 1266 |
| CAG00766 | MH0193_GL0027357 | SEQ ID NO: 1267 |
| CAG00766 | O2.UC13-2_GL0031768 | SEQ ID NO: 1268 |
| CAG00766 | O2.UC40-1_GL0192463 | SEQ ID NO: 1269 |
| CAG00766 | MH0394_GL0042591 | SEQ ID NO: 1270 |
| CAG00766 | MH0012_GL0031924 | SEQ ID NO: 1271 |
| CAG00766 | MH0229_GL0107290 | SEQ ID NO: 1272 |
| CAG00766 | O2.UC47-1_GL0095795 | SEQ ID NO: 1273 |
| CAG00766 | MH0220_GL0074700 | SEQ ID NO: 1274 |
| CAG00766 | MH0117_GL0107140 | SEQ ID NO: 1275 |
| CAG00766 | MH0272_GL0100309 | SEQ ID NO: 1276 |
| CAG00095 | MH0089_GL0046375 | SEQ ID NO: 1277 |
| CAG00095 | O2.UC28-0_GL0179744 | SEQ ID NO: 1278 |
| CAG00095 | MH0066_GL0040803 | SEQ ID NO: 1279 |
| CAG00095 | MH0089_GL0043771 | SEQ ID NO: 1280 |
| CAG00095 | MH0182_GL0033199 | SEQ ID NO: 1281 |
| CAG00095 | MH0066_GL0054638 | SEQ ID NO: 1282 |
| CAG00095 | MH0089_GL0066960 | SEQ ID NO: 1283 |
| CAG00095 | MH0262_GL0027791 | SEQ ID NO: 1284 |
| CAG00095 | N034A_GL0043072 | SEQ ID NO: 1285 |
| CAG00095 | N037A_GL0059379 | SEQ ID NO: 1286 |
| CAG00095 | MH0089_GL0002779 | SEQ ID NO: 1287 |
| CAG00095 | 763840445-stool2_revised_scaffold52492_2_gene169926 | SEQ ID NO: 1288 |
| CAG00095 | MH0089_GL0064602 | SEQ ID NO: 1289 |
| CAG00095 | MH0089_GL0047899 | SEQ ID NO: 1290 |
| CAG00095 | MH0089_GL0107661 | SEQ ID NO: 1291 |
| CAG00095 | O2.UC50-0_GL0090229 | SEQ ID NO: 1292 |
| CAG00095 | MH0089_GL0032534 | SEQ ID NO: 1293 |
| CAG00095 | MH0089_GL0108397 | SEQ ID NO: 1294 |
| CAG00095 | MH0066_GL0054655 | SEQ ID NO: 1295 |
| CAG00095 | MH0089_GL0074632 | SEQ ID NO: 1296 |
| CAG00095 | 159247771-stool1_revised_C643738_1_gene47371 | SEQ ID NO: 1297 |
| CAG00095 | MH0343_GL0066333 | SEQ ID NO: 1298 |
| CAG00095 | MH0089_GL0067108 | SEQ ID NO: 1299 |
| CAG00095 | 764588959-stool1_revised_C754420_1_gene104384 | SEQ ID NO: 1300 |
| CAG00095 | MH0089_GL0056811 | SEQ ID NO: 1301 |
| CAG00095 | MH0089_GL0099404 | SEQ ID NO: 1302 |
| CAG00095 | V1.CD2-0-PT_GL0013676 | SEQ ID NO: 1303 |
| CAG00095 | MH0262_GL0119556 | SEQ ID NO: 1304 |
| CAG00095 | MH0089_GL0013544 | SEQ ID NO: 1305 |
| CAG00095 | 764184357-stool1_revised_scaffold1841_11_gene14991 | SEQ ID NO: 1306 |
| CAG00095 | MH0182_GL0006395 | SEQ ID NO: 1307 |
| CAG00095 | MH0182_GL0048904 | SEQ ID NO: 1308 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00095 | 158944319-stool1_revised_scaffold26376_1_gene108987 | SEQ ID NO: 1309 |
| CAG00095 | MH0395_GL0116427 | SEQ ID NO: 1310 |
| CAG00095 | MH0262_GL0046339 | SEQ ID NO: 1311 |
| CAG00095 | MH0182_GL0017395 | SEQ ID NO: 1312 |
| CAG00095 | MH0182_GL0056494 | SEQ ID NO: 1313 |
| CAG00095 | MH0262_GL0136800 | SEQ ID NO: 1314 |
| CAG00095 | MH0089_GL0013064 | SEQ ID NO: 1315 |
| CAG00095 | MH0437_GL0086387 | SEQ ID NO: 1316 |
| CAG00095 | V1.CD2-0-PT_GL0041810 | SEQ ID NO: 1317 |
| CAG00095 | MH0089_GL0055816 | SEQ ID NO: 1318 |
| CAG00095 | V1.FI16_GL0098417 | SEQ ID NO: 1319 |
| CAG00095 | MH0089_GL0074324 | SEQ ID NO: 1320 |
| CAG00095 | MH0182_GL0040920 | SEQ ID NO: 1321 |
| CAG00095 | DLF004_GL0024691 | SEQ ID NO: 1322 |
| CAG00095 | N038A_GL0029176 | SEQ ID NO: 1323 |
| CAG00095 | MH0089_GL0034070 | SEQ ID NO: 1324 |
| CAG00095 | V1.CD2-0-PT_GL0091669 | SEQ ID NO: 1325 |
| CAG00095 | MH0437_GL0249840 | SEQ ID NO: 1326 |
| CAG00010_1 | MH0217_GL0019688 | SEQ ID NO: 1327 |
| CAG00010_1 | MH0217_GL0077941 | SEQ ID NO: 1328 |
| CAG00010_1 | MH0217_GL0131423 | SEQ ID NO: 1329 |
| CAG00010_1 | MH0217_GL0149562 | SEQ ID NO: 1330 |
| CAG00010_1 | MH0217_GL0100632 | SEQ ID NO: 1331 |
| CAG00010_1 | MH0217_GL0025975 | SEQ ID NO: 1332 |
| CAG00010_1 | MH0217_GL0126762 | SEQ ID NO: 1333 |
| CAG00010_1 | MH0217_GL0169704 | SEQ ID NO: 1334 |
| CAG00010_1 | MH0217_GL0176618 | SEQ ID NO: 1335 |
| CAG00010_1 | MH0217_GL0178868 | SEQ ID NO: 1336 |
| CAG00010_1 | MH0217_GL0180478 | SEQ ID NO: 1337 |
| CAG00010_1 | MH0217_GL0126187 | SEQ ID NO: 1338 |
| CAG00010_1 | MH0217_GL0178866 | SEQ ID NO: 1339 |
| CAG00010_1 | MH0217_GL0052006 | SEQ ID NO: 1340 |
| CAG00010_1 | MH0217_GL0061698 | SEQ ID NO: 1341 |
| CAG00010_1 | MH0217_GL0022762 | SEQ ID NO: 1342 |
| CAG00010_1 | MH0217_GL0019681 | SEQ ID NO: 1343 |
| CAG00010_1 | MH0217_GL0027380 | SEQ ID NO: 1344 |
| CAG00010_1 | MH0217_GL0123421 | SEQ ID NO: 1345 |
| CAG00010_1 | MH0217_GL0013322 | SEQ ID NO: 1346 |
| CAG00010_1 | MH0217_GL0060985 | SEQ ID NO: 1347 |
| CAG00010_1 | MH0217_GL0126419 | SEQ ID NO: 1348 |
| CAG00010_1 | MH0217_GL0065183 | SEQ ID NO: 1349 |
| CAG00010_1 | MH0217_GL0061898 | SEQ ID NO: 1350 |
| CAG00010_1 | MH0217_GL0049289 | SEQ ID NO: 1351 |
| CAG00010_1 | MH0217_GL0002063 | SEQ ID NO: 1352 |
| CAG00010_1 | MH0217_GL0018343 | SEQ ID NO: 1353 |
| CAG00010_1 | MH0217_GL0038438 | SEQ ID NO: 1354 |
| CAG00010_1 | MH0217_GL0004399 | SEQ ID NO: 1355 |
| CAG00010_1 | MH0217_GL0145674 | SEQ ID NO: 1356 |
| CAG00010_1 | MH0217_GL0176617 | SEQ ID NO: 1357 |
| CAG00010_1 | MH0217_GL0105375 | SEQ ID NO: 1358 |
| CAG00010_1 | MH0217_GL0052153 | SEQ ID NO: 1359 |
| CAG00010_1 | MH0217_GL0052144 | SEQ ID NO: 1360 |
| CAG00010_1 | MH0217_GL0146664 | SEQ ID NO: 1361 |
| CAG00010_1 | MH0217_GL0025977 | SEQ ID NO: 1362 |
| CAG00010_1 | MH0217_GL0147606 | SEQ ID NO: 1363 |
| CAG00010_1 | MH0217_GL0154145 | SEQ ID NO: 1364 |
| CAG00010_1 | MH0217_GL0152825 | SEQ ID NO: 1365 |
| CAG00010_1 | MH0217_GL0062706 | SEQ ID NO: 1366 |
| CAG00010_1 | MH0217_GL0160566 | SEQ ID NO: 1367 |
| CAG00010_1 | MH0217_GL0059626 | SEQ ID NO: 1368 |
| CAG00010_1 | MH0217_GL0127172 | SEQ ID NO: 1369 |
| CAG00010_1 | MH0217_GL0131064 | SEQ ID NO: 1370 |
| CAG00010_1 | MH0217_GL0070524 | SEQ ID NO: 1371 |
| CAG00010_1 | MH0217_GL0117215 | SEQ ID NO: 1372 |
| CAG00010_1 | MH0217_GL0163595 | SEQ ID NO: 1373 |
| CAG00010_1 | MH0217_GL0035863 | SEQ ID NO: 1374 |
| CAG00010_1 | MH0217_GL0183396 | SEQ ID NO: 1375 |
| CAG00010_1 | MH0217_GL0127175 | SEQ ID NO: 1376 |
| CAG00342 | MH0230_GL0150634 | SEQ ID NO: 1377 |
| CAG00342 | 547043.BIFPSEUDO_02724 | SEQ ID NO: 1378 |
| CAG00342 | MH0356_GL0195431 | SEQ ID NO: 1379 |
| CAG00342 | MH0356_GL0045072 | SEQ ID NO: 1380 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG00342 | V1.CD7-4_GL0062303 | SEQ ID NO: 1381 |
| CAG00342 | MH0206_GL0250797 | SEQ ID NO: 1382 |
| CAG00342 | MH0327_GL0032691 | SEQ ID NO: 1383 |
| CAG00342 | O2.UC26-0_GL0000164 | SEQ ID NO: 1384 |
| CAG00342 | MH0230_GL0066319 | SEQ ID NO: 1385 |
| CAG00342 | 547043.BIFPSEUDO_03586 | SEQ ID NO: 1386 |
| CAG00342 | O2.UC50-2_GL0080535 | SEQ ID NO: 1387 |
| CAG00342 | T2D-51A_GL0104197 | SEQ ID NO: 1388 |
| CAG00342 | MH0440_GL0182133 | SEQ ID NO: 1389 |
| CAG00342 | MH0230_GL0057594 | SEQ ID NO: 1390 |
| CAG00342 | MH0356_GL0185430 | SEQ ID NO: 1391 |
| CAG00342 | MH0206_GL0011184 | SEQ ID NO: 1392 |
| CAG00342 | ED19A_GL0013066 | SEQ ID NO: 1393 |
| CAG00342 | ED50A_GL0042638 | SEQ ID NO: 1394 |
| CAG00342 | V1.UC42-0_GL0042202 | SEQ ID NO: 1395 |
| CAG00342 | T2D-26A_GL0091258 | SEQ ID NO: 1396 |
| CAG00342 | V1.FI01_GL0085884 | SEQ ID NO: 1397 |
| CAG00342 | 547043.BIFPSEUDO_04297 | SEQ ID NO: 1398 |
| CAG00342 | MH0410_GL0081324 | SEQ ID NO: 1399 |
| CAG00342 | MH0356_GL0171913 | SEQ ID NO: 1400 |
| CAG00342 | BGI-06A_GL0016424 | SEQ ID NO: 1401 |
| CAG00342 | V1.UC37-0_GL0033386 | SEQ ID NO: 1402 |
| CAG00342 | V1.FI19_GL0029304 | SEQ ID NO: 1403 |
| CAG00342 | MH0410_GL0116975 | SEQ ID NO: 1404 |
| CAG00342 | MH0230_GL0150631 | SEQ ID NO: 1405 |
| CAG00342 | MH0440_GL0194775 | SEQ ID NO: 1406 |
| CAG00342 | V1.CD51-0_GL0182145 | SEQ ID NO: 1407 |
| CAG00342 | O2.UC19-1_GL0006286 | SEQ ID NO: 1408 |
| CAG00342 | 547043.BIFPSEUDO_02929 | SEQ ID NO: 1409 |
| CAG00342 | MH0356_GL0168645 | SEQ ID NO: 1410 |
| CAG00342 | V1.UC42-0_GL0019213 | SEQ ID NO: 1411 |
| CAG00342 | T2D-42A_GL0082631 | SEQ ID NO: 1412 |
| CAG00342 | MH0356_GL0141025 | SEQ ID NO: 1413 |
| CAG00342 | MH0327_GL0080409 | SEQ ID NO: 1414 |
| CAG00342 | DOF008_GL0012509 | SEQ ID NO: 1415 |
| CAG00342 | V1.CD2-0-PT_GL0009310 | SEQ ID NO: 1416 |
| CAG00342 | MH0230_GL0041022 | SEQ ID NO: 1417 |
| CAG00342 | MH0230_GL0041821 | SEQ ID NO: 1418 |
| CAG00342 | MH0327_GL0110337 | SEQ ID NO: 1419 |
| CAG00342 | MH0230_GL0144175 | SEQ ID NO: 1420 |
| CAG00342 | MH0230_GL0087113 | SEQ ID NO: 1421 |
| CAG00342 | MH0356_GL0133287 | SEQ ID NO: 1422 |
| CAG00342 | MH0327_GL0115075 | SEQ ID NO: 1423 |
| CAG00342 | MH0230_GL0122733 | SEQ ID NO: 1424 |
| CAG00342 | MH0356_GL0133291 | SEQ ID NO: 1425 |
| CAG00342 | 547043.BIFPSEUDO_04379 | SEQ ID NO: 1426 |
| CAG00303 | MH0345_GL0025069 | SEQ ID NO: 1427 |
| CAG00303 | MH0277_GL0043561 | SEQ ID NO: 1428 |
| CAG00303 | MH0277_GL0017994 | SEQ ID NO: 1429 |
| CAG00303 | MH0277_GL0035656 | SEQ ID NO: 1430 |
| CAG00303 | MH0345_GL0168665 | SEQ ID NO: 1431 |
| CAG00303 | MH0277_GL0005474 | SEQ ID NO: 1432 |
| CAG00303 | MH0277_GL0014131 | SEQ ID NO: 1433 |
| CAG00303 | MH0345_GL0161902 | SEQ ID NO: 1434 |
| CAG00303 | MH0277_GL0045721 | SEQ ID NO: 1435 |
| CAG00303 | V1.UC32-0_GL0068347 | SEQ ID NO: 1436 |
| CAG00303 | MH0277_GL0015253 | SEQ ID NO: 1437 |
| CAG00303 | MH0277_GL0027237 | SEQ ID NO: 1438 |
| CAG00303 | MH0277_GL0030721 | SEQ ID NO: 1439 |
| CAG00303 | MH0277_GL0037357 | SEQ ID NO: 1440 |
| CAG00303 | MH0277_GL0033151 | SEQ ID NO: 1441 |
| CAG00303 | MH0277_GL0047657 | SEQ ID NO: 1442 |
| CAG00303 | MH0277_GL0042255 | SEQ ID NO: 1443 |
| CAG00303 | MH0277_GL0001264 | SEQ ID NO: 1444 |
| CAG00303 | MH0345_GL0051193 | SEQ ID NO: 1445 |
| CAG00303 | MH0277_GL0027760 | SEQ ID NO: 1446 |
| CAG00303 | MH0277_GL0037876 | SEQ ID NO: 1447 |
| CAG00303 | MH0277_GL0043562 | SEQ ID NO: 1448 |
| CAG00303 | MH0277_GL0022738 | SEQ ID NO: 1449 |
| CAG00303 | MH0277_GL0025210 | SEQ ID NO: 1450 |
| CAG00303 | V1.UC22-1_GL0059013 | SEQ ID NO: 1451 |
| CAG00303 | V1.UC22-1_GL0009470 | SEQ ID NO: 1452 |

TABLE 2A-continued

Shows the bacterial genes used for characterizing bacteria co-abundance
gene groups (CAG) and the corresponding SEQ ID NO for each gene
in the bacteria of interest. Each of the listed CAG group and
gene is available on the world wide web at meta.genomics.cn/meta/dataTools,
and is incorporated herein by reference.

| CAG ID | gene_name | SEQ ID |
| --- | --- | --- |
| CAG00303 | MH0277_GL0033800 | SEQ ID NO: 1453 |
| CAG00303 | MH0277_GL0021102 | SEQ ID NO: 1454 |
| CAG00303 | MH0277_GL0013995 | SEQ ID NO: 1455 |
| CAG00303 | MH0277_GL0044358 | SEQ ID NO: 1456 |
| CAG00303 | MH0277_GL0010535 | SEQ ID NO: 1457 |
| CAG00303 | MH0277_GL0000564 | SEQ ID NO: 1458 |
| CAG00303 | MH0277_GL0054679 | SEQ ID NO: 1459 |
| CAG00303 | MH0345_GL0148022 | SEQ ID NO: 1460 |
| CAG00303 | MH0277_GL0009451 | SEQ ID NO: 1461 |
| CAG00303 | MH0277_GL0018866 | SEQ ID NO: 1462 |
| CAG00303 | MH0277_GL0002843 | SEQ ID NO: 1463 |
| CAG00303 | MH0277_GL0014642 | SEQ ID NO: 1464 |
| CAG00303 | MH0277_GL0052775 | SEQ ID NO: 1465 |
| CAG00303 | V1.CD19-0_GL0089683 | SEQ ID NO: 1466 |
| CAG00303 | MH0277_GL0002630 | SEQ ID NO: 1467 |
| CAG00303 | V1.UC32-0_GL0160339 | SEQ ID NO: 1468 |
| CAG00303 | MH0277_GL0037875 | SEQ ID NO: 1469 |
| CAG00303 | MH0277_GL0026333 | SEQ ID NO: 1470 |
| CAG00303 | MH0277_GL0033234 | SEQ ID NO: 1471 |
| CAG00303 | MH0277_GL0002101 | SEQ ID NO: 1472 |
| CAG00303 | MH0277_GL0055650 | SEQ ID NO: 1473 |
| CAG00303 | MH0345_GL0085012 | SEQ ID NO: 1474 |
| CAG00303 | MH0345_GL0140542 | SEQ ID NO: 1475 |
| CAG00303 | MH0277_GL0026993 | SEQ ID NO: 1476 |
| CAG00337 | MH0212_GL0140047 | SEQ ID NO: 1477 |
| CAG00337 | MH0212_GL0034625 | SEQ ID NO: 1478 |
| CAG00337 | MH0088_GL0006484 | SEQ ID NO: 1479 |
| CAG00337 | V1.FI13_GL0016516 | SEQ ID NO: 1480 |
| CAG00337 | MH0212_GL0131896 | SEQ ID NO: 1481 |
| CAG00337 | MH0088_GL0029891 | SEQ ID NO: 1482 |
| CAG00337 | MH0212_GL0104669 | SEQ ID NO: 1483 |
| CAG00337 | MH0212_GL0007141 | SEQ ID NO: 1484 |
| CAG00337 | MH0088_GL0118880 | SEQ ID NO: 1485 |
| CAG00337 | MH0212_GL0034404 | SEQ ID NO: 1486 |
| CAG00337 | MH0212_GL0008981 | SEQ ID NO: 1487 |
| CAG00337 | MH0088_GL0075588 | SEQ ID NO: 1488 |
| CAG00337 | MH0212_GL0168155 | SEQ ID NO: 1489 |
| CAG00337 | MH0212_GL0016239 | SEQ ID NO: 1490 |
| CAG00337 | V1.FI13_GL0150099 | SEQ ID NO: 1491 |
| CAG00337 | V1.FI13_GL0005226 | SEQ ID NO: 1492 |
| CAG00337 | MH0088_GL0056538 | SEQ ID NO: 1493 |
| CAG00337 | MH0088_GL0064137 | SEQ ID NO: 1494 |
| CAG00337 | MH0212_GL0131813 | SEQ ID NO: 1495 |
| CAG00337 | MH0212_GL0094592 | SEQ ID NO: 1496 |
| CAG00337 | MH0212_GL0150396 | SEQ ID NO: 1497 |
| CAG00337 | MH0212_GL0007716 | SEQ ID NO: 1498 |
| CAG00337 | MH0358_GL0041328 | SEQ ID NO: 1499 |
| CAG00337 | V1.FI13_GL0069720 | SEQ ID NO: 1500 |
| CAG00337 | MH0212_GL0119553 | SEQ ID NO: 1501 |
| CAG00337 | MH0358_GL0051225 | SEQ ID NO: 1502 |
| CAG00337 | MH0212_GL0161055 | SEQ ID NO: 1503 |
| CAG00337 | MH0212_GL0034621 | SEQ ID NO: 1504 |
| CAG00337 | MH0212_GL0124894 | SEQ ID NO: 1505 |
| CAG00337 | MH0212_GL0140315 | SEQ ID NO: 1506 |
| CAG00337 | MH0212_GL0120377 | SEQ ID NO: 1507 |
| CAG00337 | V1.FI13_GL0107233 | SEQ ID NO: 1508 |
| CAG00337 | MH0212_GL0024275 | SEQ ID NO: 1509 |
| CAG00337 | V1.FI11_GL0100921 | SEQ ID NO: 1510 |
| CAG00337 | MH0212_GL0049197 | SEQ ID NO: 1511 |
| CAG00337 | MH0088_GL0131171 | SEQ ID NO: 1512 |
| CAG00337 | V1.FI11_GL0025056 | SEQ ID NO: 1513 |
| CAG00337 | MH0212_GL0039936 | SEQ ID NO: 1514 |
| CAG00337 | MH0212_GL0016237 | SEQ ID NO: 1515 |
| CAG00337 | MH0088_GL0111816 | SEQ ID NO: 1516 |
| CAG00337 | MH0212_GL0090580 | SEQ ID NO: 1517 |
| CAG00337 | MH0212_GL0133270 | SEQ ID NO: 1518 |
| CAG00337 | MH0212_GL0084814 | SEQ ID NO: 1519 |
| CAG00337 | MH0088_GL0080625 | SEQ ID NO: 1520 |
| CAG00337 | MH0212_GL0126560 | SEQ ID NO: 1521 |
| CAG00337 | MH0088_GL0010923 | SEQ ID NO: 1522 |
| CAG00337 | MH0358_GL0044332 | SEQ ID NO: 1523 |
| CAG00337 | MH0212_GL0030833 | SEQ ID NO: 1524 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG00337 | MH0088__GL0100711 | SEQ ID NO: 1525 |
| CAG00337 | MH0212__GL0036263 | SEQ ID NO: 1526 |
| CAG00381 | MH0233__GL0095998 | SEQ ID NO: 1527 |
| CAG00381 | MH0233__GL0113533 | SEQ ID NO: 1528 |
| CAG00381 | MH0233__GL0113359 | SEQ ID NO: 1529 |
| CAG00381 | MH0233__GL0065305 | SEQ ID NO: 1530 |
| CAG00381 | MH0233__GL0117231 | SEQ ID NO: 1531 |
| CAG00381 | MH0233__GL0113826 | SEQ ID NO: 1532 |
| CAG00381 | MH0233__GL0065304 | SEQ ID NO: 1533 |
| CAG00381 | MH0233__GL0003883 | SEQ ID NO: 1534 |
| CAG00381 | MH0233__GL0028807 | SEQ ID NO: 1535 |
| CAG00381 | MH0233__GL0028855 | SEQ ID NO: 1536 |
| CAG00381 | MH0233__GL0091862 | SEQ ID NO: 1537 |
| CAG00381 | MH0233__GL0113327 | SEQ ID NO: 1538 |
| CAG00381 | MH0233__GL0119203 | SEQ ID NO: 1539 |
| CAG00381 | O2.UC48-0__GL0255960 | SEQ ID NO: 1540 |
| CAG00381 | MH0233__GL0030526 | SEQ ID NO: 1541 |
| CAG00381 | O2.UC19-2__GL0100874 | SEQ ID NO: 1542 |
| CAG00381 | MH0233__GL0063420 | SEQ ID NO: 1543 |
| CAG00381 | O2.UC19-2__GL0003982 | SEQ ID NO: 1544 |
| CAG00381 | MH0233__GL0095983 | SEQ ID NO: 1545 |
| CAG00381 | MH0233__GL0056899 | SEQ ID NO: 1546 |
| CAG00381 | O2.UC36-0__GL0021124 | SEQ ID NO: 1547 |
| CAG00381 | MH0233__GL0011731 | SEQ ID NO: 1548 |
| CAG00381 | MH0233__GL0082238 | SEQ ID NO: 1549 |
| CAG00381 | MH0233__GL0113355 | SEQ ID NO: 1550 |
| CAG00381 | MH0358__GL0105021 | SEQ ID NO: 1551 |
| CAG00381 | MH0233__GL0007569 | SEQ ID NO: 1552 |
| CAG00381 | O2.UC36-0__GL0058223 | SEQ ID NO: 1553 |
| CAG00381 | MH0233__GL0060185 | SEQ ID NO: 1554 |
| CAG00381 | MH0233__GL0066846 | SEQ ID NO: 1555 |
| CAG00381 | MH0233__GL0091186 | SEQ ID NO: 1556 |
| CAG00381 | MH0233__GL0052995 | SEQ ID NO: 1557 |
| CAG00381 | MH0233__GL0103619 | SEQ ID NO: 1558 |
| CAG00381 | MH0233__GL0056698 | SEQ ID NO: 1559 |
| CAG00381 | O2.UC11-1__GL0112377 | SEQ ID NO: 1560 |
| CAG00381 | MH0233__GL0019862 | SEQ ID NO: 1561 |
| CAG00381 | MH0233__GL0103622 | SEQ ID NO: 1562 |
| CAG00381 | MH0233__GL0091850 | SEQ ID NO: 1563 |
| CAG00381 | O2.UC19-2__GL0008363 | SEQ ID NO: 1564 |
| CAG00381 | MH0233__GL0059183 | SEQ ID NO: 1565 |
| CAG00381 | MH0233__GL0091864 | SEQ ID NO: 1566 |
| CAG00381 | MH0233__GL0010836 | SEQ ID NO: 1567 |
| CAG00381 | MH0233__GL0056907 | SEQ ID NO: 1568 |
| CAG00381 | MH0233__GL0035462 | SEQ ID NO: 1569 |
| CAG00381 | MH0233__GL0090705 | SEQ ID NO: 1570 |
| CAG00381 | V1.FI04__GL0104012 | SEQ ID NO: 1571 |
| CAG00381 | MH0233__GL0066852 | SEQ ID NO: 1572 |
| CAG00381 | MH0233__GL0047497 | SEQ ID NO: 1573 |
| CAG00381 | V1.FI12__GL0203479 | SEQ ID NO: 1574 |
| CAG00381 | MH0233__GL0077085 | SEQ ID NO: 1575 |
| CAG00381 | MH0233__GL0091179 | SEQ ID NO: 1576 |
| CAG00559 | MH0012__GL0066180 | SEQ ID NO: 1577 |
| CAG00559 | MH0012__GL0237518 | SEQ ID NO: 1578 |
| CAG00559 | O2.UC52-2__GL0048590 | SEQ ID NO: 1579 |
| CAG00559 | 158944319-stool1__revised__C1045997__1__gene109890 | SEQ ID NO: 1580 |
| CAG00559 | MH0012__GL0074963 | SEQ ID NO: 1581 |
| CAG00559 | 160704339-stool1__revised__C1411799__1__gene84313 | SEQ ID NO: 1582 |
| CAG00559 | O2.UC47-1__GL0019033 | SEQ ID NO: 1583 |
| CAG00559 | MH0373__GL0172307 | SEQ ID NO: 1584 |
| CAG00559 | MH0453__GL0132208 | SEQ ID NO: 1585 |
| CAG00559 | MH0012__GL0128724 | SEQ ID NO: 1586 |
| CAG00559 | MH0252__GL0186374 | SEQ ID NO: 1587 |
| CAG00559 | MH0012__GL0090850 | SEQ ID NO: 1588 |
| CAG00559 | MH0012__GL0117901 | SEQ ID NO: 1589 |
| CAG00559 | MH0012__GL0103293 | SEQ ID NO: 1590 |
| CAG00559 | MH0012__GL0165258 | SEQ ID NO: 1591 |
| CAG00559 | MH0012__GL0234812 | SEQ ID NO: 1592 |
| CAG00559 | MH0422__GL0099033 | SEQ ID NO: 1593 |
| CAG00559 | MH0012__GL0212617 | SEQ ID NO: 1594 |
| CAG00559 | MH0012__GL0036355 | SEQ ID NO: 1595 |
| CAG00559 | MH0356__GL0155940 | SEQ ID NO: 1596 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00559 | MH0193_GL0127486 | SEQ ID NO: 1597 |
| CAG00559 | MH0262_GL0099379 | SEQ ID NO: 1598 |
| CAG00559 | O2.UC47-1_GL0011868 | SEQ ID NO: 1599 |
| CAG00559 | MH0206_GL0124420 | SEQ ID NO: 1600 |
| CAG00559 | SZEY-62A_GL0068587 | SEQ ID NO: 1601 |
| CAG00559 | MH0343_GL0006001 | SEQ ID NO: 1602 |
| CAG00559 | MH0096_GL0061137 | SEQ ID NO: 1603 |
| CAG00559 | O2.UC40-1_GL0194629 | SEQ ID NO: 1604 |
| CAG00559 | MH0012_GL0117904 | SEQ ID NO: 1605 |
| CAG00559 | MH0200_GL0191918 | SEQ ID NO: 1606 |
| CAG00559 | MH0012_GL0029892 | SEQ ID NO: 1607 |
| CAG00559 | N022A_GL0074028 | SEQ ID NO: 1608 |
| CAG00559 | V1.CD30-0_GL0091931 | SEQ ID NO: 1609 |
| CAG00559 | V1.CD6-0-PT_GL0145486 | SEQ ID NO: 1610 |
| CAG00559 | MH0303_GL0078484 | SEQ ID NO: 1611 |
| CAG00559 | MH0197_GL0156714 | SEQ ID NO: 1612 |
| CAG00559 | MH0434_GL0122412 | SEQ ID NO: 1613 |
| CAG00559 | MH0012_GL0108748 | SEQ ID NO: 1614 |
| CAG00559 | MH0012_GL0090852 | SEQ ID NO: 1615 |
| CAG00559 | MH0012_GL0237521 | SEQ ID NO: 1616 |
| CAG00559 | MH0193_GL0073226 | SEQ ID NO: 1617 |
| CAG00559 | SZEY-62A_GL0048973 | SEQ ID NO: 1618 |
| CAG00559 | MH0193_GL0045020 | SEQ ID NO: 1619 |
| CAG00559 | MH0430_GL0114903 | SEQ ID NO: 1620 |
| CAG00559 | MH0197_GL0045605 | SEQ ID NO: 1621 |
| CAG00559 | MH0012_GL0119351 | SEQ ID NO: 1622 |
| CAG00559 | MH0197_GL0122038 | SEQ ID NO: 1623 |
| CAG00559 | MH0012_GL0050082 | SEQ ID NO: 1624 |
| CAG00559 | MH0012_GL0103291 | SEQ ID NO: 1625 |
| CAG00559 | MH0451_GL0204212 | SEQ ID NO: 1626 |
| CAG00570 | 158337416-stool1_revised_C1240234_1_gene61382 | SEQ ID NO: 1627 |
| CAG00570 | MH0366_GL0014438 | SEQ ID NO: 1628 |
| CAG00570 | MH0366_GL0105096 | SEQ ID NO: 1629 |
| CAG00570 | MH0366_GL0142970 | SEQ ID NO: 1630 |
| CAG00570 | 158337416-stool1_revised_C1228438_1_gene210576 | SEQ ID NO: 1631 |
| CAG00570 | 158337416-stool1_revised_C1139104_1_gene171934 | SEQ ID NO: 1632 |
| CAG00570 | 158337416-stool1_revised_C1162436_1_gene157074 | SEQ ID NO: 1633 |
| CAG00570 | 158337416-stool1_revised_scaffold16772_1_gene138838 | SEQ ID NO: 1634 |
| CAG00570 | 158337416-stool1_revised_C1269936_1_gene164544 | SEQ ID NO: 1635 |
| CAG00570 | 158337416-stool1_revised_C1225906_1_gene110954 | SEQ ID NO: 1636 |
| CAG00570 | 160704339-stool1_revised_scaffold28351_1_gene137089 | SEQ ID NO: 1637 |
| CAG00570 | MH0366_GL0132869 | SEQ ID NO: 1638 |
| CAG00570 | MH0366_GL0070438 | SEQ ID NO: 1639 |
| CAG00570 | MH0366_GL0046120 | SEQ ID NO: 1640 |
| CAG00570 | 158337416-stool1_revised_scaffold19851_1_gene97170 | SEQ ID NO: 1641 |
| CAG00570 | 158337416-stool1_revised_C1149190_1_gene133843 | SEQ ID NO: 1642 |
| CAG00570 | 158337416-stool1_revised_C1203284_1_gene113710 | SEQ ID NO: 1643 |
| CAG00570 | MH0366_GL0009017 | SEQ ID NO: 1644 |
| CAG00570 | MH0366_GL0127883 | SEQ ID NO: 1645 |
| CAG00570 | 158337416-stool1_revised_scaffold7598_1_gene91220 | SEQ ID NO: 1646 |
| CAG00570 | MH0366_GL0078392 | SEQ ID NO: 1647 |
| CAG00570 | 158337416-stool1_revised_scaffold24453_1_gene65737 | SEQ ID NO: 1648 |
| CAG00570 | MH0366_GL0125454 | SEQ ID NO: 1649 |
| CAG00570 | 158337416-stool1_revised_C1254876_1_gene205094 | SEQ ID NO: 1650 |
| CAG00570 | 158337416-stool1_revised_scaffold9058_1_gene230576 | SEQ ID NO: 1651 |
| CAG00570 | MH0366_GL0089956 | SEQ ID NO: 1652 |
| CAG00570 | MH0366_GL0066569 | SEQ ID NO: 1653 |
| CAG00570 | 158337416-stool1_revised_scaffold22387_1_gene164973 | SEQ ID NO: 1654 |
| CAG00570 | 158337416-stool1_revised_scaffold22730_1_gene129709 | SEQ ID NO: 1655 |
| CAG00570 | 158337416-stool1_revised_scaffold1855_1_gene49512 | SEQ ID NO: 1656 |
| CAG00570 | MH0366_GL0141852 | SEQ ID NO: 1657 |
| CAG00570 | 160704339-stool1_revised_C1327971_1_gene36381 | SEQ ID NO: 1658 |
| CAG00570 | MH0454_GL0090493 | SEQ ID NO: 1659 |
| CAG00570 | 158337416-stool1_revised_C1197272_1_gene97970 | SEQ ID NO: 1660 |
| CAG00570 | MH0366_GL0133228 | SEQ ID NO: 1661 |
| CAG00570 | MH0366_GL0003291 | SEQ ID NO: 1662 |
| CAG00570 | MH0366_GL0069655 | SEQ ID NO: 1663 |
| CAG00570 | MH0366_GL0023679 | SEQ ID NO: 1664 |
| CAG00570 | MH0366_GL0135591 | SEQ ID NO: 1665 |
| CAG00570 | MH0366_GL0050575 | SEQ ID NO: 1666 |
| CAG00570 | MH0366_GL0009276 | SEQ ID NO: 1667 |
| CAG00570 | 158337416-stool1_revised_scaffold26304_1_gene216014 | SEQ ID NO: 1668 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG00570 | MH0366_GL0140044 | SEQ ID NO: 1669 |
| CAG00570 | 158337416-stool1_revised_C1218172_1_gene176424 | SEQ ID NO: 1670 |
| CAG00570 | 158337416-stool1_revised_C1230400_1_gene160962 | SEQ ID NO: 1671 |
| CAG00570 | 160704339-stool1_revised_C1340293_1_gene152978 | SEQ ID NO: 1672 |
| CAG00570 | MH0454_GL0213816 | SEQ ID NO: 1673 |
| CAG00570 | MH0366_GL0045814 | SEQ ID NO: 1674 |
| CAG00570 | MH0366_GL0128454 | SEQ ID NO: 1675 |
| CAG00570 | 158337416-stool1_revised_C1257214_1_gene57912 | SEQ ID NO: 1676 |
| CAG00635 | SZEY-74A_GL0013607 | SEQ ID NO: 1677 |
| CAG00635 | V1.FI13_GL0045803 | SEQ ID NO: 1678 |
| CAG00635 | 398513.BBNG_00128 | SEQ ID NO: 1679 |
| CAG00635 | O2.UC11-1_GL0162381 | SEQ ID NO: 1680 |
| CAG00635 | O2.UC11-2_GL0025924 | SEQ ID NO: 1681 |
| CAG00635 | V1.CD19-0_GL0184168 | SEQ ID NO: 1682 |
| CAG00635 | MH0341_GL0069432 | SEQ ID NO: 1683 |
| CAG00635 | MH0341_GL0008211 | SEQ ID NO: 1684 |
| CAG00635 | 883062.BBIF_1015 | SEQ ID NO: 1685 |
| CAG00635 | O2.UC3-1_GL0087195 | SEQ ID NO: 1686 |
| CAG00635 | O2.UC11-1_GL0059462 | SEQ ID NO: 1687 |
| CAG00635 | O2.UC11-1_GL0013718 | SEQ ID NO: 1688 |
| CAG00635 | O2.UC34-2_GL0006818 | SEQ ID NO: 1689 |
| CAG00635 | V1.FI17_GL0019390 | SEQ ID NO: 1690 |
| CAG00635 | MH0203_GL0030664 | SEQ ID NO: 1691 |
| CAG00635 | V1.CD15-3_GL0025660 | SEQ ID NO: 1692 |
| CAG00635 | 702459.BBPR_0958 | SEQ ID NO: 1693 |
| CAG00635 | O2.UC11-2_GL0084124 | SEQ ID NO: 1694 |
| CAG00635 | 398513.BBNG_00233 | SEQ ID NO: 1695 |
| CAG00635 | O2.UC3-0_GL0065679 | SEQ ID NO: 1696 |
| CAG00635 | O2.UC34-2_GL0070625 | SEQ ID NO: 1697 |
| CAG00635 | O2.UC3-0_GL0157811 | SEQ ID NO: 1698 |
| CAG00635 | MH0203_GL0216381 | SEQ ID NO: 1699 |
| CAG00635 | O2.UC11-2_GL0118283 | SEQ ID NO: 1700 |
| CAG00635 | V1.UC54-0_GL0091833 | SEQ ID NO: 1701 |
| CAG00635 | MH0341_GL0069076 | SEQ ID NO: 1702 |
| CAG00635 | O2.UC36-0_GL0157758 | SEQ ID NO: 1703 |
| CAG00635 | O2.UC11-1_GL0160585 | SEQ ID NO: 1704 |
| CAG00635 | O2.UC20-2_GL0014643 | SEQ ID NO: 1705 |
| CAG00635 | O2.UC36-0_GL0106717 | SEQ ID NO: 1706 |
| CAG00635 | 398513.BBNG_01392 | SEQ ID NO: 1707 |
| CAG00635 | 883062.BBIF_0260 | SEQ ID NO: 1708 |
| CAG00635 | BGI-06A_GL0020618 | SEQ ID NO: 1709 |
| CAG00635 | 883062.BBIF_0743 | SEQ ID NO: 1710 |
| CAG00635 | O2.UC11-1_GL0034723 | SEQ ID NO: 1711 |
| CAG00635 | O2.UC36-0_GL0135830 | SEQ ID NO: 1712 |
| CAG00635 | MH0203_GL0243009 | SEQ ID NO: 1713 |
| CAG00635 | V1.FI17_GL0217323 | SEQ ID NO: 1714 |
| CAG00635 | 398513.BBNG_01505 | SEQ ID NO: 1715 |
| CAG00635 | MH0161_GL0172217 | SEQ ID NO: 1716 |
| CAG00635 | O2.UC8-0_GL0116801 | SEQ ID NO: 1717 |
| CAG00635 | 702459.BBPR_1025 | SEQ ID NO: 1718 |
| CAG00635 | MH0203_GL0035804 | SEQ ID NO: 1719 |
| CAG00635 | O2.UC19-1_GL0047789 | SEQ ID NO: 1720 |
| CAG00635 | O2.UC8-0_GL0078403 | SEQ ID NO: 1721 |
| CAG00635 | O2.UC11-1_GL0067564 | SEQ ID NO: 1722 |
| CAG00635 | 702459.BBPR_0500 | SEQ ID NO: 1723 |
| CAG00635 | O2.UC11-2_GL0049242 | SEQ ID NO: 1724 |
| CAG00635 | MH0203_GL0222471 | SEQ ID NO: 1725 |
| CAG00635 | O2.UC36-0_GL0048522 | SEQ ID NO: 1726 |
| CAG00636 | MH0205_GL0155444 | SEQ ID NO: 1727 |
| CAG00636 | MH0098_GL0040145 | SEQ ID NO: 1728 |
| CAG00636 | MH0006_GL0151219 | SEQ ID NO: 1729 |
| CAG00636 | MH0205_GL0098023 | SEQ ID NO: 1730 |
| CAG00636 | MH0098_GL0033699 | SEQ ID NO: 1731 |
| CAG00636 | MH0098_GL0060936 | SEQ ID NO: 1732 |
| CAG00636 | MH0205_GL0074663 | SEQ ID NO: 1733 |
| CAG00636 | MH0006_GL0034135 | SEQ ID NO: 1734 |
| CAG00636 | MH0205_GL0033937 | SEQ ID NO: 1735 |
| CAG00636 | MH0098_GL0037973 | SEQ ID NO: 1736 |
| CAG00636 | MH0205_GL0081238 | SEQ ID NO: 1737 |
| CAG00636 | MH0098_GL0103935 | SEQ ID NO: 1738 |
| CAG00636 | MH0006_GL0103395 | SEQ ID NO: 1739 |
| CAG00636 | MH0250_GL0001435 | SEQ ID NO: 1740 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00636 | MH0205_GL0038215 | SEQ ID NO: 1741 |
| CAG00636 | MH0205_GL0155424 | SEQ ID NO: 1742 |
| CAG00636 | MH0205_GL0105586 | SEQ ID NO: 1743 |
| CAG00636 | MH0006_GL0015683 | SEQ ID NO: 1744 |
| CAG00636 | MH0098_GL0133499 | SEQ ID NO: 1745 |
| CAG00636 | MH0205_GL0073445 | SEQ ID NO: 1746 |
| CAG00636 | MH0006_GL0160459 | SEQ ID NO: 1747 |
| CAG00636 | MH0006_GL0105106 | SEQ ID NO: 1748 |
| CAG00636 | MH0410_GL0068910 | SEQ ID NO: 1749 |
| CAG00636 | MH0204_GL0106563 | SEQ ID NO: 1750 |
| CAG00636 | MH0006_GL0175311 | SEQ ID NO: 1751 |
| CAG00636 | MH0434_GL0073320 | SEQ ID NO: 1752 |
| CAG00636 | MH0205_GL0113435 | SEQ ID NO: 1753 |
| CAG00636 | MH0205_GL0143994 | SEQ ID NO: 1754 |
| CAG00636 | MH0006_GL0222862 | SEQ ID NO: 1755 |
| CAG00636 | MH0205_GL0041515 | SEQ ID NO: 1756 |
| CAG00636 | MH0098_GL0003062 | SEQ ID NO: 1757 |
| CAG00636 | MH0205_GL0146613 | SEQ ID NO: 1758 |
| CAG00636 | MH0006_GL0146322 | SEQ ID NO: 1759 |
| CAG00636 | MH0006_GL0198074 | SEQ ID NO: 1760 |
| CAG00636 | MH0205_GL0047838 | SEQ ID NO: 1761 |
| CAG00636 | MH0204_GL0009282 | SEQ ID NO: 1762 |
| CAG00636 | MH0204_GL0194250 | SEQ ID NO: 1763 |
| CAG00636 | MH0204_GL0144559 | SEQ ID NO: 1764 |
| CAG00636 | MH0006_GL0018871 | SEQ ID NO: 1765 |
| CAG00636 | MH0205_GL0158536 | SEQ ID NO: 1766 |
| CAG00636 | 159571453-stool2_revised_C1199086_1_gene7339 | SEQ ID NO: 1767 |
| CAG00636 | MH0205_GL0144498 | SEQ ID NO: 1768 |
| CAG00636 | MH0204_GL0176828 | SEQ ID NO: 1769 |
| CAG00636 | MH0086_GL0081171 | SEQ ID NO: 1770 |
| CAG00636 | MH0098_GL0073539 | SEQ ID NO: 1771 |
| CAG00636 | MH0006_GL0191234 | SEQ ID NO: 1772 |
| CAG00636 | MH0205_GL0068695 | SEQ ID NO: 1773 |
| CAG00636 | MH0006_GL0018233 | SEQ ID NO: 1774 |
| CAG00636 | MH0206_GL0061239 | SEQ ID NO: 1775 |
| CAG00636 | MH0006_GL0164383 | SEQ ID NO: 1776 |
| CAG00660 | 159551223-stool1_revised_scaffold36550_1_gene37802 | SEQ ID NO: 1777 |
| CAG00660 | 159551223-stool1_revised_scaffold39514_1_gene117926 | SEQ ID NO: 1778 |
| CAG00660 | 159551223-stool1_revised_scaffold34582_1_gene105320 | SEQ ID NO: 1779 |
| CAG00660 | 159551223-stool1_revised_scaffold3298_1_gene168956 | SEQ ID NO: 1780 |
| CAG00660 | 159551223-stool1_revised_scaffold34345_1_gene557 | SEQ ID NO: 1781 |
| CAG00660 | 159551223-stool1_revised_scaffold13073_2_gene99788 | SEQ ID NO: 1782 |
| CAG00660 | MH0403_GL083883 | SEQ ID NO: 1783 |
| CAG00660 | 159551223-stool1_revised_scaffold42896_1_gene32050 | SEQ ID NO: 1784 |
| CAG00660 | 159551223-stool1_revised_scaffold39675_1_gene99755 | SEQ ID NO: 1785 |
| CAG00660 | 159551223-stool1_revised_scaffold13073_1_gene107119 | SEQ ID NO: 1786 |
| CAG00660 | 159551223-stool1_revised_scaffold37687_1_gene84758 | SEQ ID NO: 1787 |
| CAG00660 | 159551223-stool1_revised_scaffold13073_2_gene99790 | SEQ ID NO: 1788 |
| CAG00660 | 159551223-stool1_revised_scaffold42962_1_gene51280 | SEQ ID NO: 1789 |
| CAG00660 | 159551223-stool1_revised_scaffold49831_4_gene7345 | SEQ ID NO: 1790 |
| CAG00660 | 159551223-stool1_revised_scaffold38343_1_gene43429 | SEQ ID NO: 1791 |
| CAG00660 | 159551223-stool1_revised_scaffold49831_3_gene104078 | SEQ ID NO: 1792 |
| CAG00660 | 159551223-stool1_revised_scaffold17948_8_gene139490 | SEQ ID NO: 1793 |
| CAG00660 | 159551223-stool1_revised_scaffold17805_1_gene151102 | SEQ ID NO: 1794 |
| CAG00660 | 159551223-stool1_revised_scaffold50270_2_gene111004 | SEQ ID NO: 1795 |
| CAG00660 | 159551223-stool1_revised_scaffold39986_2_gene53942 | SEQ ID NO: 1796 |
| CAG00660 | 159551223-stool1_revised_C1047407_1_gene121290 | SEQ ID NO: 1797 |
| CAG00660 | 159551223-stool1_revised_scaffold34582_1_gene105316 | SEQ ID NO: 1798 |
| CAG00660 | 159551223-stool1_revised_scaffold15409_1_gene119865 | SEQ ID NO: 1799 |
| CAG00660 | 159551223-stool1_revised_scaffold13073_2_gene99791 | SEQ ID NO: 1800 |
| CAG00660 | 763496533-stool2_revised_scaffold48134_1_gene30793 | SEQ ID NO: 1801 |
| CAG00660 | 159551223-stool1_revised_scaffold17948_7_gene103947 | SEQ ID NO: 1802 |
| CAG00660 | 159551223-stool1_revised_scaffold32985_1_gene115578 | SEQ ID NO: 1803 |
| CAG00660 | 159551223-stool1_revised_scaffold42600_1_gene152210 | SEQ ID NO: 1804 |
| CAG00660 | 159551223-stool1_revised_scaffold19684_1_gene33917 | SEQ ID NO: 1805 |
| CAG00660 | 159551223-stool1_revised_scaffold13073_1_gene107116 | SEQ ID NO: 1806 |
| CAG00660 | 159551223-stool1_revised_C1031143_1_gene28558 | SEQ ID NO: 1807 |
| CAG00660 | 159551223-stool1_revised_scaffold2508_1_gene78321 | SEQ ID NO: 1808 |
| CAG00660 | 159551223-stool1_revised_scaffold40336_1_gene3156 | SEQ ID NO: 1809 |
| CAG00660 | 159551223-stool1_revised_scaffold14052_1_gene127907 | SEQ ID NO: 1810 |
| CAG00660 | 159551223-stool1_revised_scaffold17948_7_gene103950 | SEQ ID NO: 1811 |
| CAG00660 | 159551223-stool1_revised_scaffold35611_1_gene108963 | SEQ ID NO: 1812 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00660 | 159551223-stool1_revised_scaffold34582_1_gene105317 | SEQ ID NO: 1813 |
| CAG00660 | 159551223-stool1_revised_scaffold19605_1_gene13629 | SEQ ID NO: 1814 |
| CAG00660 | 159551223-stool1_revised_scaffold36550_2_gene72111 | SEQ ID NO: 1815 |
| CAG00660 | 159551223-stool1_revised_scaffold4271_1_gene139339 | SEQ ID NO: 1816 |
| CAG00660 | 159551223-stool1_revised_scaffold49831_3_gene104079 | SEQ ID NO: 1817 |
| CAG00660 | 159551223-stool1_revised_scaffold34582_1_gene105318 | SEQ ID NO: 1818 |
| CAG00660 | 159551223-stool1_revised_scaffold5822_2_gene908 | SEQ ID NO: 1819 |
| CAG00660 | 159551223-stool1_revised_C1059513_1_gene104605 | SEQ ID NO: 1820 |
| CAG00660 | 763496533-stool2_revised_scaffold44269_1_gene30449 | SEQ ID NO: 1821 |
| CAG00660 | 159551223-stool1_revised_scaffold22937_2_gene164540 | SEQ ID NO: 1822 |
| CAG00660 | 159551223-stool1_revised_scaffold31901_1_gene90689 | SEQ ID NO: 1823 |
| CAG00660 | 159551223-stool1_revised_scaffold34582_1_gene105319 | SEQ ID NO: 1824 |
| CAG00660 | 159551223-stool1_revised_scaffold22937_3_gene150472 | SEQ ID NO: 1825 |
| CAG00660 | 159551223-stool1_revised_scaffold10714_2_gene35081 | SEQ ID NO: 1826 |
| CAG00669 | MH0367_GL0070731 | SEQ ID NO: 1827 |
| CAG00669 | MH0197_GL0129961 | SEQ ID NO: 1828 |
| CAG00669 | MH0197_GL0146043 | SEQ ID NO: 1829 |
| CAG00669 | T2D-47A_GL0061723 | SEQ ID NO: 1830 |
| CAG00669 | MH0197_GL0055241 | SEQ ID NO: 1831 |
| CAG00669 | MH0366_GL0036354 | SEQ ID NO: 1832 |
| CAG00669 | MH0197_GL0037877 | SEQ ID NO: 1833 |
| CAG00669 | MH0303_GL0074511 | SEQ ID NO: 1834 |
| CAG00669 | MH0197_GL0136603 | SEQ ID NO: 1835 |
| CAG00669 | MH0229_GL0129914 | SEQ ID NO: 1836 |
| CAG00669 | MH0197_GL0183681 | SEQ ID NO: 1837 |
| CAG00669 | MH0229_GL0148590 | SEQ ID NO: 1838 |
| CAG00669 | MH0197_GL0109522 | SEQ ID NO: 1839 |
| CAG00669 | V1.FI14_GL0234953 | SEQ ID NO: 1840 |
| CAG00669 | MH0397_GL0181573 | SEQ ID NO: 1841 |
| CAG00669 | MH0197_GL0129963 | SEQ ID NO: 1842 |
| CAG00669 | MH0197_GL0042741 | SEQ ID NO: 1843 |
| CAG00669 | MH0197_GL0094985 | SEQ ID NO: 1844 |
| CAG00669 | MH0286_GL0119078 | SEQ ID NO: 1845 |
| CAG00669 | MH0229_GL0199684 | SEQ ID NO: 1846 |
| CAG00669 | MH0197_GL0083020 | SEQ ID NO: 1847 |
| CAG00669 | MH0197_GL0066436 | SEQ ID NO: 1848 |
| CAG00669 | MH0330_GL0206949 | SEQ ID NO: 1849 |
| CAG00669 | MH0197_GL0070704 | SEQ ID NO: 1850 |
| CAG00669 | MH0013_GL0028809 | SEQ ID NO: 1851 |
| CAG00669 | MH0197_GL0142820 | SEQ ID NO: 1852 |
| CAG00669 | MH0330_GL0189177 | SEQ ID NO: 1853 |
| CAG00669 | MH0197_GL0088581 | SEQ ID NO: 1854 |
| CAG00669 | MH0197_GL0182366 | SEQ ID NO: 1855 |
| CAG00669 | MH0197_GL0130278 | SEQ ID NO: 1856 |
| CAG00669 | MH0197_GL0029501 | SEQ ID NO: 1857 |
| CAG00669 | MH0197_GL0100655 | SEQ ID NO: 1858 |
| CAG00669 | MH0373_GL0085470 | SEQ ID NO: 1859 |
| CAG00669 | MH0229_GL0064007 | SEQ ID NO: 1860 |
| CAG00669 | MH0197_GL0016425 | SEQ ID NO: 1861 |
| CAG00669 | MH0197_GL0146041 | SEQ ID NO: 1862 |
| CAG00669 | V1.FI14_GL0234081 | SEQ ID NO: 1863 |
| CAG00669 | V1.FI04_GL0219293 | SEQ ID NO: 1864 |
| CAG00669 | MH0451_GL0015685 | SEQ ID NO: 1865 |
| CAG00669 | MH0229_GL0083775 | SEQ ID NO: 1866 |
| CAG00669 | MH0197_GL0130275 | SEQ ID NO: 1867 |
| CAG00669 | MH0229_GL0058166 | SEQ ID NO: 1868 |
| CAG00669 | MH0429_GL0191886 | SEQ ID NO: 1869 |
| CAG00669 | MH0197_GL0093005 | SEQ ID NO: 1870 |
| CAG00669 | MH0197_GL0079932 | SEQ ID NO: 1871 |
| CAG00669 | MH0197_GL0125083 | SEQ ID NO: 1872 |
| CAG00669 | MH0197_GL0094204 | SEQ ID NO: 1873 |
| CAG00669 | MH0197_GL0113421 | SEQ ID NO: 1874 |
| CAG00669 | MH0367_GL0043136 | SEQ ID NO: 1875 |
| CAG00669 | V1.CD50-0_GL0120458 | SEQ ID NO: 1876 |
| CAG00708 | MH0247_GL0127983 | SEQ ID NO: 1877 |
| CAG00708 | MH0247_GL0105999 | SEQ ID NO: 1878 |
| CAG00708 | 159632143-stool1_revised_scaffold3172_2_gene50831 | SEQ ID NO: 1879 |
| CAG00708 | MH0244_GL0114679 | SEQ ID NO: 1880 |
| CAG00708 | MH0247_GL0039279 | SEQ ID NO: 1881 |
| CAG00708 | MH0244_GL0135896 | SEQ ID NO: 1882 |
| CAG00708 | MH0244_GL0155054 | SEQ ID NO: 1883 |
| CAG00708 | MH0247_GL0159353 | SEQ ID NO: 1884 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
| --- | --- | --- |
| CAG00708 | MH0247_GL0106616 | SEQ ID NO: 1885 |
| CAG00708 | MH0247_GL0068996 | SEQ ID NO: 1886 |
| CAG00708 | MH0244_GL0064454 | SEQ ID NO: 1887 |
| CAG00708 | MH0244_GL0080631 | SEQ ID NO: 1888 |
| CAG00708 | MH0247_GL0184933 | SEQ ID NO: 1889 |
| CAG00708 | MH0244_GL0122056 | SEQ ID NO: 1890 |
| CAG00708 | MH0247_GL0180674 | SEQ ID NO: 1891 |
| CAG00708 | MH0247_GL0063238 | SEQ ID NO: 1892 |
| CAG00708 | 158802708-stool2_revised_scaffold23523_1_gene106103 | SEQ ID NO: 1893 |
| CAG00708 | MH0244_GL0044729 | SEQ ID NO: 1894 |
| CAG00708 | MH0244_GL0099222 | SEQ ID NO: 1895 |
| CAG00708 | MH0247_GL0093590 | SEQ ID NO: 1896 |
| CAG00708 | MH0247_GL0178370 | SEQ ID NO: 1897 |
| CAG00708 | MH0244_GL0103462 | SEQ ID NO: 1898 |
| CAG00708 | MH0244_GL0057657 | SEQ ID NO: 1899 |
| CAG00708 | MH0247_GL0149574 | SEQ ID NO: 1900 |
| CAG00708 | MH0247_GL0198694 | SEQ ID NO: 1901 |
| CAG00708 | MH0247_GL0063231 | SEQ ID NO: 1902 |
| CAG00708 | MH0244_GL0149878 | SEQ ID NO: 1903 |
| CAG00708 | MH0247_GL0119273 | SEQ ID NO: 1904 |
| CAG00708 | MH0244_GL0003207 | SEQ ID NO: 1905 |
| CAG00708 | MH0244_GL0057659 | SEQ ID NO: 1906 |
| CAG00708 | MH0247_GL0168180 | SEQ ID NO: 1907 |
| CAG00708 | MH0244_GL0051657 | SEQ ID NO: 1908 |
| CAG00708 | MH0247_GL0179216 | SEQ ID NO: 1909 |
| CAG00708 | MH0247_GL0126555 | SEQ ID NO: 1910 |
| CAG00708 | MH0244_GL0112700 | SEQ ID NO: 1911 |
| CAG00708 | 159632143-stool1_revised_scaffold46131_1_gene3651 | SEQ ID NO: 1912 |
| CAG00708 | MH0247_GL0201508 | SEQ ID NO: 1913 |
| CAG00708 | MH0244_GL0051655 | SEQ ID NO: 1914 |
| CAG00708 | MH0244_GL0051247 | SEQ ID NO: 1915 |
| CAG00708 | MH0247_GL0059767 | SEQ ID NO: 1916 |
| CAG00708 | MH0244_GL0053868 | SEQ ID NO: 1917 |
| CAG00708 | MH0244_GL0069611 | SEQ ID NO: 1918 |
| CAG00708 | MH0247_GL0054726 | SEQ ID NO: 1919 |
| CAG00708 | MH0247_GL0149581 | SEQ ID NO: 1920 |
| CAG00708 | 159632143-stool1_revised_scaffold2564_1_gene9545 | SEQ ID NO: 1921 |
| CAG00708 | MH0247_GL0111749 | SEQ ID NO: 1922 |
| CAG00708 | MH0244_GL0139322 | SEQ ID NO: 1923 |
| CAG00708 | MH0247_GL0063222 | SEQ ID NO: 1924 |
| CAG00708 | MH0247_GL0077032 | SEQ ID NO: 1925 |
| CAG00708 | MH0244_GL0115874 | SEQ ID NO: 1926 |
| CAG00773 | MH0176_GL0136011 | SEQ ID NO: 1927 |
| CAG00773 | MH0222_GL0126770 | SEQ ID NO: 1928 |
| CAG00773 | MH0176_GL0003864 | SEQ ID NO: 1929 |
| CAG00773 | MH0176_GL0056104 | SEQ ID NO: 1930 |
| CAG00773 | MH0023_GL0029268 | SEQ ID NO: 1931 |
| CAG00773 | MH0176_GL0117492 | SEQ ID NO: 1932 |
| CAG00773 | MH0176_GL0037224 | SEQ ID NO: 1933 |
| CAG00773 | MH0176_GL0037226 | SEQ ID NO: 1934 |
| CAG00773 | O2.UC1-2_GL0103698 | SEQ ID NO: 1935 |
| CAG00773 | MH0293_GL0180427 | SEQ ID NO: 1936 |
| CAG00773 | MH0176_GL0046360 | SEQ ID NO: 1937 |
| CAG00773 | MH0110_GL0070711 | SEQ ID NO: 1938 |
| CAG00773 | MH0443_GL0014210 | SEQ ID NO: 1939 |
| CAG00773 | T2D-59A_GL0053779 | SEQ ID NO: 1940 |
| CAG00773 | V1.FI11_GL0101062 | SEQ ID NO: 1941 |
| CAG00773 | MH0176_GL0043722 | SEQ ID NO: 1942 |
| CAG00773 | MH0176_GL0125552 | SEQ ID NO: 1943 |
| CAG00773 | MH0176_GL0087927 | SEQ ID NO: 1944 |
| CAG00773 | MH0176_GL0116526 | SEQ ID NO: 1945 |
| CAG00773 | MH0315_GL0043366 | SEQ ID NO: 1946 |
| CAG00773 | MH0154_GL0000284 | SEQ ID NO: 1947 |
| CAG00773 | MH0176_GL0003862 | SEQ ID NO: 1948 |
| CAG00773 | MH0176_GL0033106 | SEQ ID NO: 1949 |
| CAG00773 | V1.FI19_GL0065772 | SEQ ID NO: 1950 |
| CAG00773 | MH0176_GL0090410 | SEQ ID NO: 1951 |
| CAG00773 | MH0381_GL0041486 | SEQ ID NO: 1952 |
| CAG00773 | MH0176_GL0116527 | SEQ ID NO: 1953 |
| CAG00773 | MH0222_GL0102268 | SEQ ID NO: 1954 |
| CAG00773 | MH0424_GL0113348 | SEQ ID NO: 1955 |
| CAG00773 | MH0293_GL0145886 | SEQ ID NO: 1956 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00773 | MH0154_GL0003240 | SEQ ID NO: 1957 |
| CAG00773 | MH0176_GL0117488 | SEQ ID NO: 1958 |
| CAG00773 | MH0176_GL0006609 | SEQ ID NO: 1959 |
| CAG00773 | MH0110_GL0065980 | SEQ ID NO: 1960 |
| CAG00773 | 158479027-stool1_revised_scaffold16618_1_gene102199 | SEQ ID NO: 1961 |
| CAG00773 | MH0176_GL0001208 | SEQ ID NO: 1962 |
| CAG00773 | MH0245_GL0148135 | SEQ ID NO: 1963 |
| CAG00773 | MH0381_GL0009741 | SEQ ID NO: 1964 |
| CAG00773 | MH0396_GL0102547 | SEQ ID NO: 1965 |
| CAG00773 | MH0176_GL0036856 | SEQ ID NO: 1966 |
| CAG00773 | MH0176_GL0130995 | SEQ ID NO: 1967 |
| CAG00773 | MH0293_GL0019828 | SEQ ID NO: 1968 |
| CAG00773 | MH0293_GL0138546 | SEQ ID NO: 1969 |
| CAG00773 | V1.FI11_GL0194656 | SEQ ID NO: 1970 |
| CAG00773 | MH0176_GL0005737 | SEQ ID NO: 1971 |
| CAG00773 | MH0176_GL0061893 | SEQ ID NO: 1972 |
| CAG00773 | MH0154_GL0106428 | SEQ ID NO: 1973 |
| CAG00773 | MH0154_GL0078114 | SEQ ID NO: 1974 |
| CAG00773 | MH0222_GL0157669 | SEQ ID NO: 1975 |
| CAG00773 | MH0222_GL0105590 | SEQ ID NO: 1976 |
| CAG00807 | MH0301_GL0033725 | SEQ ID NO: 1977 |
| CAG00807 | MH0165_GL0061412 | SEQ ID NO: 1978 |
| CAG00807 | MH0301_GL0047494 | SEQ ID NO: 1979 |
| CAG00807 | MH0092_GL0080106 | SEQ ID NO: 1980 |
| CAG00807 | MH0165_GL0113700 | SEQ ID NO: 1981 |
| CAG00807 | MH0148_GL0116445 | SEQ ID NO: 1982 |
| CAG00807 | MH0148_GL0145001 | SEQ ID NO: 1983 |
| CAG00807 | MH0148_GL0044463 | SEQ ID NO: 1984 |
| CAG00807 | MH0041_GL0055082 | SEQ ID NO: 1985 |
| CAG00807 | MH0148_GL0115069 | SEQ ID NO: 1986 |
| CAG00807 | MH0148_GL0118383 | SEQ ID NO: 1987 |
| CAG00807 | MH0102_GL0075586 | SEQ ID NO: 1988 |
| CAG00807 | MH0148_GL0042336 | SEQ ID NO: 1989 |
| CAG00807 | MH0093_GL0063769 | SEQ ID NO: 1990 |
| CAG00807 | V1.FI02_GL0020817 | SEQ ID NO: 1991 |
| CAG00807 | MH0442_GL0193529 | SEQ ID NO: 1992 |
| CAG00807 | MH0041_GL0054811 | SEQ ID NO: 1993 |
| CAG00807 | MH0163_GL0069186 | SEQ ID NO: 1994 |
| CAG00807 | MH0041_GL0006132 | SEQ ID NO: 1995 |
| CAG00807 | MH0102_GL0050698 | SEQ ID NO: 1996 |
| CAG00807 | O2.UC44-0_GL0040348 | SEQ ID NO: 1997 |
| CAG00807 | MH0148_GL0092929 | SEQ ID NO: 1998 |
| CAG00807 | MH0148_GL0159142 | SEQ ID NO: 1999 |
| CAG00807 | 764487809-stool1_revised_C1069950_1_gene191231 | SEQ ID NO: 2000 |
| CAG00807 | MH0148_GL0139776 | SEQ ID NO: 2001 |
| CAG00807 | MH0041_GL0006131 | SEQ ID NO: 2002 |
| CAG00807 | MH0187_GL0143210 | SEQ ID NO: 2003 |
| CAG00807 | MH0260_GL0109822 | SEQ ID NO: 2004 |
| CAG00807 | V1.CD42-0_GL0096154 | SEQ ID NO: 2005 |
| CAG00807 | V1.CD16-0_GL0111163 | SEQ ID NO: 2006 |
| CAG00807 | MH0165_GL0042349 | SEQ ID NO: 2007 |
| CAG00807 | MH0441_GL0226653 | SEQ ID NO: 2008 |
| CAG00807 | MH0398_GL0192694 | SEQ ID NO: 2009 |
| CAG00807 | MH0041_GL0043725 | SEQ ID NO: 2010 |
| CAG00807 | MH0165_GL0021847 | SEQ ID NO: 2011 |
| CAG00807 | N037A_GL0072326 | SEQ ID NO: 2012 |
| CAG00807 | MH0362_GL0079670 | SEQ ID NO: 2013 |
| CAG00807 | MH0041_GL0005391 | SEQ ID NO: 2014 |
| CAG00807 | V1.UC44-0_GL0120843 | SEQ ID NO: 2015 |
| CAG00807 | MH0298_GL0172386 | SEQ ID NO: 2016 |
| CAG00807 | O2.UC12-0_GL0044661 | SEQ ID NO: 2017 |
| CAG00807 | V1.UC22-1_GL0047416 | SEQ ID NO: 2018 |
| CAG00807 | MH0041_GL0015386 | SEQ ID NO: 2019 |
| CAG00807 | MH0148_GL0153943 | SEQ ID NO: 2020 |
| CAG00807 | MH0148_GL0125143 | SEQ ID NO: 2021 |
| CAG00807 | MH0041_GL0002618 | SEQ ID NO: 2022 |
| CAG00807 | MH0222_GL0153280 | SEQ ID NO: 2023 |
| CAG00807 | MH0092_GL0058374 | SEQ ID NO: 2024 |
| CAG00807 | MH0102_GL0109724 | SEQ ID NO: 2025 |
| CAG00807 | SZEY-43A_GL0042615 | SEQ ID NO: 2026 |
| CAG00880 | MH0303_GL0173352 | SEQ ID NO: 2027 |
| CAG00880 | MH0100_GL0099997 | SEQ ID NO: 2028 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00880 | MH0002_GL0034748 | SEQ ID NO: 2029 |
| CAG00880 | MH0012_GL0237170 | SEQ ID NO: 2030 |
| CAG00880 | O2.UC44-0_GL0117257 | SEQ ID NO: 2031 |
| CAG00880 | MH0012_GL0195203 | SEQ ID NO: 2032 |
| CAG00880 | MH0262_GL0025010 | SEQ ID NO: 2033 |
| CAG00880 | MH0012_GL0056991 | SEQ ID NO: 2034 |
| CAG00880 | MH0012_GL0077956 | SEQ ID NO: 2035 |
| CAG00880 | MH0220_GL0192349 | SEQ ID NO: 2036 |
| CAG00880 | MH0012_GL0102653 | SEQ ID NO: 2037 |
| CAG00880 | MH0012_GL0220969 | SEQ ID NO: 2038 |
| CAG00880 | MH0012_GL0093821 | SEQ ID NO: 2039 |
| CAG00880 | MH0012_GL0134845 | SEQ ID NO: 2040 |
| CAG00880 | MH0012_GL0027380 | SEQ ID NO: 2041 |
| CAG00880 | MH0343_GL0167330 | SEQ ID NO: 2042 |
| CAG00880 | MH0012_GL0103710 | SEQ ID NO: 2043 |
| CAG00880 | O2.UC31-1_GL0033906 | SEQ ID NO: 2044 |
| CAG00880 | O2.UC29-0_GL0061068 | SEQ ID NO: 2045 |
| CAG00880 | MH0012_GL0103695 | SEQ ID NO: 2046 |
| CAG00880 | MH0012_GL0023918 | SEQ ID NO: 2047 |
| CAG00880 | MH0012_GL0087717 | SEQ ID NO: 2048 |
| CAG00880 | MH0148_GL0160053 | SEQ ID NO: 2049 |
| CAG00880 | MH0012_GL0057003 | SEQ ID NO: 2050 |
| CAG00880 | MH0012_GL0087706 | SEQ ID NO: 2051 |
| CAG00880 | MH0012_GL0087718 | SEQ ID NO: 2052 |
| CAG00880 | MH0012_GL0001511 | SEQ ID NO: 2053 |
| CAG00880 | MH0012_GL0188466 | SEQ ID NO: 2054 |
| CAG00880 | MH0012_GL0000902 | SEQ ID NO: 2055 |
| CAG00880 | MH0174_GL0153781 | SEQ ID NO: 2056 |
| CAG00880 | MH0012_GL0087712 | SEQ ID NO: 2057 |
| CAG00880 | MH0012_GL0056938 | SEQ ID NO: 2058 |
| CAG00880 | MH0012_GL0040034 | SEQ ID NO: 2059 |
| CAG00880 | MH0280_GL0193689 | SEQ ID NO: 2060 |
| CAG00880 | MH0012_GL0082084 | SEQ ID NO: 2061 |
| CAG00880 | MH0012_GL0027391 | SEQ ID NO: 2062 |
| CAG00880 | MH0012_GL0040027 | SEQ ID NO: 2063 |
| CAG00880 | MH0012_GL0103688 | SEQ ID NO: 2064 |
| CAG00880 | MH0012_GL0056935 | SEQ ID NO: 2065 |
| CAG00880 | MH0012_GL0190522 | SEQ ID NO: 2066 |
| CAG00880 | MH0012_GL0233883 | SEQ ID NO: 2067 |
| CAG00880 | MH0012_GL0171998 | SEQ ID NO: 2068 |
| CAG00880 | MH0012_GL0040024 | SEQ ID NO: 2069 |
| CAG00880 | MH0012_GL0032203 | SEQ ID NO: 2070 |
| CAG00880 | MH0002_GL0076942 | SEQ ID NO: 2071 |
| CAG00880 | MH0012_GL0027390 | SEQ ID NO: 2072 |
| CAG00880 | MH0348_GL0094114 | SEQ ID NO: 2073 |
| CAG00880 | MH0012_GL0011994 | SEQ ID NO: 2074 |
| CAG00880 | MH0012_GL0102651 | SEQ ID NO: 2075 |
| CAG00880 | MH0012_GL0188458 | SEQ ID NO: 2076 |
| CAG00907 | MH0406_GL0036577 | SEQ ID NO: 2077 |
| CAG00907 | MH0406_GL0082730 | SEQ ID NO: 2078 |
| CAG00907 | MH0406_GL0212707 | SEQ ID NO: 2079 |
| CAG00907 | MH0406_GL0188937 | SEQ ID NO: 2080 |
| CAG00907 | MH0406_GL0194580 | SEQ ID NO: 2081 |
| CAG00907 | V1.FI02_GL0004581 | SEQ ID NO: 2082 |
| CAG00907 | V1.FI17_GL0111364 | SEQ ID NO: 2083 |
| CAG00907 | V1.FI02_GL0078865 | SEQ ID NO: 2084 |
| CAG00907 | V1.FI02_GL0033306 | SEQ ID NO: 2085 |
| CAG00907 | MH0406_GL0025955 | SEQ ID NO: 2086 |
| CAG00907 | V1.FI02_GL0193901 | SEQ ID NO: 2087 |
| CAG00907 | MH0406_GL0150018 | SEQ ID NO: 2088 |
| CAG00907 | MH0406_GL0159210 | SEQ ID NO: 2089 |
| CAG00907 | MH0406_GL0050040 | SEQ ID NO: 2090 |
| CAG00907 | MH0406_GL0056872 | SEQ ID NO: 2091 |
| CAG00907 | V1.FI17_GL0113355 | SEQ ID NO: 2092 |
| CAG00907 | MH0252_GL0069372 | SEQ ID NO: 2093 |
| CAG00907 | MH0406_GL0160700 | SEQ ID NO: 2094 |
| CAG00907 | MH0406_GL0106290 | SEQ ID NO: 2095 |
| CAG00907 | MH0406_GL0107270 | SEQ ID NO: 2096 |
| CAG00907 | MH0406_GL0140952 | SEQ ID NO: 2097 |
| CAG00907 | MH0406_GL0198479 | SEQ ID NO: 2098 |
| CAG00907 | MH0406_GL0114916 | SEQ ID NO: 2099 |
| CAG00907 | MH0406_GL0098212 | SEQ ID NO: 2100 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00907 | MH0406_GL0109826 | SEQ ID NO: 2101 |
| CAG00907 | MH0406_GL0050047 | SEQ ID NO: 2102 |
| CAG00907 | MH0406_GL0010585 | SEQ ID NO: 2103 |
| CAG00907 | V1.FI17_GL0232428 | SEQ ID NO: 2104 |
| CAG00907 | MH0406_GL0188934 | SEQ ID NO: 2105 |
| CAG00907 | V1.FI02_GL0130832 | SEQ ID NO: 2106 |
| CAG00907 | MH0406_GL0027320 | SEQ ID NO: 2107 |
| CAG00907 | MH0406_GL0106289 | SEQ ID NO: 2108 |
| CAG00907 | MH0406_GL0200362 | SEQ ID NO: 2109 |
| CAG00907 | MH0406_GL0137182 | SEQ ID NO: 2110 |
| CAG00907 | V1.FI17_GL0052501 | SEQ ID NO: 2111 |
| CAG00907 | MH0406_GL0160699 | SEQ ID NO: 2112 |
| CAG00907 | MH0406_GL0130721 | SEQ ID NO: 2113 |
| CAG00907 | MH0406_GL0004857 | SEQ ID NO: 2114 |
| CAG00907 | MH0406_GL0036571 | SEQ ID NO: 2115 |
| CAG00907 | MH0406_GL0103619 | SEQ ID NO: 2116 |
| CAG00907 | MH0406_GL0001932 | SEQ ID NO: 2117 |
| CAG00907 | MH0406_GL0179891 | SEQ ID NO: 2118 |
| CAG00907 | MH0406_GL0036551 | SEQ ID NO: 2119 |
| CAG00907 | V1.FI02_GL0015755 | SEQ ID NO: 2120 |
| CAG00907 | V1.FI02_GL0006959 | SEQ ID NO: 2121 |
| CAG00907 | MH0406_GL0160729 | SEQ ID NO: 2122 |
| CAG00907 | V1.FI02_GL0057414 | SEQ ID NO: 2123 |
| CAG00907 | MH0406_GL0203649 | SEQ ID NO: 2124 |
| CAG00907 | MH0406_GL0179889 | SEQ ID NO: 2125 |
| CAG00907 | V1.FI02_GL0070231 | SEQ ID NO: 2126 |
| CAG01086 | MH0272_GL0033692 | SEQ ID NO: 2127 |
| CAG01086 | MH0272_GL0097741 | SEQ ID NO: 2128 |
| CAG01086 | MH0272_GL0208037 | SEQ ID NO: 2129 |
| CAG01086 | MH0272_GL0165135 | SEQ ID NO: 2130 |
| CAG01086 | MH0272_GL0221196 | SEQ ID NO: 2131 |
| CAG01086 | MH0272_GL0059874 | SEQ ID NO: 2132 |
| CAG01086 | MH0272_GL0178997 | SEQ ID NO: 2133 |
| CAG01086 | MH0272_GL0090046 | SEQ ID NO: 2134 |
| CAG01086 | MH0197_GL0021730 | SEQ ID NO: 2135 |
| CAG01086 | MH0197_GL0177498 | SEQ ID NO: 2136 |
| CAG01086 | MH0197_GL0047997 | SEQ ID NO: 2137 |
| CAG01086 | MH0272_GL0018541 | SEQ ID NO: 2138 |
| CAG01086 | V1.FI12_GL0168719 | SEQ ID NO: 2139 |
| CAG01086 | MH0272_GL0044864 | SEQ ID NO: 2140 |
| CAG01086 | MH0272_GL0208142 | SEQ ID NO: 2141 |
| CAG01086 | V1.FI12_GL0199579 | SEQ ID NO: 2142 |
| CAG01086 | MH0272_GL0042322 | SEQ ID NO: 2143 |
| CAG01086 | MH0272_GL0199766 | SEQ ID NO: 2144 |
| CAG01086 | MH0272_GL0098607 | SEQ ID NO: 2145 |
| CAG01086 | MH0272_GL0081607 | SEQ ID NO: 2146 |
| CAG01086 | MH0272_GL0014839 | SEQ ID NO: 2147 |
| CAG01086 | MH0272_GL0181505 | SEQ ID NO: 2148 |
| CAG01086 | MH0197_GL0027753 | SEQ ID NO: 2149 |
| CAG01086 | V1.FI12_GL0102462 | SEQ ID NO: 2150 |
| CAG01086 | V1.FI12_GL0055721 | SEQ ID NO: 2151 |
| CAG01086 | MH0272_GL0094548 | SEQ ID NO: 2152 |
| CAG01086 | MH0272_GL0077413 | SEQ ID NO: 2153 |
| CAG01086 | MH0197_GL0175920 | SEQ ID NO: 2154 |
| CAG01086 | MH0197_GL0047836 | SEQ ID NO: 2155 |
| CAG01086 | MH0272_GL0016746 | SEQ ID NO: 2156 |
| CAG01086 | V1.FI12_GL0190838 | SEQ ID NO: 2157 |
| CAG01086 | MH0272_GL0077416 | SEQ ID NO: 2158 |
| CAG01086 | MH0272_GL0217594 | SEQ ID NO: 2159 |
| CAG01086 | MH0272_GL0070921 | SEQ ID NO: 2160 |
| CAG01086 | MH0197_GL0115341 | SEQ ID NO: 2161 |
| CAG01086 | MH0272_GL0105935 | SEQ ID NO: 2162 |
| CAG01086 | MH0272_GL0033707 | SEQ ID NO: 2163 |
| CAG01086 | V1.FI12_GL0185655 | SEQ ID NO: 2164 |
| CAG01086 | MH0452_GL0230002 | SEQ ID NO: 2165 |
| CAG01086 | MH0272_GL0051892 | SEQ ID NO: 2166 |
| CAG01086 | MH0272_GL0040138 | SEQ ID NO: 2167 |
| CAG01086 | MH0272_GL0172085 | SEQ ID NO: 2168 |
| CAG01086 | MH0272_GL0106128 | SEQ ID NO: 2169 |
| CAG01086 | MH0272_GL0077415 | SEQ ID NO: 2170 |
| CAG01086 | MH0197_GL0111839 | SEQ ID NO: 2171 |
| CAG01086 | MH0272_GL0126357 | SEQ ID NO: 2172 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG01086 | V1.FI12_GL0152693 | SEQ ID NO: 2173 |
| CAG01086 | MH0197_GL0020164 | SEQ ID NO: 2174 |
| CAG01086 | MH0272_GL0201993 | SEQ ID NO: 2175 |
| CAG01086 | MH0272_GL0061438 | SEQ ID NO: 2176 |
| CAG01215 | MH0433_GL0246310 | SEQ ID NO: 2177 |
| CAG01215 | MH0433_GL0002323 | SEQ ID NO: 2178 |
| CAG01215 | MH0433_GL0182338 | SEQ ID NO: 2179 |
| CAG01215 | MH0433_GL0059452 | SEQ ID NO: 2180 |
| CAG01215 | MH0433_GL0151518 | SEQ ID NO: 2181 |
| CAG01215 | MH0433_GL0179521 | SEQ ID NO: 2182 |
| CAG01215 | MH0433_GL0117415 | SEQ ID NO: 2183 |
| CAG01215 | MH0433_GL0046627 | SEQ ID NO: 2184 |
| CAG01215 | MH0433_GL0141413 | SEQ ID NO: 2185 |
| CAG01215 | MH0433_GL0006791 | SEQ ID NO: 2186 |
| CAG01215 | MH0433_GL0222378 | SEQ ID NO: 2187 |
| CAG01215 | MH0433_GL0231566 | SEQ ID NO: 2188 |
| CAG01215 | MH0433_GL0058495 | SEQ ID NO: 2189 |
| CAG01215 | MH0433_GL0011928 | SEQ ID NO: 2190 |
| CAG01215 | MH0433_GL0237792 | SEQ ID NO: 2191 |
| CAG01215 | MH0433_GL0142574 | SEQ ID NO: 2192 |
| CAG01215 | MH0433_GL0083732 | SEQ ID NO: 2193 |
| CAG01215 | MH0433_GL0134574 | SEQ ID NO: 2194 |
| CAG01215 | MH0433_GL0012830 | SEQ ID NO: 2195 |
| CAG01215 | MH0433_GL0218821 | SEQ ID NO: 2196 |
| CAG01215 | MH0433_GL0222379 | SEQ ID NO: 2197 |
| CAG01215 | MH0433_GL0037988 | SEQ ID NO: 2198 |
| CAG01215 | MH0433_GL0191549 | SEQ ID NO: 2199 |
| CAG01215 | MH0433_GL0233278 | SEQ ID NO: 2200 |
| CAG01215 | MH0433_GL0162961 | SEQ ID NO: 2201 |
| CAG01215 | MH0433_GL0172751 | SEQ ID NO: 2202 |
| CAG01215 | MH0433_GL0218452 | SEQ ID NO: 2203 |
| CAG01215 | MH0433_GL0047571 | SEQ ID NO: 2204 |
| CAG01215 | MH0433_GL0199159 | SEQ ID NO: 2205 |
| CAG01215 | MH0433_GL0103567 | SEQ ID NO: 2206 |
| CAG01215 | MH0433_GL0165868 | SEQ ID NO: 2207 |
| CAG01215 | MH0433_GL0191255 | SEQ ID NO: 2208 |
| CAG01215 | MH0433_GL0145241 | SEQ ID NO: 2209 |
| CAG01215 | MH0433_GL0079550 | SEQ ID NO: 2210 |
| CAG01215 | MH0433_GL0182566 | SEQ ID NO: 2211 |
| CAG01215 | MH0433_GL0069540 | SEQ ID NO: 2212 |
| CAG01215 | MH0433_GL0007656 | SEQ ID NO: 2213 |
| CAG01215 | MH0433_GL0010719 | SEQ ID NO: 2214 |
| CAG01215 | MH0433_GL0235599 | SEQ ID NO: 2215 |
| CAG01215 | MH0433_GL0151460 | SEQ ID NO: 2216 |
| CAG01215 | MH0433_GL0049378 | SEQ ID NO: 2217 |
| CAG01215 | MH0433_GL0086943 | SEQ ID NO: 2218 |
| CAG01215 | MH0433_GL0055538 | SEQ ID NO: 2219 |
| CAG01215 | MH0433_GL0102724 | SEQ ID NO: 2220 |
| CAG01215 | MH0433_GL0141284 | SEQ ID NO: 2221 |
| CAG01215 | MH0433_GL0108811 | SEQ ID NO: 2222 |
| CAG01215 | MH0433_GL0006130 | SEQ ID NO: 2223 |
| CAG01215 | MH0433_GL0041529 | SEQ ID NO: 2224 |
| CAG01215 | MH0433_GL0149845 | SEQ ID NO: 2225 |
| CAG01215 | MH0433_GL0176143 | SEQ ID NO: 2226 |
| CAG01277 | MH0406_GL0208401 | SEQ ID NO: 2227 |
| CAG01277 | MH0406_GL0212707 | SEQ ID NO: 2228 |
| CAG01277 | MH0406_GL0081467 | SEQ ID NO: 2229 |
| CAG01277 | MH0406_GL0198479 | SEQ ID NO: 2230 |
| CAG01277 | MH0406_GL0114913 | SEQ ID NO: 2231 |
| CAG01277 | V1.FI17_GL0113355 | SEQ ID NO: 2232 |
| CAG01277 | MH0406_GL0159210 | SEQ ID NO: 2233 |
| CAG01277 | V1.FI17_GL0158312 | SEQ ID NO: 2234 |
| CAG01277 | MH0406_GL0176325 | SEQ ID NO: 2235 |
| CAG01277 | MH0406_GL0168102 | SEQ ID NO: 2236 |
| CAG01277 | MH0406_GL0145969 | SEQ ID NO: 2237 |
| CAG01277 | MH0406_GL0060237 | SEQ ID NO: 2238 |
| CAG01277 | MH0406_GL0015582 | SEQ ID NO: 2239 |
| CAG01277 | MH0406_GL0126250 | SEQ ID NO: 2240 |
| CAG01277 | MH0406_GL0053950 | SEQ ID NO: 2241 |
| CAG01277 | MH0406_GL0053951 | SEQ ID NO: 2242 |
| CAG01277 | MH0406_GL0090592 | SEQ ID NO: 2243 |
| CAG01277 | MH0406_GL0163333 | SEQ ID NO: 2244 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG01277 | MH0406_GL0142881 | SEQ ID NO: 2245 |
| CAG01277 | MH0406_GL0155754 | SEQ ID NO: 2246 |
| CAG01277 | MH0406_GL0198480 | SEQ ID NO: 2247 |
| CAG01277 | MH0406_GL0207882 | SEQ ID NO: 2248 |
| CAG01277 | MH0433_GL0150353 | SEQ ID NO: 2249 |
| CAG01277 | MH0406_GL0142889 | SEQ ID NO: 2250 |
| CAG01277 | MH0406_GL0213396 | SEQ ID NO: 2251 |
| CAG01277 | MH0406_GL0003826 | SEQ ID NO: 2252 |
| CAG01277 | MH0406_GL0198478 | SEQ ID NO: 2253 |
| CAG01277 | MH0406_GL0130721 | SEQ ID NO: 2254 |
| CAG01277 | MH0433_GL0150751 | SEQ ID NO: 2255 |
| CAG01277 | MH0406_GL0150228 | SEQ ID NO: 2256 |
| CAG01277 | MH0406_GL0003626 | SEQ ID NO: 2257 |
| CAG01277 | MH0406_GL0058550 | SEQ ID NO: 2258 |
| CAG01277 | MH0406_GL0157472 | SEQ ID NO: 2259 |
| CAG01277 | MH0406_GL0142885 | SEQ ID NO: 2260 |
| CAG01277 | MH0406_GL0114916 | SEQ ID NO: 2261 |
| CAG01277 | MH0406_GL0168103 | SEQ ID NO: 2262 |
| CAG01277 | V1.FI02_GL0049212 | SEQ ID NO: 2263 |
| CAG01277 | V1.FI02_GL0013181 | SEQ ID NO: 2264 |
| CAG01277 | MH0406_GL0210050 | SEQ ID NO: 2265 |
| CAG01277 | MH0406_GL0015606 | SEQ ID NO: 2266 |
| CAG01277 | V1.FI17_GL0005209 | SEQ ID NO: 2267 |
| CAG01277 | MH0406_GL0211031 | SEQ ID NO: 2268 |
| CAG01277 | MH0406_GL0133735 | SEQ ID NO: 2269 |
| CAG01277 | V1.FI02_GL0115051 | SEQ ID NO: 2270 |
| CAG01277 | MH0406_GL0146427 | SEQ ID NO: 2271 |
| CAG01277 | V1.FI17_GL0019567 | SEQ ID NO: 2272 |
| CAG01277 | MH0406_GL0116594 | SEQ ID NO: 2273 |
| CAG01277 | MH0406_GL0198381 | SEQ ID NO: 2274 |
| CAG01277 | MH0406_GL0215713 | SEQ ID NO: 2275 |
| CAG01277 | MH0433_GL0239178 | SEQ ID NO: 2276 |
| CAG01308 | V1.FI36_GL0162409 | SEQ ID NO: 2277 |
| CAG01308 | MH0244_GL0125576 | SEQ ID NO: 2278 |
| CAG01308 | MH0234_GL0080290 | SEQ ID NO: 2279 |
| CAG01308 | MH0244_GL0062145 | SEQ ID NO: 2280 |
| CAG01308 | MH0244_GL0014298 | SEQ ID NO: 2281 |
| CAG01308 | V1.FI36_GL0066337 | SEQ ID NO: 2282 |
| CAG01308 | MH0244_GL0016761 | SEQ ID NO: 2283 |
| CAG01308 | MH0244_GL0007228 | SEQ ID NO: 2284 |
| CAG01308 | MH0244_GL0092742 | SEQ ID NO: 2285 |
| CAG01308 | MH0234_GL0155898 | SEQ ID NO: 2286 |
| CAG01308 | MH0244_GL0015948 | SEQ ID NO: 2287 |
| CAG01308 | MH0244_GL0112042 | SEQ ID NO: 2288 |
| CAG01308 | MH0325_GL0025548 | SEQ ID NO: 2289 |
| CAG01308 | MH0364_GL0119824 | SEQ ID NO: 2290 |
| CAG01308 | T2D-6A_GL0099679 | SEQ ID NO: 2291 |
| CAG01308 | MH0244_GL0117600 | SEQ ID NO: 2292 |
| CAG01308 | MH0244_GL0082661 | SEQ ID NO: 2293 |
| CAG01308 | MH0244_GL0038215 | SEQ ID NO: 2294 |
| CAG01308 | MH0244_GL0034934 | SEQ ID NO: 2295 |
| CAG01308 | MH0220_GL0218242 | SEQ ID NO: 2296 |
| CAG01308 | MH0244_GL0051207 | SEQ ID NO: 2297 |
| CAG01308 | MH0323_GL0136858 | SEQ ID NO: 2298 |
| CAG01308 | MH0234_GL0000384 | SEQ ID NO: 2299 |
| CAG01308 | MH0234_GL0139816 | SEQ ID NO: 2300 |
| CAG01308 | MH0364_GL0093837 | SEQ ID NO: 2301 |
| CAG01308 | MH0244_GL0034936 | SEQ ID NO: 2302 |
| CAG01308 | MH0244_GL0067087 | SEQ ID NO: 2303 |
| CAG01308 | V1.FI36_GL0004702 | SEQ ID NO: 2304 |
| CAG01308 | MH0234_GL0087096 | SEQ ID NO: 2305 |
| CAG01308 | MH0364_GL0152267 | SEQ ID NO: 2306 |
| CAG01308 | MH0234_GL0047709 | SEQ ID NO: 2307 |
| CAG01308 | MH0234_GL0106008 | SEQ ID NO: 2308 |
| CAG01308 | MH0234_GL0161275 | SEQ ID NO: 2309 |
| CAG01308 | MH0244_GL0025744 | SEQ ID NO: 2310 |
| CAG01308 | MH0244_GL0050838 | SEQ ID NO: 2311 |
| CAG01308 | T2D-6A_GL0189151 | SEQ ID NO: 2312 |
| CAG01308 | MH0244_GL0033106 | SEQ ID NO: 2313 |
| CAG01308 | MH0244_GL0093208 | SEQ ID NO: 2314 |
| CAG01308 | T2D-15A_GL0176051 | SEQ ID NO: 2315 |
| CAG01308 | MH0244_GL0041878 | SEQ ID NO: 2316 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG01308 | MH0244_GL0093260 | SEQ ID NO: 2317 |
| CAG01308 | MH0244_GL0053442 | SEQ ID NO: 2318 |
| CAG01308 | MH0244_GL0062146 | SEQ ID NO: 2319 |
| CAG01308 | MH0244_GL0036596 | SEQ ID NO: 2320 |
| CAG01308 | V1.UC35-4_GL0069659 | SEQ ID NO: 2321 |
| CAG01308 | MH0244_GL0050837 | SEQ ID NO: 2322 |
| CAG01308 | MH0234_GL0165035 | SEQ ID NO: 2323 |
| CAG01308 | MH0244_GL0044794 | SEQ ID NO: 2324 |
| CAG01308 | MH0234_GL0109970 | SEQ ID NO: 2325 |
| CAG01308 | MH0446_GL0183437 | SEQ ID NO: 2326 |
| CAG00577 | O2.UC53-0_GL0258016 | SEQ ID NO: 2327 |
| CAG00577 | MH0161_GL0105291 | SEQ ID NO: 2328 |
| CAG00577 | MH0161_GL0102478 | SEQ ID NO: 2329 |
| CAG00577 | MH0246_GL0006696 | SEQ ID NO: 2330 |
| CAG00577 | MH0161_GL0023380 | SEQ ID NO: 2331 |
| CAG00577 | MH0161_GL0129486 | SEQ ID NO: 2332 |
| CAG00577 | MH0243_GL0076883 | SEQ ID NO: 2333 |
| CAG00577 | MH0419_GL0188987 | SEQ ID NO: 2334 |
| CAG00577 | V1.FI07_GL0058208 | SEQ ID NO: 2335 |
| CAG00577 | MH0136_GL0032411 | SEQ ID NO: 2336 |
| CAG00577 | MH0409_GL0012015 | SEQ ID NO: 2337 |
| CAG00577 | MH0446_GL0261351 | SEQ ID NO: 2338 |
| CAG00577 | MH0136_GL0100087 | SEQ ID NO: 2339 |
| CAG00577 | BGI-34A_GL0104891 | SEQ ID NO: 2340 |
| CAG00577 | MH0243_GL0060327 | SEQ ID NO: 2341 |
| CAG00577 | MH0161_GL0121426 | SEQ ID NO: 2342 |
| CAG00577 | MH0161_GL0155126 | SEQ ID NO: 2343 |
| CAG00577 | MH0276_GL0081418 | SEQ ID NO: 2344 |
| CAG00577 | MH0251_GL0168754 | SEQ ID NO: 2345 |
| CAG00577 | MH0377_GL0014956 | SEQ ID NO: 2346 |
| CAG00577 | MH0187_GL0110670 | SEQ ID NO: 2347 |
| CAG00577 | 764669880-stool2_revised_scaffold10448_2_gene8524 | SEQ ID NO: 2348 |
| CAG00577 | 638754422-stool2_revised_scaffold8139_1_gene83549 | SEQ ID NO: 2349 |
| CAG00577 | NOM027_GL0017049 | SEQ ID NO: 2350 |
| CAG00577 | 763901136-stool1_revised_scaffold19007_1_gene87186 | SEQ ID NO: 2351 |
| CAG00577 | MH0161_GL0124558 | SEQ ID NO: 2352 |
| CAG00577 | MH0122_GL0017342 | SEQ ID NO: 2353 |
| CAG00577 | MH0161_GL0140082 | SEQ ID NO: 2354 |
| CAG00577 | MH0360_GL0039102 | SEQ ID NO: 2355 |
| CAG00577 | T2D-70A_GL0068462 | SEQ ID NO: 2356 |
| CAG00577 | SZEY-27A_GL0042977 | SEQ ID NO: 2357 |
| CAG00577 | MH0205_GL0010899 | SEQ ID NO: 2358 |
| CAG00577 | V1.UC29-0_GL0089797 | SEQ ID NO: 2359 |
| CAG00577 | MH0122_GL0103058 | SEQ ID NO: 2360 |
| CAG00577 | MH0187_GL0139420 | SEQ ID NO: 2361 |
| CAG00577 | MH0335_GL0015488 | SEQ ID NO: 2362 |
| CAG00577 | NOM027_GL0026387 | SEQ ID NO: 2363 |
| CAG00577 | MH0187_GL0161161 | SEQ ID NO: 2364 |
| CAG00577 | MH0161_GL0136297 | SEQ ID NO: 2365 |
| CAG00577 | MH0119_GL0032510 | SEQ ID NO: 2366 |
| CAG00577 | MH0264_GL0010910 | SEQ ID NO: 2367 |
| CAG00577 | 718252.FP2_01730 | SEQ ID NO: 2368 |
| CAG00577 | MH0176_GL0108424 | SEQ ID NO: 2369 |
| CAG00577 | D0M001_GL0044227 | SEQ ID NO: 2370 |
| CAG00577 | N052A_GL0044576 | SEQ ID NO: 2371 |
| CAG00577 | MH0161_GL0138976 | SEQ ID NO: 2372 |
| CAG00577 | MH0192_GL0138753 | SEQ ID NO: 2373 |
| CAG00577 | MH0161_GL0035380 | SEQ ID NO: 2374 |
| CAG00577 | MH0122_GL0085848 | SEQ ID NO: 2375 |
| CAG00577 | MH0161_GL0148787 | SEQ ID NO: 2376 |
| CAG00506 | V1.FI06_GL0142877 | SEQ ID NO: 2377 |
| CAG00506 | V1.FI06_GL0081750 | SEQ ID NO: 2378 |
| CAG00506 | MH0245_GL0098106 | SEQ ID NO: 2379 |
| CAG00506 | MH0193_GL0061145 | SEQ ID NO: 2380 |
| CAG00506 | O2.UC8-1_GL0071926 | SEQ ID NO: 2381 |
| CAG00506 | V1.FI06_GL0177878 | SEQ ID NO: 2382 |
| CAG00506 | V1.FI28_GL0124123 | SEQ ID NO: 2383 |
| CAG00506 | MH0245_GL0120503 | SEQ ID NO: 2384 |
| CAG00506 | MH0245_GL0092011 | SEQ ID NO: 2385 |
| CAG00506 | V1.FI10_GL0059693 | SEQ ID NO: 2386 |
| CAG00506 | O2.UC49-0_GL0011326 | SEQ ID NO: 2387 |
| CAG00506 | MH0203_GL0113000 | SEQ ID NO: 2388 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00506 | V1.FI20_GL0186097 | SEQ ID NO: 2389 |
| CAG00506 | V1.FI06_GL0107857 | SEQ ID NO: 2390 |
| CAG00506 | V1.FI06_GL0098842 | SEQ ID NO: 2391 |
| CAG00506 | O2.UC49-0_GL0130004 | SEQ ID NO: 2392 |
| CAG00506 | MH0358_GL0115004 | SEQ ID NO: 2393 |
| CAG00506 | V1.FI06_GL0024747 | SEQ ID NO: 2394 |
| CAG00506 | MH0239_GL0117717 | SEQ ID NO: 2395 |
| CAG00506 | MH0239_GL0116017 | SEQ ID NO: 2396 |
| CAG00506 | MH0233_GL0077458 | SEQ ID NO: 2397 |
| CAG00506 | O2.UC49-0_GL0070852 | SEQ ID NO: 2398 |
| CAG00506 | O2.UC49-0_GL0108955 | SEQ ID NO: 2399 |
| CAG00506 | V1.FI06_GL0203007 | SEQ ID NO: 2400 |
| CAG00506 | MH0378_GL0199978 | SEQ ID NO: 2401 |
| CAG00506 | V1.FI06_GL0046835 | SEQ ID NO: 2402 |
| CAG00506 | MH0245_GL0041180 | SEQ ID NO: 2403 |
| CAG00506 | MH0203_GL0089458 | SEQ ID NO: 2404 |
| CAG00506 | MH0245_GL0125120 | SEQ ID NO: 2405 |
| CAG00506 | MH0203_GL0064889 | SEQ ID NO: 2406 |
| CAG00506 | MH0245_GL0071752 | SEQ ID NO: 2407 |
| CAG00506 | MH0203_GL0200298 | SEQ ID NO: 2408 |
| CAG00506 | V1.FI20_GL0027361 | SEQ ID NO: 2409 |
| CAG00506 | MH0203_GL0178685 | SEQ ID NO: 2410 |
| CAG00506 | V1.FI10_GL0046508 | SEQ ID NO: 2411 |
| CAG00506 | MH0432_GL0047693 | SEQ ID NO: 2412 |
| CAG00506 | O2.UC49-0_GL0121013 | SEQ ID NO: 2413 |
| CAG00506 | MH0462_GL0072403 | SEQ ID NO: 2414 |
| CAG00506 | MH0203_GL0133407 | SEQ ID NO: 2415 |
| CAG00506 | MH0203_GL0208700 | SEQ ID NO: 2416 |
| CAG00506 | V1.FI06_GL0090451 | SEQ ID NO: 2417 |
| CAG00506 | MH0203_GL0189162 | SEQ ID NO: 2418 |
| CAG00506 | O2.UC11-1_GL0130864 | SEQ ID NO: 2419 |
| CAG00506 | MH0239_GL0150262 | SEQ ID NO: 2420 |
| CAG00506 | MH0239_GL0100836 | SEQ ID NO: 2421 |
| CAG00506 | MH0203_GL0271131 | SEQ ID NO: 2422 |
| CAG00506 | MH0378_GL0026482 | SEQ ID NO: 2423 |
| CAG00506 | V1.FI06_GL0103649 | SEQ ID NO: 2424 |
| CAG00506 | MH0245_GL0014270 | SEQ ID NO: 2425 |
| CAG00506 | O2.UC8-1_GL0090917 | SEQ ID NO: 2426 |
| CAG00852 | 428126.CLOSPI_01703 | SEQ ID NO: 2427 |
| CAG00852 | 428126.CLOSPI_01048 | SEQ ID NO: 2428 |
| CAG00852 | T2D-62A_GL0056517 | SEQ ID NO: 2429 |
| CAG00852 | V1.UC55-0_GL0234527 | SEQ ID NO: 2430 |
| CAG00852 | 428126.CLOSPI_00163 | SEQ ID NO: 2431 |
| CAG00852 | T2D-62A_GL0062993 | SEQ ID NO: 2432 |
| CAG00852 | 428126.CLOSPI_02499 | SEQ ID NO: 2433 |
| CAG00852 | T2D-62A_GL0063552 | SEQ ID NO: 2434 |
| CAG00852 | T2D-62A_GL0037637 | SEQ ID NO: 2435 |
| CAG00852 | 428126.CLOSPI_01729 | SEQ ID NO: 2436 |
| CAG00852 | 428126.CLOSPI_01154 | SEQ ID NO: 2437 |
| CAG00852 | T2D-62A_GL0042747 | SEQ ID NO: 2438 |
| CAG00852 | O2.UC48-0_GL0287483 | SEQ ID NO: 2439 |
| CAG00852 | T2D-62A_GL0007270 | SEQ ID NO: 2440 |
| CAG00852 | 428126.CLOSPI_01676 | SEQ ID NO: 2441 |
| CAG00852 | T2D-62A_GL0005689 | SEQ ID NO: 2442 |
| CAG00852 | 428126.CLOSPI_00564 | SEQ ID NO: 2443 |
| CAG00852 | T2D-62A_GL0018962 | SEQ ID NO: 2444 |
| CAG00852 | 428126.CLOSPI_01979 | SEQ ID NO: 2445 |
| CAG00852 | T2D-62A_GL0003361 | SEQ ID NO: 2446 |
| CAG00852 | 763820215-stool1_revised_C753290_1_gene28165 | SEQ ID NO: 2447 |
| CAG00852 | T2D-62A_GL0015998 | SEQ ID NO: 2448 |
| CAG00852 | 428126.CLOSPI_00074 | SEQ ID NO: 2449 |
| CAG00852 | T2D-62A_GL0003189 | SEQ ID NO: 2450 |
| CAG00852 | 763820215-stool1_revised_C751872_1_gene53758 | SEQ ID NO: 2451 |
| CAG00852 | 428126.CLOSPI_00417 | SEQ ID NO: 2452 |
| CAG00852 | T2D-62A_GL0002497 | SEQ ID NO: 2453 |
| CAG00852 | 763820215-stool1_revised_C753944_1_gene52720 | SEQ ID NO: 2454 |
| CAG00852 | 428126.CLOSPI_02466 | SEQ ID NO: 2455 |
| CAG00852 | T2D-62A_GL0035007 | SEQ ID NO: 2456 |
| CAG00852 | T2D-62A_GL0003764 | SEQ ID NO: 2457 |
| CAG00852 | V1.UC41-0_GL0059442 | SEQ ID NO: 2458 |
| CAG00852 | T2D-62A_GL0024874 | SEQ ID NO: 2459 |
| CAG00852 | 428126.CLOSPI_01977 | SEQ ID NO: 2460 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00852 | 428126.CLOSPI_02118 | SEQ ID NO: 2461 |
| CAG00852 | T2D-62A_GL0037428 | SEQ ID NO: 2462 |
| CAG00852 | 763820215-stool1_revised_C751758_1_gene22231 | SEQ ID NO: 2463 |
| CAG00852 | T2D-62A_GL0039739 | SEQ ID NO: 2464 |
| CAG00852 | T2D-62A_GL0058023 | SEQ ID NO: 2465 |
| CAG00852 | T2D-62A_GL0031255 | SEQ ID NO: 2466 |
| CAG00852 | T2D-62A_GL0033716 | SEQ ID NO: 2467 |
| CAG00852 | 428126.CLOSPI_00717 | SEQ ID NO: 2468 |
| CAG00852 | T2D-62A_GL0030287 | SEQ ID NO: 2469 |
| CAG00852 | 428126.CLOSPI_00347 | SEQ ID NO: 2470 |
| CAG00852 | T2D-62A_GL0037352 | SEQ ID NO: 2471 |
| CAG00852 | T2D-62A_GL0060825 | SEQ ID NO: 2472 |
| CAG00852 | 428126.CLOSPI_00649 | SEQ ID NO: 2473 |
| CAG00852 | T2D-62A_GL0036985 | SEQ ID NO: 2474 |
| CAG00852 | T2D-62A_GL0062259 | SEQ ID NO: 2475 |
| CAG00852 | T2D-62A_GL0014638 | SEQ ID NO: 2476 |
| CAG01046 | MH0419_GL0134444 | SEQ ID NO: 2477 |
| CAG01046 | MH0419_GL0081415 | SEQ ID NO: 2478 |
| CAG01046 | T2D-11A_GL0089312 | SEQ ID NO: 2479 |
| CAG01046 | V1.UC26-4_GL0178700 | SEQ ID NO: 2480 |
| CAG01046 | MH0419_GL0141746 | SEQ ID NO: 2481 |
| CAG01046 | MH0419_GL0161227 | SEQ ID NO: 2482 |
| CAG01046 | MH0419_GL0057166 | SEQ ID NO: 2483 |
| CAG01046 | MH0419_GL0101764 | SEQ ID NO: 2484 |
| CAG01046 | MH0419_GL0055784 | SEQ ID NO: 2485 |
| CAG01046 | MH0419_GL0009850 | SEQ ID NO: 2486 |
| CAG01046 | MH0419_GL0144211 | SEQ ID NO: 2487 |
| CAG01046 | MH0419_GL0129970 | SEQ ID NO: 2488 |
| CAG01046 | MH0419_GL0133667 | SEQ ID NO: 2489 |
| CAG01046 | MH0419_GL0087423 | SEQ ID NO: 2490 |
| CAG01046 | MH0419_GL0128079 | SEQ ID NO: 2491 |
| CAG01046 | MH0419_GL0181480 | SEQ ID NO: 2492 |
| CAG01046 | MH0419_GL0089745 | SEQ ID NO: 2493 |
| CAG01046 | V1.UC26-4_GL0196540 | SEQ ID NO: 2494 |
| CAG01046 | MH0402_GL0215165 | SEQ ID NO: 2495 |
| CAG01046 | MH0419_GL0134445 | SEQ ID NO: 2496 |
| CAG01046 | MH0419_GL0094834 | SEQ ID NO: 2497 |
| CAG01046 | MH0419_GL0113310 | SEQ ID NO: 2498 |
| CAG01046 | MH0419_GL0033530 | SEQ ID NO: 2499 |
| CAG01046 | MH0419_GL0173114 | SEQ ID NO: 2500 |
| CAG01046 | MH0419_GL0121366 | SEQ ID NO: 2501 |
| CAG01046 | MH0419_GL0188727 | SEQ ID NO: 2502 |
| CAG01046 | MH0419_GL0167995 | SEQ ID NO: 2503 |
| CAG01046 | MH0419_GL0109090 | SEQ ID NO: 2504 |
| CAG01046 | MH0419_GL0139393 | SEQ ID NO: 2505 |
| CAG01046 | MH0419_GL0028139 | SEQ ID NO: 2506 |
| CAG01046 | MH0419_GL0134374 | SEQ ID NO: 2507 |
| CAG01046 | MH0419_GL0129214 | SEQ ID NO: 2508 |
| CAG01046 | MH0419_GL0015783 | SEQ ID NO: 2509 |
| CAG01046 | MH0419_GL0136244 | SEQ ID NO: 2510 |
| CAG01046 | MH0419_GL0058520 | SEQ ID NO: 2511 |
| CAG01046 | MH0419_GL0093672 | SEQ ID NO: 2512 |
| CAG01046 | MH0419_GL0081494 | SEQ ID NO: 2513 |
| CAG01046 | MH0419_GL0071701 | SEQ ID NO: 2514 |
| CAG01046 | V1.UC26-4_GL0014931 | SEQ ID NO: 2515 |
| CAG01046 | MH0419_GL0021131 | SEQ ID NO: 2516 |
| CAG01046 | MH0419_GL0154413 | SEQ ID NO: 2517 |
| CAG01046 | MH0419_GL0065735 | SEQ ID NO: 2518 |
| CAG01046 | MH0419_GL0154182 | SEQ ID NO: 2519 |
| CAG01046 | V1.UC26-4_GL0114982 | SEQ ID NO: 2520 |
| CAG01046 | MH0419_GL0093098 | SEQ ID NO: 2521 |
| CAG01046 | MH0419_GL0119499 | SEQ ID NO: 2522 |
| CAG01046 | MH0419_GL0031857 | SEQ ID NO: 2523 |
| CAG01046 | MH0419_GL0126857 | SEQ ID NO: 2524 |
| CAG01046 | V1.UC26-4_GL0009310 | SEQ ID NO: 2525 |
| CAG01046 | MH0419_GL0189867 | SEQ ID NO: 2526 |
| CAG00320 | MH0026_GL0048591 | SEQ ID NO: 2527 |
| CAG00320 | NOM005_GL0026873 | SEQ ID NO: 2528 |
| CAG00320 | 764143897-stool2_revised_scaffold25132_1_gene18467 | SEQ ID NO: 2529 |
| CAG00320 | MH0425_GL0149489 | SEQ ID NO: 2530 |
| CAG00320 | 158742018-stool1_revised_C792715_1_gene81439 | SEQ ID NO: 2531 |
| CAG00320 | NOF008_GL0017986 | SEQ ID NO: 2532 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00320 | O2.UC59-2__GL0012634 | SEQ ID NO: 2533 |
| CAG00320 | MH0016__GL0070979 | SEQ ID NO: 2534 |
| CAG00320 | MH0184__GL0080481 | SEQ ID NO: 2535 |
| CAG00320 | 158742018-stool1_revised_scaffold24144_1_gene122932 | SEQ ID NO: 2536 |
| CAG00320 | MH0089__GL0068788 | SEQ ID NO: 2537 |
| CAG00320 | MH0016__GL0078176 | SEQ ID NO: 2538 |
| CAG00320 | 160421117-stool1_revised_C297599_1_gene60160 | SEQ ID NO: 2539 |
| CAG00320 | 706846339-stool1_revised_scaffold53564_1_gene171437 | SEQ ID NO: 2540 |
| CAG00320 | MH0026__GL0006163 | SEQ ID NO: 2541 |
| CAG00320 | MH0016__GL0036082 | SEQ ID NO: 2542 |
| CAG00320 | NLM007__GL0004685 | SEQ ID NO: 2543 |
| CAG00320 | MH0150__GL0154882 | SEQ ID NO: 2544 |
| CAG00320 | T2D-149A__GL0033867 | SEQ ID NO: 2545 |
| CAG00320 | MH0016__GL0011934 | SEQ ID NO: 2546 |
| CAG00320 | NLM017__GL0047166 | SEQ ID NO: 2547 |
| CAG00320 | 764062976-stool1_revised_C1266385_1_gene114204 | SEQ ID NO: 2548 |
| CAG00320 | MH0026__GL0039721 | SEQ ID NO: 2549 |
| CAG00320 | DOF013__GL0043028 | SEQ ID NO: 2550 |
| CAG00320 | MH0016__GL0082126 | SEQ ID NO: 2551 |
| CAG00320 | MH0089__GL0034565 | SEQ ID NO: 2552 |
| CAG00320 | O2.UC35-0__GL0081200 | SEQ ID NO: 2553 |
| CAG00320 | V1.UC11-0__GL0089485 | SEQ ID NO: 2554 |
| CAG00320 | MH0026__GL0013353 | SEQ ID NO: 2555 |
| CAG00320 | NOM007__GL0045210 | SEQ ID NO: 2556 |
| CAG00320 | MH0016__GL0075426 | SEQ ID NO: 2557 |
| CAG00320 | MH0026__GL0019542 | SEQ ID NO: 2558 |
| CAG00320 | MH0016__GL0014232 | SEQ ID NO: 2559 |
| CAG00320 | T2D-178A__GL0095543 | SEQ ID NO: 2560 |
| CAG00320 | NLM005__GL0019993 | SEQ ID NO: 2561 |
| CAG00320 | 765094712-stool1_revised_C356815_1_gene59944 | SEQ ID NO: 2562 |
| CAG00320 | DOM020__GL0029204 | SEQ ID NO: 2563 |
| CAG00320 | DOM019__GL0099701 | SEQ ID NO: 2564 |
| CAG00320 | O2.UC59-2__GL0006731 | SEQ ID NO: 2565 |
| CAG00320 | SZEY-68A__GL0089081 | SEQ ID NO: 2566 |
| CAG00320 | DOM021__GL0005579 | SEQ ID NO: 2567 |
| CAG00320 | NLF014__GL0047448 | SEQ ID NO: 2568 |
| CAG00320 | N044A__GL0039024 | SEQ ID NO: 2569 |
| CAG00320 | 764325968-stool2_revised_scaffold4874_1_gene4212 | SEQ ID NO: 2570 |
| CAG00320 | MH0026__GL0044579 | SEQ ID NO: 2571 |
| CAG00320 | T2D-140A__GL0085864 | SEQ ID NO: 2572 |
| CAG00320 | 160400887-stool1_revised_C1320145_1_gene238639 | SEQ ID NO: 2573 |
| CAG00320 | MH0026__GL0018472 | SEQ ID NO: 2574 |
| CAG00320 | NLM005__GL0048100 | SEQ ID NO: 2575 |
| CAG00320 | MH0445__GL0034623 | SEQ ID NO: 2576 |
| CAG00619 | O2.UC27-1__GL0096976 | SEQ ID NO: 2577 |
| CAG00619 | MH0230__GL0113758 | SEQ ID NO: 2578 |
| CAG00619 | MH0425__GL0121626 | SEQ ID NO: 2579 |
| CAG00619 | MH0244__GL0025967 | SEQ ID NO: 2580 |
| CAG00619 | MH0244__GL0032296 | SEQ ID NO: 2581 |
| CAG00619 | MH0271__GL0061023 | SEQ ID NO: 2582 |
| CAG00619 | O2.UC38-2__GL0069803 | SEQ ID NO: 2583 |
| CAG00619 | MH0204__GL0120612 | SEQ ID NO: 2584 |
| CAG00619 | MH0244__GL0010807 | SEQ ID NO: 2585 |
| CAG00619 | MH0204__GL0179682 | SEQ ID NO: 2586 |
| CAG00619 | MH0204__GL0036337 | SEQ ID NO: 2587 |
| CAG00619 | MH0193__GL0128370 | SEQ ID NO: 2588 |
| CAG00619 | MH0272__GL0006105 | SEQ ID NO: 2589 |
| CAG00619 | MH0204__GL0007448 | SEQ ID NO: 2590 |
| CAG00619 | MH0244__GL0123950 | SEQ ID NO: 2591 |
| CAG00619 | MH0204__GL0176256 | SEQ ID NO: 2592 |
| CAG00619 | V1.FI28__GL0078516 | SEQ ID NO: 2593 |
| CAG00619 | MH0230__GL0095497 | SEQ ID NO: 2594 |
| CAG00619 | MH0204__GL0074260 | SEQ ID NO: 2595 |
| CAG00619 | MH0230__GL0167508 | SEQ ID NO: 2596 |
| CAG00619 | MH0204__GL0098332 | SEQ ID NO: 2597 |
| CAG00619 | MH0244__GL0082048 | SEQ ID NO: 2598 |
| CAG00619 | MH0204__GL0039377 | SEQ ID NO: 2599 |
| CAG00619 | MH0244__GL0008613 | SEQ ID NO: 2600 |
| CAG00619 | MH0244__GL0022447 | SEQ ID NO: 2601 |
| CAG00619 | MH0412__GL0150687 | SEQ ID NO: 2602 |
| CAG00619 | MH0244__GL0043838 | SEQ ID NO: 2603 |
| CAG00619 | MH0204__GL0088591 | SEQ ID NO: 2604 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG00619 | MH0204_GL0003543 | SEQ ID NO: 2605 |
| CAG00619 | MH0244_GL0046019 | SEQ ID NO: 2606 |
| CAG00619 | MH0230_GL0158262 | SEQ ID NO: 2607 |
| CAG00619 | MH0305_GL0053525 | SEQ ID NO: 2608 |
| CAG00619 | MH0230_GL0097229 | SEQ ID NO: 2609 |
| CAG00619 | MH0204_GL0058174 | SEQ ID NO: 2610 |
| CAG00619 | MH0204_GL0190107 | SEQ ID NO: 2611 |
| CAG00619 | MH0425_GL0083676 | SEQ ID NO: 2612 |
| CAG00619 | MH0162_GL0125751 | SEQ ID NO: 2613 |
| CAG00619 | MH0193_GL0053644 | SEQ ID NO: 2614 |
| CAG00619 | MH0230_GL0023755 | SEQ ID NO: 2615 |
| CAG00619 | MH0193_GL0121539 | SEQ ID NO: 2616 |
| CAG00619 | V1.FI28_GL0081089 | SEQ ID NO: 2617 |
| CAG00619 | MH0230_GL0127895 | SEQ ID NO: 2618 |
| CAG00619 | MH0193_GL0111037 | SEQ ID NO: 2619 |
| CAG00619 | MH0162_GL0105293 | SEQ ID NO: 2620 |
| CAG00619 | 764325968-stool2_revised_scaffold26651_2_gene129299 | SEQ ID NO: 2621 |
| CAG00619 | MH0244_GL0138477 | SEQ ID NO: 2622 |
| CAG00619 | MH0204_GL0146978 | SEQ ID NO: 2623 |
| CAG00619 | MH0204_GL0176255 | SEQ ID NO: 2624 |
| CAG00619 | MH0244_GL0075789 | SEQ ID NO: 2625 |
| CAG00619 | MH0230_GL0158307 | SEQ ID NO: 2626 |
| CAG01366 | 760570.HMPREF0833_11447 | SEQ ID NO: 2627 |
| CAG01366 | MH0003_GL0009797 | SEQ ID NO: 2628 |
| CAG01366 | MH0003_GL0094252 | SEQ ID NO: 2629 |
| CAG01366 | MH0003_GL0010084 | SEQ ID NO: 2630 |
| CAG01366 | MH0003_GL0022325 | SEQ ID NO: 2631 |
| CAG01366 | MH0003_GL0046585 | SEQ ID NO: 2632 |
| CAG01366 | MH0003_GL0056693 | SEQ ID NO: 2633 |
| CAG01366 | MH0003_GL0095863 | SEQ ID NO: 2634 |
| CAG01366 | MH0003_GL0045418 | SEQ ID NO: 2635 |
| CAG01366 | ED9A_GL0093685 | SEQ ID NO: 2636 |
| CAG01366 | MH0003_GL0065032 | SEQ ID NO: 2637 |
| CAG01366 | 760570.HMPREF0833_11360 | SEQ ID NO: 2638 |
| CAG01366 | 760570.HMPREF0833_12012 | SEQ ID NO: 2639 |
| CAG01366 | MH0003_GL0090470 | SEQ ID NO: 2640 |
| CAG01366 | MH0003_GL0046474 | SEQ ID NO: 2641 |
| CAG01366 | MH0003_GL0040447 | SEQ ID NO: 2642 |
| CAG01366 | MH0003_GL0018280 | SEQ ID NO: 2643 |
| CAG01366 | MH0003_GL0070887 | SEQ ID NO: 2644 |
| CAG01366 | MH0003_GL0097555 | SEQ ID NO: 2645 |
| CAG01366 | MH0003_GL0075033 | SEQ ID NO: 2646 |
| CAG01366 | 760570.HMPREF0833_10311 | SEQ ID NO: 2647 |
| CAG01366 | MH0003_GL0050527 | SEQ ID NO: 2648 |
| CAG01366 | MH0003_GL0070890 | SEQ ID NO: 2649 |
| CAG01366 | MH0003_GL0075034 | SEQ ID NO: 2650 |
| CAG01366 | MH0003_GL0114233 | SEQ ID NO: 2651 |
| CAG01366 | NLM027_GL0005333 | SEQ ID NO: 2652 |
| CAG01366 | MH0003_GL0002987 | SEQ ID NO: 2653 |
| CAG01366 | MH0003_GL0088953 | SEQ ID NO: 2654 |
| CAG01366 | MH0003_GL0042367 | SEQ ID NO: 2655 |
| CAG01366 | MH0287_GL0136304 | SEQ ID NO: 2656 |
| CAG01366 | MH0003_GL0039649 | SEQ ID NO: 2657 |
| CAG01366 | MH0003_GL0046477 | SEQ ID NO: 2658 |
| CAG01366 | MH0003_GL0001128 | SEQ ID NO: 2659 |
| CAG01366 | MH0003_GL0029627 | SEQ ID NO: 2660 |
| CAG01366 | MH0003_GL0036396 | SEQ ID NO: 2661 |
| CAG01366 | MH0003_GL0037301 | SEQ ID NO: 2662 |
| CAG01366 | MH0287_GL0182172 | SEQ ID NO: 2663 |
| CAG01366 | MH0003_GL0024528 | SEQ ID NO: 2664 |
| CAG01366 | MH0003_GL0046587 | SEQ ID NO: 2665 |
| CAG01366 | 760570.HMPREF0833_11647 | SEQ ID NO: 2666 |
| CAG01366 | MH0003_GL0009545 | SEQ ID NO: 2667 |
| CAG01366 | MH0003_GL0087011 | SEQ ID NO: 2668 |
| CAG01366 | 760570.HMPREF0833_10973 | SEQ ID NO: 2669 |
| CAG01366 | MH0003_GL0103117 | SEQ ID NO: 2670 |
| CAG01366 | MH0003_GL0114020 | SEQ ID NO: 2671 |
| CAG01366 | MH0003_GL0088954 | SEQ ID NO: 2672 |
| CAG01366 | MH0003_GL0079951 | SEQ ID NO: 2673 |
| CAG01366 | MH0003_GL0034625 | SEQ ID NO: 2674 |

TABLE 2A-continued

Shows the bacterial genes used for characterizing bacteria co-abundance gene groups (CAG) and the corresponding SEQ ID NO for each gene in the bacteria of interest. Each of the listed CAG group and gene is available on the world wide web at meta.genomics.cn/meta/dataTools, and is incorporated herein by reference.

| CAG ID | gene_name | SEQ ID |
|---|---|---|
| CAG01366 | ED9A_GL0070789 | SEQ ID NO: 2675 |
| CAG01366 | MH0003_GL0078182 | SEQ ID NO: 2676 |

The present disclosure also provides a pharmaceutical composition comprising one or more microbial cultures as described above. The bacterial species therefore are present in the dose form as live bacteria, whether in dried, lyophilized, or sporolated form. This may be preferably adapted for suitable administration; for example, in tablet or powder form, potentially with an enteric coating, for oral treatment.

In particular aspects, the composition is formulated for oral administration. Oral administration may be achieved using a chewable formulation, a dissolving formulation, an encapsulated/coated formulation, a multi-layered lozenge (to separate active ingredients and/or active ingredients and excipients), a slow release/timed release formulation, or other suitable formulations known to persons skilled in the art. Although the word "tablet" is used herein, the formulation may take a variety of physical forms that may commonly be referred to by other terms, such as lozenge, pill, capsule, or the like.

While the compositions of the present disclosure are preferably formulated for oral administration, other routes of administration can be employed, however, including, but not limited to, subcutaneous, intramuscular, intradermal, transdermal, intraocular, intraperitoneal, mucosal, vaginal, rectal, and intravenous.

The desired dose of the composition of the present disclosure may be presented in multiple (e.g., two, three, four, five, six, or more) sub-doses administered at appropriate intervals throughout the day.

In one aspect, the disclosed composition may be prepared as a capsule. The capsule (i.e., the carrier) may be a hollow, generally cylindrical capsule formed from various substances, such as gelatin, cellulose, carbohydrate or the like.

In another aspect, the disclosed composition may be prepared as a suppository. The suppository may include but is not limited to the bacteria and one or more carriers, such as polyethylene glycol, acacia, acetylated monoglycerides, carnuba wax, cellulose acetate phthalate, corn starch, dibutyl phthalate, docusate sodium, gelatin, glycerin, iron oxides, kaolin, lactose, magnesium stearate, methyl paraben, pharmaceutical glaze, povidone, propyl paraben, sodium benzoate, sorbitan monoleate, sucrose talc, titanium dioxide, white wax and coloring agents.

In some aspects, the disclosed probiotic may be prepared as a tablet. The tablet may include the bacteria and one or more tableting agents (i.e., carriers), such as dibasic calcium phosphate, stearic acid, croscarmellose, silica, cellulose and cellulose coating. The tablets may be formed using a direct compression process, though those skilled in the art will appreciate that various techniques may be used to form the tablets.

In other aspects, the disclosed probiotic may be formed as food or drink or, alternatively, as an additive to food or drink, wherein an appropriate quantity of bacteria is added to the food or drink to render the food or drink the carrier.

The probiotic compositions of the present disclosure may further comprise one or more prebiotics known in the art, such as lactitol, inulin, or a combination thereof.

In some embodiments, the compositions of the embodiments comprise one or more of the species of bacteria that produce short chain fatty acids. In particular aspects, the species of bacteria produce butyrate. For example, the bacterial population can comprise one or more bacterial species of the order Clostridiales. The Clostridiales bacteria may be substantially in spore form. In particular aspects, the bacterial species is from the family Ruminococcaceae, Christensenellaceae, Clostridiaceae or Coriobacteriacease. In some embodiments, the Clostridiales bacteria comprise a first family and a second family. In some embodiments, the first family is selected from the group consisting of Ruminococcaceae, Christensenellaceae, Clostridiaceae and Coriobacteriacease, and the second family is not identical to the first family. Examples of bacterial species include, but are not limited to, *Faecalibacterium prausnitzii, Ruminococcus albus, Ruminococcus bromii, Ruminococcus callidus, Ruminococcus flavefaciens, Ruminococcus champanellensis, Ruminococcus faecis, Ruminococcus gauvreauii, Ruminococcus gnavus, Ruminococcus hansenii, Ruminococcus hydrogenotrophicus, Ruminococcus lactaris, Ruminococcus luti, Ruminococcus obeum, Ruminococcus palustris, Ruminococcus pasteurii, Ruminococcus productus, Ruminococcus schinkii, Ruminococcus torques, Subdoligranulum variabile, Butyrivibrio fibrisolvens, Roseburia intestinalis, Anaerostipes caccae, Blautia obeum, Eubacterium nodatum*, and *Eubacterium* oxidoreducens. In particular aspects, the bacterial species is *Faecalibacterium prausnitzii*. In certain embodiments, the bacterial population does not comprise bacterial species of the class Bacteroidia or family Prevotellaceae.

In some embodiments, the bacterial population comprises bacteria of the order Clostridiales in an amount effective or sufficient to produce one or more metabolites capable of enhancing immune checkpoint therapy in the subject. In some embodiments, the one or more metabolites comprise a short chain fatty acid. In particular aspects, the short chain fatty acid is butyrate. In some embodiments, the order Clostridiales produce one or more short chain fatty acids (e.g., butyrate) in an effective amount to increase the local short chain fatty acid concentration by 2-fold, 4-fold, 5-fold, 10-fold, 50-fold, 100-fold, 1000-fold, or over 1000-fold.

In some embodiments, the probiotic composition may further comprise a food or a nutritional supplement effective to stimulate the growth of bacteria of the order Clostridiales present in the gastrointestinal tract of the subject. In some embodiments, the nutritional supplement is produced by a bacterium associated with a healthy human gut microbiome. In certain embodiments, the nutritional supplement is produced by bacteria of the order Clostridiales. In certain embodiments, the nutritional supplement comprises a short chain fatty acid. In certain embodiments, the short chain fatty acid is selected from butyrate, propionate, or a combination thereof. In particular embodiments, the short chain fatty acid is butyrate.

Accordingly, certain embodiments of the present disclosure concern administering butyrate prodrugs or salts to a subject who has been or is currently being administered an immune checkpoint inhibitor. For example, the butyrate may be sodium butyrate, arginine butyrate, ethylbutyryl lactate, tributyrin, 4-phenyl butyrate, AN-9 or AN-10. Prodrugs and salts of butyrate have been described in WO 96/15660 and in U.S. Pat. No. 5,763,488, the disclosures of which are herein incorporated by reference. Other orally available prodrugs and salts of butyrate that may be administered include, but are not limited to, isobutyramide, 1-octyl butyrate, orthonitrobenzyl butyrate, monobutyrate-3-monoacetone glucose, monobutyrate-1-monoacetone mannose, monobutyrate xylitol, isobutyramide, 4-phenylbutyrate, and 4-phenyl acetate. Each of these compounds releases butyrate or a butyrate analog into the blood stream upon administration. One or more isoforms of butyrate can include butyl butyrate, amyl butyrate, isobutyl butyrate, benzyl butyrate, α-methylbenzyl butyrate, hexyl butyrate, heptyl butyrate, pennetyl butyrate, methyl butyrate, and 2-hydroxy-3-methylbutanoic acid.

In further embodiments, the present disclosure concerns methods of obtaining a microbiome profile, comprising the steps of: i) obtaining a sample obtained from a subject (e.g., a human subject), ii) isolating one or more bacterial species from the sample, iii) isolating one or more nucleic acids from at least one bacterial species, iv) sequencing the isolated nucleic acids, and v) comparing the sequenced nucleic acids to a reference nucleic acid sequence. When performing the methods necessitating genotyping, any genotyping assay can be used. For example, this can be done by sequencing the 16S or the 23S ribosomal subunit or by metagenomics shotgun DNA sequencing associated with metatranscriptomics. The biological sample may be selected from the group comprising: whole blood, blood plasma, urine, tears, semen, saliva, buccal mucosa, interstitial fluid, lymph fluid, meningeal fluid, amniotic fluid, glandular fluid, sputum, feces, perspiration, mucous, vaginal secretion, cerebrospinal fluid, hair, skin, fecal material, wound exudate, wound homogenate, and wound fluid. In particular aspects, the sample is fecal material or a buccal sample.

In some embodiments, the microbiome profile is identified to be favorable for immune checkpoint therapy. A favorable microbial profile would have a high relative abundance of one or more bacterial species from the phylum Firmicutes, class Clostridia, order Clostridiales, family Ruminococcaceae, genus *Ruminococcus*, genus *Hydrogenoanaerobacterium*, genus *Faecalibacterium*, phylum Actinobacteria, class Coriobacteriia, order Coriaobacteriales, family Coriobacteriaceae, domain Archaea, phylum Cyanobacteria, phylum Euryarchaeota or famly Christensenellaceae. A favorable microbial profile would have a low relative abundance of bacteria from the genus *Dialister*, family Veillonellaceae, phylum Bacteroidetes, class Bacteroida, order Bacteroidales or family Prevotellaceae. Accordingly, a favorable microbial profile would have a higher relative abundance of one or more bacterial species from the phylum Firmicutes, class Clostridia, order Clostridiales, famiy Ruminococcaceae, genus *Ruminococcus*, genus *Hydrogenoanaerobacterium*, phylum Actinobacteria, class Coriobacteria, order Coriaobacteriales, family Coriobacteriaceae, domain Archaea, phylum Cyanobacteria, phylum Euryarchaeota or family Christensenellaceae, and would have a decreased abundance of one or more bacterial species from genus *Dialister*, family Veillonellaceae, phylum Bacteroidetes, class Bacteroida, order Bacteroidales and/or family Prevotellaceae.

III. IMMUNE CHECKPOINT BLOCKADE

The present disclosure provides methods of enhancing the efficacy of immune checkpoint blockade by modulating the microbiome of a subject, such as by administering a short-chain fatty acid, such as butyrate, and/or a composition comprising one or more populations of short-chain fatty acid-producing bacteria, such as butyrate-producing bacteria. Immune checkpoints either turn up a signal (e.g., co-stimulatory molecules) or turn down a signal. Inhibitory immune checkpoint molecules that may be targeted by immune checkpoint blockade include adenosine A2A receptor (A2AR), B7-H3 (also known as CD276), B and T lymphocyte attenuator (BTLA), cytotoxic T-lymphocyte-associated protein 4 (CTLA-4, also known as CD152), indoleamine 2,3-dioxygenase (IDO), killer-cell immunoglobulin (KIR), lymphocyte activation gene-3 (LAG3), programmed death 1 (PD-1), T-cell immunoglobulin domain and mucin domain 3 (TIM-3) and V-domain Ig suppressor of T cell activation (VISTA). In particular, the immune checkpoint inhibitors target the PD-1 axis and/or CTLA-4.

The immune checkpoint inhibitors may be drugs such as small molecules, recombinant forms of ligand or receptors, or, antibodies, such as human antibodies (e.g., International Patent Publication No. WO2015016718; Pardoll, *Nat Rev Cancer*, 12(4): 252-64, 2012; both incorporated herein by reference). Known inhibitors of the immune checkpoint proteins or analogs thereof may be used, in particular chimerized, humanized or human forms of antibodies may be used. As the skilled person will know, alternative and/or equivalent names may be in use for certain antibodies mentioned in the present disclosure. Such alternative and/or equivalent names are interchangeable in the context of the present invention. For example it is known that lambrolizumab is also known under the alternative and equivalent names MK-3475 and pembrolizumab.

It is contemplated that any of the immune checkpoint inhibitors that are known in the art to stimulate immune responses may be used. This includes inhibitors that directly or indirectly stimulate or enhance antigen-specific T-lymphocytes. These immune checkpoint inhibitors include, without limitation, agents targeting immune checkpoint proteins and pathways involving PD-L2, LAG3, BTLA, B7H4 and TIM3. For example, LAG3 inhibitors known in the art include soluble LAG3 (IMP321, or LAG3-Ig disclosed in WO2009044273) as well as mouse or humanized antibodies blocking human LAG3 (e.g., IMP701 disclosed in WO2008132601), or fully human antibodies blocking human LAG3 (such as disclosed in EP 2320940). Another example is provided by the use of blocking agents towards BTLA, including without limitation antibodies blocking human BTLA interaction with its ligand (such as 4C7 disclosed in WO2011014438). Yet another example is provided by the use of agents neutralizing B7H4 including without limitation antibodies to human B7H4 (disclosed in WO 2013025779, and in WO2013067492) or soluble recombinant forms of B7H4 (such as disclosed in US20120177645). Yet another example is provided by agents neutralizing B7-H3, including without limitation antibodies neutralizing human B7-H3 (e.g. MGA271 disclosed as BRCA84D and derivatives in US 20120294796). Yet another example is provided by agents targeting TIM3, including without limitation antibodies targeting human TIM3 (e.g. as disclosed in WO 2013006490 A2 or the anti-human TIM3, blocking antibody F38-2E2 disclosed by Jones et al., J Exp Med. 2008; 205(12):2763-79).

A. PD-1 Axis Antagonists

T cell dysfunction or anergy occurs concurrently with an induced and sustained expression of the inhibitory receptor, programmed death 1 polypeptide (PD-1). Thus, therapeutic targeting of PD-1 and other molecules which signal through interactions with PD-1, such as programmed death ligand 1 (PD-L1) and programmed death ligand 2 (PD-L2) is provided herein. PD-L1 is overexpressed in many cancers and is often associated with poor prognosis (Okazaki T et al., Intern. Immun. 2007 19(7):813). Thus, improved methods of treating cancer by inhibiting the PD-L1/PD-1 interaction in combination with modulating the microbiome is provided herein.

For example, PD-1 axis binding antagonists include a PD-1 binding antagonist, a PDL1 binding antagonist and a PDL2 binding antagonist. Alternative names for "PD-1" include CD279 and SLEB2. Alternative names for "PDL1" include B7-H1, B7-4, CD274, and B7-H. Alternative names for "PDL2" include B7-DC, Btdc, and CD273. In some embodiments, PD-1, PDL1, and PDL2 are human PD-1, PDL1 and PDL2.

In some embodiments, the PD-1 binding antagonist is a molecule that inhibits the binding of PD-1 to its ligand binding partners. In a specific aspect, the PD-1 ligand binding partners are PDL1 and/or PDL2. In another embodiment, a PDL1 binding antagonist is a molecule that inhibits the binding of PDL1 to its binding partners. In a specific aspect, PDL1 binding partners are PD-1 and/or B7-1. In another embodiment, the PDL2 binding antagonist is a molecule that inhibits the binding of PDL2 to its binding partners. In a specific aspect, a PDL2 binding partner is PD-1. The antagonist may be an antibody, an antigen binding fragment thereof, an immunoadhesin, a fusion protein, or oligopeptide. Exemplary antibodies are described in U.S. Pat. Nos. 8,735,553, 8,354,509, and 8,008,449, all incorporated herein by reference. Other PD-1 axis antagonists for use in the methods provided herein are known in the art such as described in U.S. Patent Application No. US20140294898, US2014022021, and US20110008369, all incorporated herein by reference.

In some embodiments, the PD-1 binding antagonist is an anti-PD-1 antibody (e.g., a human antibody, a humanized antibody, or a chimeric antibody). In some embodiments, the anti-PD-1 antibody is selected from the group consisting of nivolumab, pembrolizumab, and CT-011. In some embodiments, the PD-1 binding antagonist is an immunoadhesin (e.g., an immunoadhesin comprising an extracellular or PD-1 binding portion of PDL1 or PDL2 fused to a constant region (e.g., an Fc region of an immunoglobulin sequence). In some embodiments, the PD-1 binding antagonist is AMP-224. Nivolumab, also known as MDX-1106-04, MDX-1106, ONO-4538, BMS-936558, and OPDIVO®, is an anti-PD-1 antibody described in WO2006/121168. Pembrolizumab, also known as MK-3475, Merck 3475, lambrolizumab, KEYTRUDA®, and SCH-900475, is an anti-PD-1 antibody described in WO2009/114335. CT-011, also known as hBAT or hBAT-1, is an anti-PD-1 antibody described in WO2009/101611. AMP-224, also known as B7-DCIg, is a PDL2-Fc fusion soluble receptor described in WO2010/027827 and WO2011/066342. Additional PD-1 binding antagonists include Pidilizumab, also known as CT-011, MEDI0680, also known as AMP-514, and REGN2810.

In some embodiments, the immune checkpoint inhibitor is a PD-L1 antagonist such as Durvalumab, also known as MEDI4736, atezolizumab, also known as MPDL3280A, or avelumab, also known as MSB00010118C. In certain aspects, the immune checkpoint inhibitor is a PD-L2 antagonist such as rHIgM12B7. In some aspects, the immune checkpoint inhibitor is a LAG-3 antagonist such as, but not limited to, IMP321, and BMS-986016. The immune checkpoint inhibitor may be an adenosine A2a receptor (A2aR) antagonist such as PBF-509.

In some embodiments, the antibody described herein (such as an anti-PD-1 antibody, an anti-PDL1 antibody, or an anti-PDL2 antibody) further comprises a human or murine constant region. In a still further aspect, the human constant region is selected from the group consisting of IgG1, IgG2, IgG2, IgG3, and IgG4. In a still further specific aspect, the human constant region is IgG1. In a still further aspect, the murine constant region is selected from the group consisting of IgG1, IgG2A, IgG2B, and IgG3. In a still further specific aspect, the antibody has reduced or minimal effector function. In a still further specific aspect, the minimal effector function results from production in prokaryotic cells. In a still further specific aspect the minimal effector function results from an "effector-less Fc mutation" or aglycosylation.

Accordingly, an antibody used herein can be aglycosylated. Glycosylation of antibodies is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxy amino acid, most commonly serine or threonine, although 5-hydroxyproline or 5-hydroxy lysine may also be used. Removal of glycosylation sites form an antibody is conveniently accomplished by altering the amino acid sequence such that one of the above-described tripeptide sequences (for N-linked glycosylation sites) is removed. The alteration may be made by substitution of an asparagine, serine or threonine residue within the glycosylation site another amino acid residue (e.g., glycine, alanine or a conservative substitution).

The antibody or antigen binding fragment thereof, may be made using methods known in the art, for example, by a process comprising culturing a host cell containing nucleic acid encoding any of the previously described anti-PDL1, anti-PD-1, or anti-PDL2 antibodies or antigen-binding fragment in a form suitable for expression, under conditions suitable to produce such antibody or fragment, and recovering the antibody or fragment.

B. CTLA-4

Another immune checkpoint that can be targeted in the methods provided herein is the cytotoxic T-lymphocyte-associated protein 4 (CTLA-4), also known as CD152. The complete cDNA sequence of human CTLA-4 has the Genbank accession number L15006. CTLA-4 is found on the surface of T cells and acts as an "off" switch when bound to CD80 or CD86 on the surface of antigen-presenting cells. CTLA4 is a member of the immunoglobulin superfamily that is expressed on the surface of Helper T cells and transmits an inhibitory signal to T cells. CTLA4 is similar to the T-cell co-stimulatory protein, CD28, and both molecules bind to CD80 and CD86, also called B7-1 and B7-2 respectively, on antigen-presenting cells. CTLA4 transmits an inhibitory signal to T cells, whereas CD28 transmits a stimulatory signal. Intracellular CTLA4 is also found in regulatory T cells and may be important to their function. T cell activation through the T cell receptor and CD28 leads to increased expression of CTLA-4, an inhibitory receptor for B7 molecules.

In some embodiments, the immune checkpoint inhibitor is an anti-CTLA-4 antibody (e.g., a human antibody, a humanized antibody, or a chimeric antibody), an antigen binding fragment thereof, an immunoadhesin, a fusion protein, or oligopeptide.

Anti-human-CTLA-4 antibodies (or VH and/or VL domains derived therefrom) suitable for use in the present methods can be generated using methods well known in the art. Alternatively, art recognized anti-CTLA-4 antibodies can be used. For example, the anti-CTLA-4 antibodies disclosed in: U.S. Pat. No. 8,119,129, WO 01/14424, WO 98/42752; WO 00/37504 (CP675,206, also known as tremelimumab; formerly ticilimumab), U.S. Pat. No. 6,207,156; Hurwitz et al., 1998; can be used in the methods disclosed herein. The teachings of each of the aforementioned publications are hereby incorporated by reference. Antibodies that compete with any of these art-recognized antibodies for binding to CTLA-4 also can be used. For example, a humanized CTLA-4 antibody is described in International Patent Application No. WO2001014424, WO2000037504, and U.S. Pat. No. 8,017,114; all incorporated herein by reference.

An exemplary anti-CTLA-4 antibody is ipilimumab (also known as 10D1, MDX-010, MDX-101, and Yervoy®) or antigen binding fragments and variants thereof (see, e.g., WO01/14424). In other embodiments, the antibody comprises the heavy and light chain CDRs or VRs of ipilimumab. Accordingly, in one embodiment, the antibody comprises the CDR1, CDR2, and CDR3 domains of the VH region of ipilimumab, and the CDR1, CDR2 and CDR3 domains of the VL region of ipilimumab. In another embodiment, the antibody competes for binding with and/or binds to the same epitope on CTLA-4 as the above-mentioned antibodies. In another embodiment, the antibody has at least about 90% variable region amino acid sequence identity with the above-mentioned antibodies (e.g., at least about 90%, 95%, or 99% variable region identity with ipilimumab).

Other molecules for modulating CTLA-4 include soluble CTLA-4 ligands and receptors such as described in U.S. Pat. Nos. 5,844,905, 5,885,796 and International Patent Application Nos. WO1995001994 and WO1998042752; all incorporated herein by reference, and immunoadhesins such as described in U.S. Pat. No. 8,329,867, incorporated herein by reference.

C. Killer Immunoglobulin-Like Receptor (KIR)

Another immune checkpoint inhibitor for use in the present disclosure is an anti-MR antibody. Anti-human-MR antibodies (or VH/VL domains derived therefrom) suitable for use in the present methods can be generated using methods well known in the art.

Alternatively, art recognized anti-MR antibodies can be used. The anti-KIR antibody can be cross-reactive with multiple inhibitory KIR receptors and potentiates the cytotoxicity of NK cells bearing one or more of these receptors. For example, the anti-KIR antibody may bind to each of KIR2D2DL1, KIR2DL2, and KIR2DL3, and potentiate NK cell activity by reducing, neutralizing and/or reversing inhibition of NK cell cytotoxicity mediated by any or all of these KIRs. In some aspects, the anti-KIR antibody does not bind KIR2DS4 and/or KIR2DS3. For example, monoclonal antibodies 1-7F9 (also known as IPH2101), 14F1, 1-6F1 and 1-6F5, described in WO 2006/003179, the teachings of which are hereby incorporated by reference, can be used. Antibodies that compete with any of these art-recognized antibodies for binding to KIR also can be used. Additional art-recognized anti-KIR antibodies which can be used include, for example, those disclosed in WO 2005/003168, WO 2005/009465, WO 2006/072625, WO 2006/072626, WO 2007/042573, WO 2008/084106, WO 2010/065939, WO 2012/071411 and WO 2012/160448.

An exemplary anti-MR antibody is lirilumab (also referred to as BMS-986015 or IPH2102). In other embodiments, the anti-KIR antibody comprises the heavy and light chain complementarity determining regions (CDRs) or variable regions (VRs) of lirilumab. Accordingly, in one embodiment, the antibody comprises the CDR1, CDR2, and CDR3 domains of the heavy chain variable (VH) region of lirilumab, and the CDR1, CDR2 and CDR3 domains of the light chain variable (VL) region of lirilumab. In another embodiment, the antibody has at least about 90% variable region amino acid sequence identity with lirilumab.

IV. METHODS OF TREATMENT

Provided herein are methods for treating or delaying progression of cancer in an individual comprising administering to the individual an effective or sufcicient amount of a short-chain fatty acid, such as butyrate, and/or populations of short-chain fatty acid-producing bacteria, such as butyrate-producing bacteria, to a subject who has been or is currently being administered immune checkpoint therapy. Also provided herein are methods of selecting subjects who will respond favorably to immune checkpoint therapy by assessing the microbial profile of the subject and administering immune checkpoint inhibitor to a subject identified to have a favorable microbial profile.

In some embodiments, the treatment results in a sustained response in the individual after cessation of the treatment. The methods described herein may find use in treating conditions where enhanced immunogenicity is desired such as increasing tumor immunogenicity for the treatment of cancer. Also provided herein are methods of enhancing immune function such as in an individual having cancer comprising administering to the individual an effective amount of an immune checkpoint inhibitor (e.g., PD-1 axis binding antagonist and/or CTLA-4 antibody) and a short-chain fatty acid, such as butyrate, and/or populations of short-chain fatty acid-producing bacteria, such as butyrate-producing bacteria. In some embodiments, the individual is a human.

Examples of cancers contemplated for treatment include lung cancer, head and neck cancer, breast cancer, pancreatic cancer, prostate cancer, renal cancer, bone cancer, testicular cancer, cervical cancer, gastrointestinal cancer, lymphomas, pre-neoplastic lesions in the lung, colon cancer, melanoma, metastatic melanoma, basal-cell skin cancer, squamous-cell skin cancer, dermatofibrosarcoma protuberans, Merkel cell carcinoma, Kaposi's sarcoma, keratoacanthoma, spindle cell tumors, sebaceous carcinomas, microcystic adnexal carcinoma, Paget's disease of the breast, atypical fibroxanthoma, leiomyosarcoma, and angiosarcoma, Lentigo Maligna, Lentigo Maligna Melanoma, Superficial Spreading Melanoma, Nodular Melanoma, Acral Lentiginous Melanoma, Desmoplastic Melanoma, and bladder cancer.

In some embodiments, the individual has cancer that is resistant (has been demonstrated to be resistant) to one or more anti-cancer therapies. In some embodiments, resistance to anti-cancer therapy includes recurrence of cancer or refractory cancer. Recurrence may refer to the reappearance of cancer, in the original site or a new site, after treatment. In some embodiments, resistance to anti-cancer therapy includes progression of the cancer during treatment with the anti-cancer therapy. In some embodiments, the cancer is at early stage or at late stage.

The individual may have a cancer that expresses (has been shown to express e.g., in a diagnostic test) PD-L1 biomarker. In some embodiments, the patient's cancer expresses low PD-L1 biomarker. In some embodiments, the patient's cancer expresses high PD-L1 biomarker. The PD-L1 biomarker can be detected in the sample using a method selected from the group consisting of FACS, Western blot, ELISA, immunoprecipitation, immunohistochemistry, immunofluorescence, radioimmunoassay, dot blotting, immunodetection methods, HPLC, surface plasmon resonance, optical spectroscopy, mass spectrometery, HPLC, qPCR, RT-qPCR, multiplex qPCR or RT-qPCR, RNA-seq, microarray analysis, SAGE, MassARRAY technique, and FISH, and combinations thereof.

In some embodiments of the methods of the present disclosure, the cancer has low levels of T cell infiltration. In some embodiments, the cancer has no detectable T cell infiltrate. In some embodiments, the cancer is a non-immunogenic cancer (e.g., non-immunogenic colorectal cancer and/or ovarian cancer). Without being bound by theory, the combination treatment may increase T cell (e.g., $CD4^+$ T cell, $CD8^+$ T cell, memory T cell) priming, activation, proliferation, and/or infiltration relative to prior to the administration of the combination.

A. Administration

The therapy provided herein comprises administration of an immune checkpoint inhibitor, a prebiotic or probiotic composition comprising a short-chain fatty acid, such as butyrate, and/or populations of short-chain fatty acid-producing bacteria, such as butyrate-producing bacteria. The therapy may be administered in any suitable manner known in the art. For example, of an immune checkpoint inhibitor (e.g., PD-1 axis binding antagonist and/or CTLA-4 antibody), and a short-chain fatty acid, such as butyrate, and/or populations of short-chain fatty acid-producing bacteria, such as butyrate-producing bacteria, may be administered sequentially (at different times) or concurrently (at the same time). In some embodiments, the one or more immune checkpoint inhibitors are in a separate composition as the probiotic therapy. In some embodiments, the immune checkpoint inhibitor is in the same composition as the probiotic composition.

According to a preferred embodiment, the probiotic bacterial composition is formulated for oral administration. The skilled artisan knows a variety of formulas which can encompass living or killed microorganisms and which can present as food supplements (e.g., pills, tablets and the like) or as functional food such as drinks or fermented yogurts.

The one or more immune checkpoint inhibitors and the short-chain fatty acid, such as butyrate, and/or populations of short-chain fatty acid-producing bacteria, such as butyrate-producing bacteria, may be administered by the same route of administration or by different routes of administration. In some embodiments, the immune checkpoint inhibitor is administered intravenously, intramuscularly, subcutaneously, topically, orally, transdermally, intraperitoneally, intraorbitally, by implantation, by inhalation, intrathecally, intraventricularly, or intranasally. In some embodiments, the short-chain fatty acid, such as butyrate, and/or population of short-chain fatty acid-producing bacteria, such as butyrate-producing bacteria, is administered intravenously, intramuscularly, subcutaneously, topically, orally, transdermally, intraperitoneally, intraorbitally, by implantation, by inhalation, intrathecally, intraventricularly, or intranasally. In particular aspects, the immune checkpoint inhibitor is administered intravenously and the short-chain fatty acid, such as butyrate, and/or population of short-chain fatty acid-producing bacteria, such as butyrate-producing bacteria, is administered orally. An effective amount of the immune checkpoint inhibitor and the short-chain fatty acid, such as butyrate, and/or population of short-chain fatty acid-producing bacteria, such as butyrate-producing bacteria, may be administered for prevention or treatment of disease. The appropriate dosage of immune checkpoint inhibitor and/or the short-chain fatty acid, such as butyrate, and/or population of short-chain fatty acid-producing bacteria, such as butyrate-producing bacteria may be determined based on the type of disease to be treated, severity and course of the disease, the clinical condition of the individual, the individual's clinical history and response to the treatment, and the discretion of the attending physician.

For example, the therapeutically effective or sufficient amount of the immune checkpoint inhibitor, such as an antibody and/or short-chain fatty acid, such as butyrate, that is administered to a human will be in the range of about 0.01 to about 50 mg/kg of patient body weight whether by one or more administrations. In some embodiments, the antibody used is about 0.01 to about 45 mg/kg, about 0.01 to about 40 mg/kg, about 0.01 to about 35 mg/kg, about 0.01 to about 30 mg/kg, about 0.01 to about 25 mg/kg, about 0.01 to about 20 mg/kg, about 0.01 to about 15 mg/kg, about 0.01 to about 10 mg/kg, about 0.01 to about 5 mg/kg, or about 0.01 to about 1 mg/kg administered daily, for example. In some embodiments, the antibody is administered at 15 mg/kg. However, other dosage regimens may be useful. In one embodiment, an anti-PDL1 antibody described herein is administered to a human at a dose of about 100 mg, about 200 mg, about 300 mg, about 400 mg, about 500 mg, about 600 mg, about 700 mg, about 800 mg, about 900 mg, about 1000 mg, about 1100 mg, about 1200 mg, about 1300 mg or about 1400 mg on day 1 of 21-day cycles. The dose may be administered as a single dose or as multiple doses (e.g., 2 or 3 doses), such as infusions. The progress of this therapy is easily monitored by conventional techniques.

For example, the therapeutically effective or sufficient amount of each of the at least one isolated or purified population of bacteria or each of the at least two isolated or purified populations of bacteria of the probiotic or live bacterial product compositions of the embodiments that is administered to a human will be at least about $1\times10^3$ colony forming units (CFU) of bacteria or at least about $1\times10^4$ (CFU). In some embodiments, a single dose will contain about $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$ or greater than $1\times10^{15}$ CFU of bacteria. In specific embodiments, the bacteria are provided in spore form or as sporulated bacteria. In particular embodiments, the concentration of spores of each isolated or purified population of bacteria, for example of each species, subspecies or strain, is $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$ or greater than $1\times10^{15}$ viable bacterial spores per gram of composition or per administered dose.

Intratumoral injection, or injection into the tumor vasculature is specifically contemplated for discrete, solid, accessible tumors. Local, regional or systemic administration also may be appropriate. For tumors of >4 cm, the volume to be administered will be about 4-10 ml (in particular 10 ml), while for tumors of <4 cm, a volume of about 1-3 ml will be used (in particular 3 ml). Multiple injections delivered as single dose comprise about 0.1 to about 0.5 ml volumes. For example, adenoviral particles may advantageously be contacted by administering multiple injections to the tumor.

Treatment regimens may vary as well, and often depend on tumor type, tumor location, disease progression, and health and age of the patient. Obviously, certain types of tumors will require more aggressive treatment, while at the same time, certain patients cannot tolerate more taxing protocols. The clinician will be best suited to make such decisions based on the known efficacy and toxicity (if any) of the therapeutic formulations.

In certain embodiments, the tumor being treated may not, at least initially, be resectable. Treatments with therapeutic viral constructs may increase the resectability of the tumor due to shrinkage at the margins or by elimination of certain particularly invasive portions. Following treatments, resection may be possible. Additional treatments subsequent to resection will serve to eliminate microscopic residual disease at the tumor site.

The treatments may include various "unit doses." Unit dose is defined as containing a predetermined-quantity of the therapeutic composition. The quantity to be administered, and the particular route and formulation, is within the skill of determination of those in the clinical arts. A unit dose need not be administered as a single injection but may comprise continuous infusion over a set period of time.

B. Additional Anti-Cancer Therapies

In some embodiments, the immune checkpoint inhibitor, composition comprising a short-chain fatty acid, such as butyrate, and/or composition comprising a population of short-chain fatty acid-producing bacteria, such as butyrate-producing bacteria, provided herein may be administered in combination with at least one additional therapeutic. The additional therapy may be a cancer therapy such as radiation therapy, surgery, chemotherapy, gene therapy, DNA therapy, viral therapy, RNA therapy, immunotherapy, bone marrow transplantation, nanotherapy, monoclonal antibody therapy, or a combination of the foregoing. The additional therapy may be in the form of adjuvant or neoadjuvant therapy.

In some embodiments, the additional cancer therapy is the administration of a small molecule enzymatic inhibitor or anti-metastatic agent. In some embodiments, the additional therapy is the administration of side-effect limiting agents (e.g., agents intended to lessen the occurrence and/or severity of side effects of treatment, such as anti-nausea agents, etc.). In some embodiments, the additional cancer therapy is radiation therapy. In some embodiments, the additional cancer therapy is surgery. In some embodiments, the additional cancer therapy is a combination of radiation therapy and surgery. In some embodiments, the additional cancer therapy is gamma irradiation. In some embodiments, the additional cancer therapy is therapy targeting PBK/AKT/mTOR pathway, HSP90 inhibitor, tubulin inhibitor, apoptosis inhibitor, and/or chemopreventative agent. The additional cancer therapy may be one or more of the chemotherapeutic agents known in the art.

Various combinations may also be employed. For the example below the immune checkpoint inhibitor, butyrate, and/or butyrate-producing bacterial population is "A" and an additional cancer therapy is "B":

| | | | | | | |
|---|---|---|---|---|---|---|
| A/B/A | B/A/B | B/B/A | A/A/B | A/B/B | B/A/A | A/B/B/B B/A/B/B |
| B/B/B/A | B/B/A/B | A/A/B/B | A/B/A/B | A/B/B/A | B/B/A/A | |
| B/A/B/A | B/A/A/B | A/A/A/B | B/A/A/A | A/B/A/A | A/A/B/A | |

Administration of any compound or therapy of the present embodiments to a patient will follow general protocols for the administration of such compounds, taking into account the toxicity, if any, of the agents. Therefore, in some embodiments there is a step of monitoring toxicity that is attributable to combination therapy.

1. Chemotherapy

A wide variety of chemotherapeutic agents may be used in accordance with the present embodiments. The term "chemotherapy" refers to the use of drugs to treat cancer. A "chemotherapeutic agent" is used to connote a compound or composition that is administered in the treatment of cancer. These agents or drugs are categorized by their mode of activity within a cell, for example, whether and at what stage they affect the cell cycle. Alternatively, an agent may be characterized based on its ability to directly cross-link DNA, to intercalate into DNA, or to induce chromosomal and mitotic aberrations by affecting nucleic acid synthesis.

Examples of chemotherapeutic agents include alkylating agents, such as thiotepa and cyclosphosphamide; alkyl sulfonates, such as busulfan, improsulfan, and piposulfan; aziridines, such as benzodopa, carboquone, meturedopa, and uredopa; ethylenimines and methylamelamines, including altretamine, triethylenemelamine, trietylenephosphoramide, triethiylenethiophosphoramide, and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB 1-TM1); eleutherobin; pancratistatin; a sarcodictyin; spongistatin; nitrogen mustards, such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, and uracil mustard; nitrosureas, such as carmustine, chlorozotocin, fotemustine, lomustine, nimustine, and ranimnustine; antibiotics, such as the enediyne antibiotics (e.g., calicheamicin, especially calicheamicin gammaII and calicheamicin omegaI1); dynemicin, including dynemicin A; bisphosphonates, such as clodronate; an esperamicin; as well as neocarzinostatin chromophore and related chromoprotein enediyne antiobiotic chromophores, aclacinomysins, actinomycin, authrarnycin, azaserine, bleomycins, cactinomycin, carabicin, carminomycin, carzinophilin, chromomycinis, dactinomycin, daunorubicin, detorubicin, 6-diazo-5-oxo-L-norleucine, doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins, such as mitomycin C, mycophenolic acid, nogalarnycin, olivomycins, peplomycin, potfiromycin, puromycin, quelamycin, rodorubicin, streptonigrin, streptozocin, tubercidin, ubenimex, zinostatin, and zorubicin; anti-metabolites, such as methotrexate and 5-fluorouracil (5-FU); folic acid analogues, such as denopterin, pteropterin, and trimetrexate; purine analogs, such as fludarabine, 6-mercaptopurine, thiamiprine, and thioguanine; pyrimidine analogs, such as ancitabine, azacitidine, 6-azauridine, carmofur, cytarabine, dideoxyuridine, doxifluridine, enocitabine, and floxuridine; androgens, such as calusterone, dromostanolone propionate, epitiostanol, mepitiostane, and testolactone; anti-adrenals, such as mitotane and trilostane; folic acid replenisher, such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids, such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSKpolysaccharide complex; razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; taxoids, e.g., paclitaxel and docetaxel gemcitabine; 6-thioguanine; mercaptopurine; platinum coordination complexes, such as cisplatin, oxaliplatin, and carboplatin; vinblastine; platinum; etoposide (VP-16); ifosfamide; mitoxantrone; vincristine; vinorelbine; novantrone; teniposide; edatrexate; daunomycin; aminopterin; xeloda; ibandronate; irinotecan (e.g., CPT-11); topoisomerase inhibitor RFS 2000; difluorometlhylornithine (DMFO); retinoids, such as retinoic acid; capecitabine; carboplatin, procarbazine, plicomycin, gemcitabien, navelbine, farnesyl-protein tansferase inhibitors, transplatinum, and pharmaceutically acceptable salts, acids, or derivatives of any of the above, 2. Radiotherapy Other factors that cause DNA damage and have been used extensively include what are commonly known as γ-rays, X-rays, and/or the directed delivery of radioisotopes to tumor cells. Other forms of DNA damaging factors are also contemplated, such as microwaves, proton beam irradiation (U.S. Pat. Nos. 5,760,395 and 4,870,287), and UV-irradiation. It is most likely that all of these factors affect a broad range of damage on DNA, on the precursors of DNA, on the replication and repair of DNA, and on the assembly and maintenance of chromosomes. Dosage ranges for X-rays range from daily doses of 50 to 200 roentgens for prolonged periods of time (3 to 4 wk), to single doses of 2000 to 6000 roentgens. Dosage ranges for radioisotopes vary widely, and depend on the half-life of the isotope, the strength and type of radiation emitted, and the uptake by the neoplastic cells.

3. Immunotherapy

The skilled artisan will understand that immunotherapies may be used in combination or in conjunction with the methods described herein. In the context of cancer treatment, immunotherapeutics generally rely on the use of immune effector cells and molecules to target and destroy cancer cells. Rituximab (RITUXAN®) is an example of an immunotherapy. The immune effector may be, for example, an antibody specific for a marker on the surface of a tumor cell. The antibody alone may serve as an effector of therapy or it may recruit other cells to actually effect cell killing. The antibody also may be conjugated to a drug or toxin (chemotherapeutic, radionuclide, ricin A chain, cholera toxin, pertussis toxin, etc.) and serve as a targeting agent. Alternatively, the effector may be a lymphocyte carrying a surface molecule that interacts, either directly or indirectly, with a tumor cell target. Various effector cells include cytotoxic T cells and NK cells Antibody-drug conjugates have emerged as a breakthrough approach to the development of cancer therapeutics. Antibody-drug conjugates (ADCs) comprise monoclonal antibodies (MAbs) that are covalently linked to cell-killing drugs. This approach combines the high specificity of MAbs against their antigen targets with highly potent cytotoxic drugs, resulting in "armed" MAbs that deliver the payload (drug) to tumor cells with enriched levels of the antigen. Targeted delivery of the drug also minimizes its exposure in normal tissues, resulting in decreased toxicity and improved therapeutic index. The approval of two ADC drugs, ADCETRIS® (brentuximab vedotin) in 2011 and KADCYLA® (trastuzumab emtansine or T-DM1) in 2013 by FDA validated the approach. There are currently more than 30 ADC drug candidates in various stages of clinical trials for cancer treatment. As antibody engineering and linker-payload optimization are becoming more and more mature, the discovery and development of new ADCs are increasingly dependent on the identification and validation of new targets that are suitable to this approach and the generation of targeting MAbs. Two criteria for ADC targets are upregulated/high levels of expression in tumor cells and robust internalization.

In one aspect of immunotherapy, the tumor cell must bear some marker that is amenable to targeting, i.e., is not present on the majority of other cells. Many tumor markers exist and any of these may be suitable for targeting in the context of the present embodiments. Common tumor markers include CD20, carcinoembryonic antigen, tyrosinase (p9'7), gp68, TAG-72, HMFG, Sialyl Lewis Antigen, MucA, MucB, PLAP, laminin receptor, erb B, and p155. An alternative aspect of immunotherapy is to combine anticancer effects with immune stimulatory effects. Immune stimulating molecules also exist including: cytokines, such as IL-2, IL-4, IL-12, GM-CSF, gamma-IFN, chemokines, such as MIP-1, MCP-1, IL-8, and growth factors, such as FLT3 ligand.

4. Surgery

Approximately 60% of persons with cancer will undergo surgery of some type, which includes preventative, diagnostic or staging, curative, and palliative surgery. Curative surgery includes resection in which all or part of cancerous tissue is physically removed, excised, and/or destroyed and may be used in conjunction with other therapies, such as the treatment of the present embodiments, chemotherapy, radiotherapy, hormonal therapy, gene therapy, immunotherapy, and/or alternative therapies. Tumor resection refers to physical removal of at least part of a tumor. In addition to tumor resection, treatment by surgery includes laser surgery, cryosurgery, electrosurgery, and microscopically-controlled surgery (Mohs' surgery).

Upon excision of part or all of cancerous cells, tissue, or tumor, a cavity may be formed in the body. Treatment may be accomplished by perfusion, direct injection, or local application of the area with an additional anti-cancer therapy. Such treatment may be repeated, for example, every 1, 2, 3, 4, 5, 6, or 7 days, or every 1, 2, 3, 4, and 5 weeks or every 1, 2, 3, 4, 5, 6, 7, 8, 9, 10, 11, or 12 months. These treatments may be of varying dosages as well.

5. Other Agents

It is contemplated that other agents may be used in combination with certain aspects of the present embodiments to improve the therapeutic efficacy of treatment. These additional agents include agents that affect the upregulation of cell surface receptors and GAP junctions, cytostatic and differentiation agents, inhibitors of cell adhesion, agents that increase the sensitivity of the hyperproliferative cells to apoptotic inducers, or other biological agents. Increases in intercellular signaling by elevating the number of GAP junctions would increase the anti-hyperproliferative effects on the neighboring hyperproliferative cell population. In other embodiments, cytostatic or differentiation agents can be used in combination with certain aspects of the present embodiments to improve the anti-hyperproliferative efficacy of the treatments. Inhibitors of cell adhesion are contemplated to improve the efficacy of the present embodiments. Examples of cell adhesion inhibitors are focal adhesion kinase (FAKs) inhibitors and Lovastatin. It is further contemplated that other agents that increase the sensitivity of a hyperproliferative cell to apoptosis, such as the antibody c225, could be used in combination with certain aspects of the present embodiments to improve the treatment efficacy.

V. EXAMPLES

The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the invention.

Example 1—Characterization of Microbiome of Melanoma Patients

To better understand the role of the microbiome in response to immune checkpoint blockade in cancer patients, microbiome samples were prospectively collected from patients with metastatic melanoma going onto treatment with PD-1 blockade (n=112 patients). Oral (buccal) and gut (fecal) microbiome samples were collected at treatment initiation, and tumor biopsies and blood samples were collected when feasible to assess for genomic alterations as well as the density and phenotype of tumor-infiltrating and circulating immune cell subsets (FIG. 1A). Taxonomic profiling via 16S rRNA gene sequencing was performed on all available oral and gut samples, with metagenomic whole genome shotgun sequencing (WGS) on a subset. Patients were classified as responders (R) or non-responders (NR) based on imaging analysis via RECIST 1.1 criteria (Schwartz et al., 2016). Of note, patients in R versus NR groups were relatively similar with respect to age, gender, primary type, prior therapy, concurrent therapy and serum LDH (Table 3). The frequency of specific melanoma driver mutations and total mutational load were also similar between the groups (FIG. 5) (17).

TABLE 3

Patient characteristics table by microbiome sample type.

| | Oral Microbiome Samples | | | | Fecal Microbiome Samples | | |
|---|---|---|---|---|---|---|---|
| | R n = 52 (%) | NR n = 34 (%) | P* | | R n = 30 (%) | NR n = 13 (%) | P* |
| Age | | | 0.57 | | | | 0.60 |
| Median | 66.5 | 64.5 | | Median | 64 | 70 | |
| Range | 21-88 | 32-87 | | Range | 21-88 | 42-80 | |
| Gender | | | 0.14 | | | | 0.74 |
| Male | 41 (79) | 22 (65) | | Male | 20 (67) | 8 (62) | |
| Female | 11 (21) | 12 (35) | | Female | 10 (33) | 5 (38) | |
| Ethnicity | | | 0.47 | | | | 0.57 |
| White | 48 (92) | 29 (85) | | White | 28 (94) | 11 (85) | |
| Other | 4 (6) | 5 (6) | | Other | 2 (6) | 2 (15) | |
| Primary Type | | | 0.032 | | | | 0.68 |
| Cutaneous | 44 (85) | 22 (65) | | Cutaneous | 25 (83) | 10 (77) | |
| Other** | 8 (15) | 12 (35) | | Other** | 5 (17) | 3 (23) | |
| Prior Targeted Therapy | | | 0.76 | | | | 0.76 |
| Yes | 8 (15) | 4 (12) | | Yes | 5 (17) | 6 (46) | |
| No | 44 (85) | 30 (88) | | No | | | |
| Prior Checkpoint Therapy | | | 0.81 | | | | 0.46 |
| Yes | 17 (33) | 12 (35) | | Yes | 9 (30) | 2 (15) | |
| No | 35 (67) | 22 (65) | | No | 21 (70) | 11 (85) | |
| Disease Stage | | | 0.053 | | | | 0.0006 |
| III | 14 (27) | 3 (9) | | III | 20 (67) | 1 (8) | |
| IV | 38 (73) | 31 (91) | | IV | 10 (33) | 12 (92) | |
| Lactate Dehydrogenase**** | | | | | | | 0.21 |
| <618 IU | 44 (85) | 23 (68) | 0.11 | <618 IU | 26 (87) | 9 (69) | |
| ≥618 IU | 8 (15) | 10 (30) | | ≥618 IU | 3 (10) | 4 (31) | |
| Treatment Type | | | 0.053 | | | | 0.22 |
| PD1 Monotherapy | 50 (96) | 28 (82) | | PD1 Monotherapy | 29 (97) | 11 (85) | |
| PD1 Combination*** | 2 (4) | 6 (18) | | PD1 Combination*** | 1 (3) | 2 (15) | |

Figure 1B:
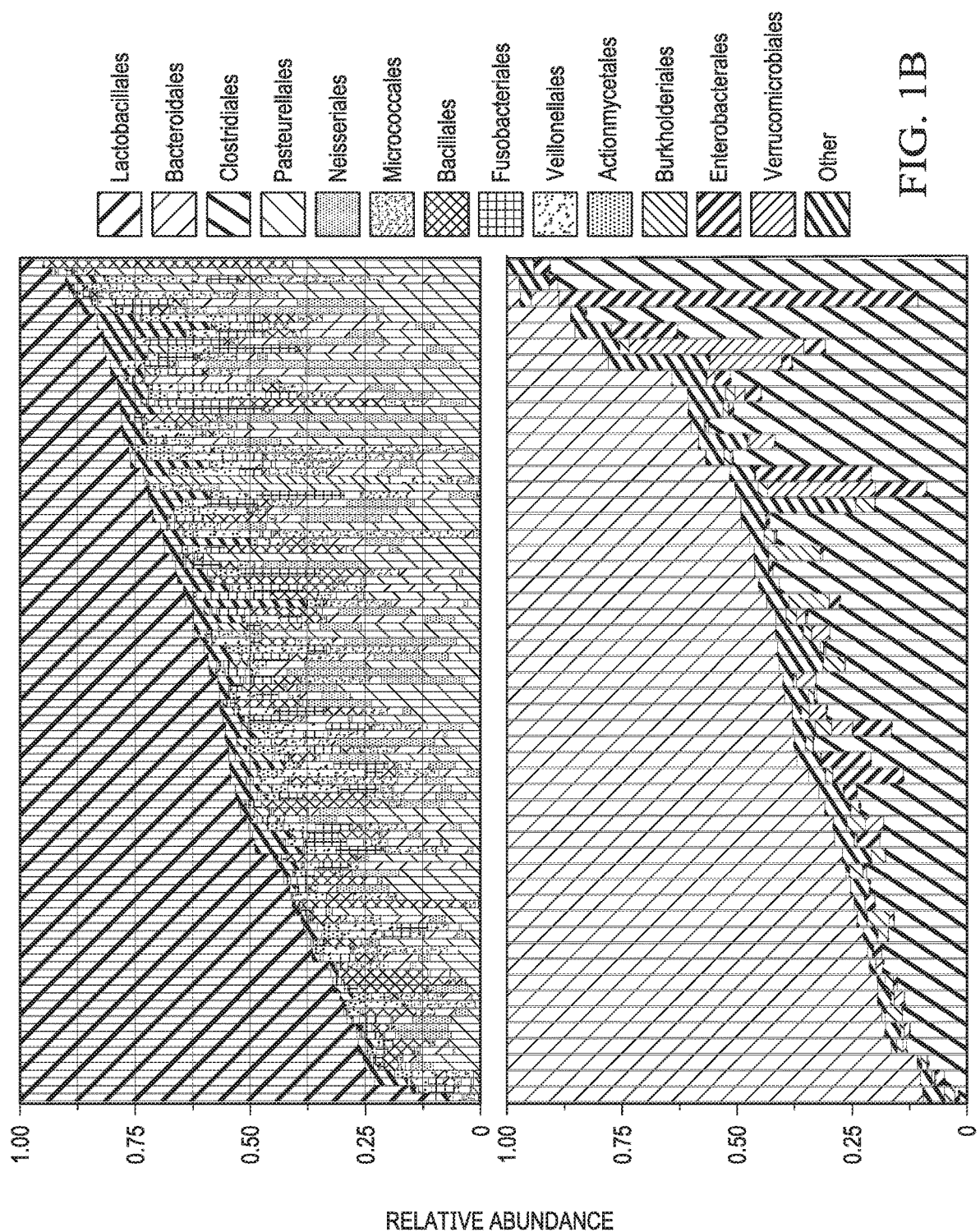
Figure 1C:
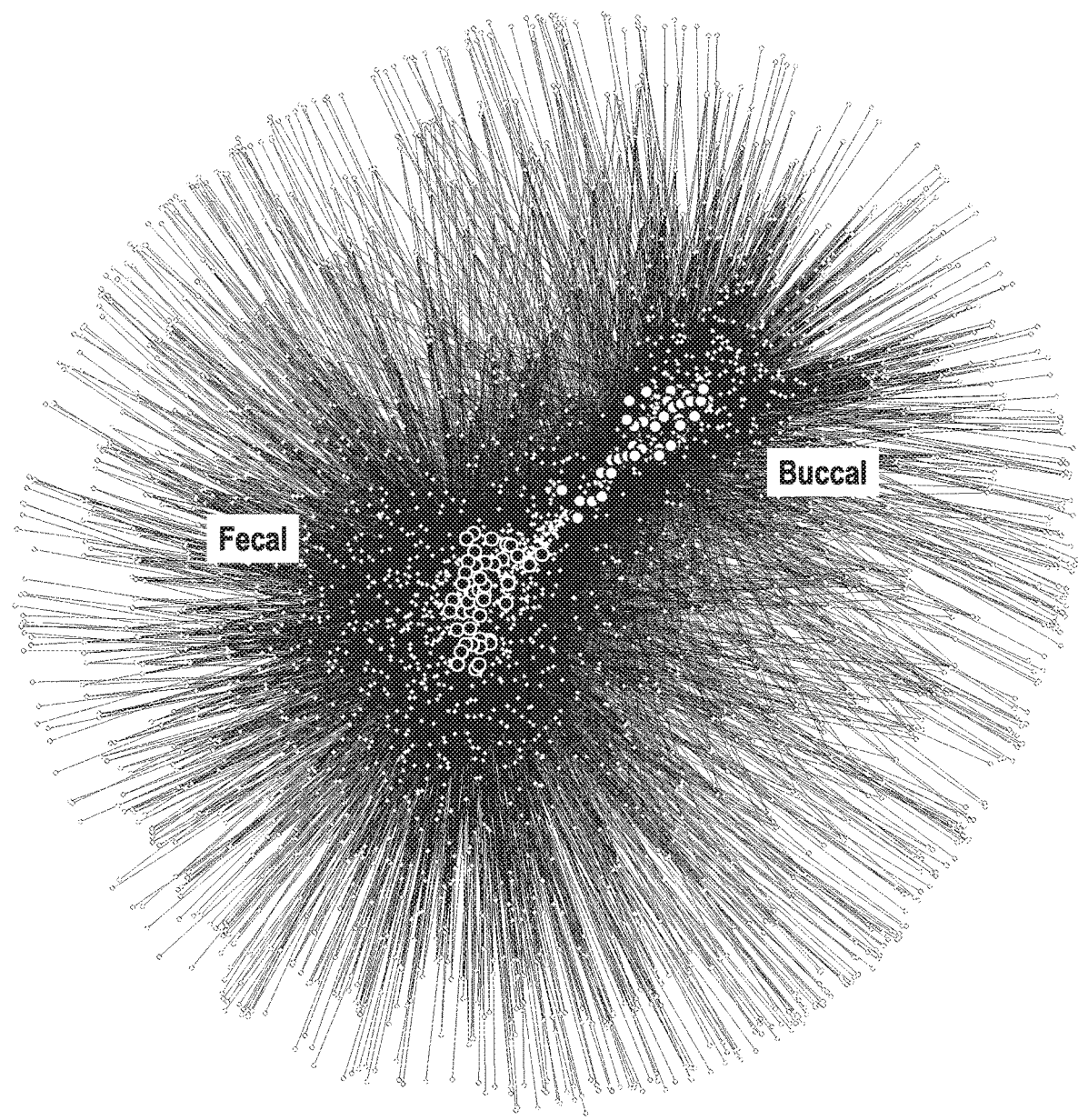

*p values calculated by Wilcoxon rank sum (age), chi-squared (gender, prior checkpoint) and Fisher's exact (all others)
**other includes acral, mucosal, unknown primaries
***combos include: Abraxane, Urelumanb, Aldera cream
****1 missing value from 1 R who didn't have a baseline LDH read The landscape of the oral and fecal microbiota in patients was first assessed with metastatic melanoma via 16S sequencing (V4 region), noting that both communities were relatively diverse, with a high abundance of Lactobacillales in the oral microbiome and Bacteroidales in the fecal microbiome (FIG. 1B). Bipartite network analysis (Muegge et al., 2011) demonstrated a clear separation of community structure between the oral and fecal microbiomes in terms of both matched and aggregate samples (FIGS. 1C and 6), suggesting that these communities are distinct.

Figure 1D:
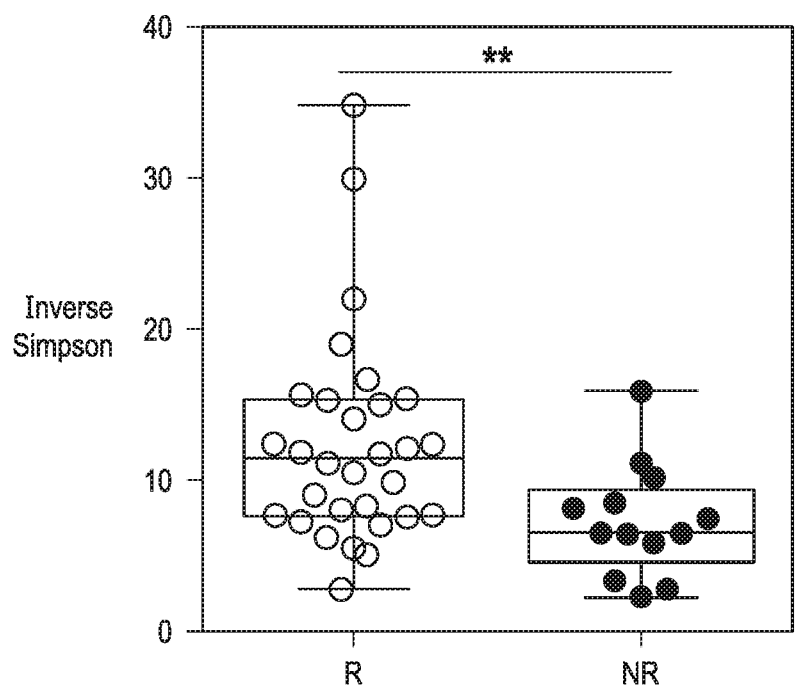
Figure 1E:
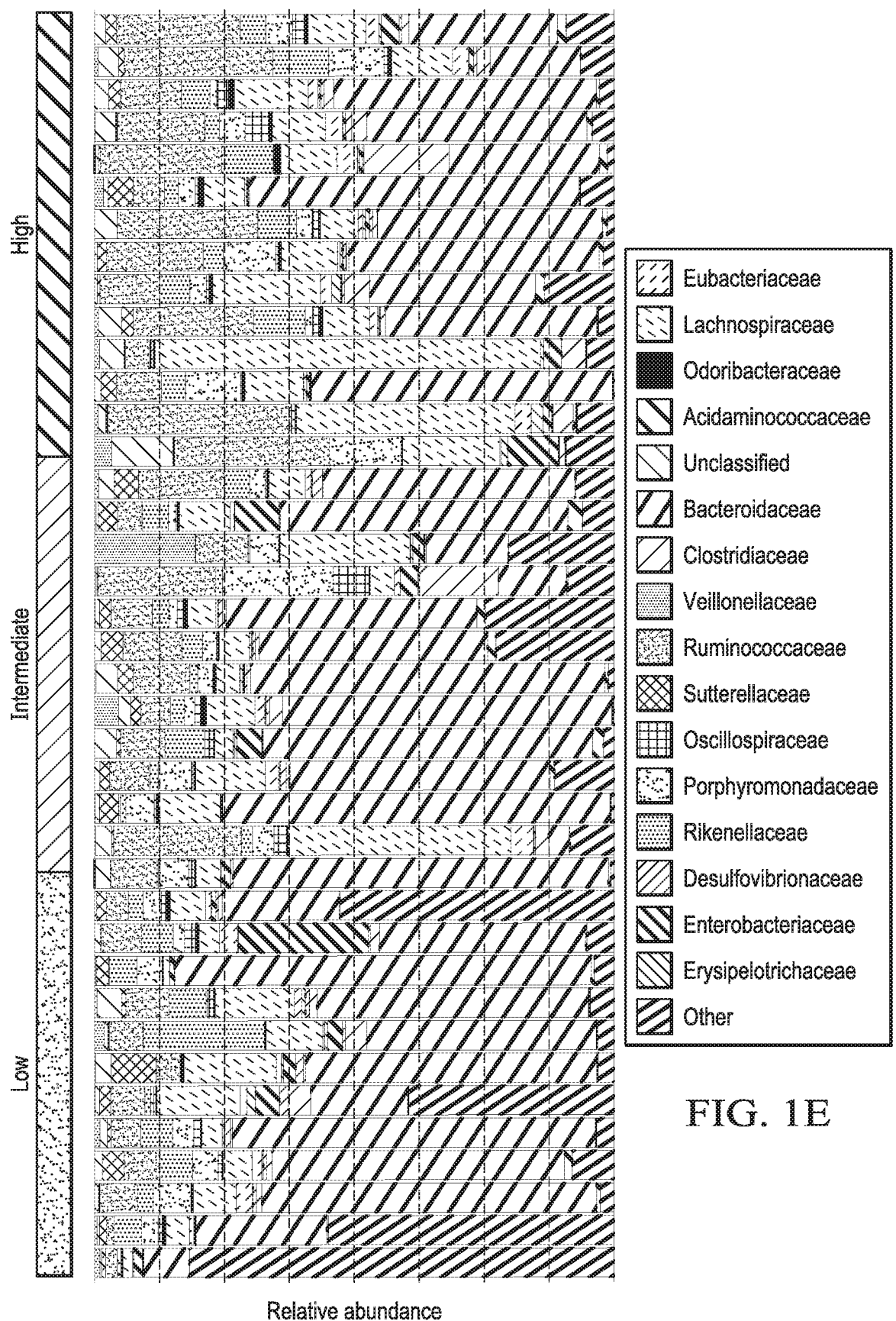
Figure 1G:
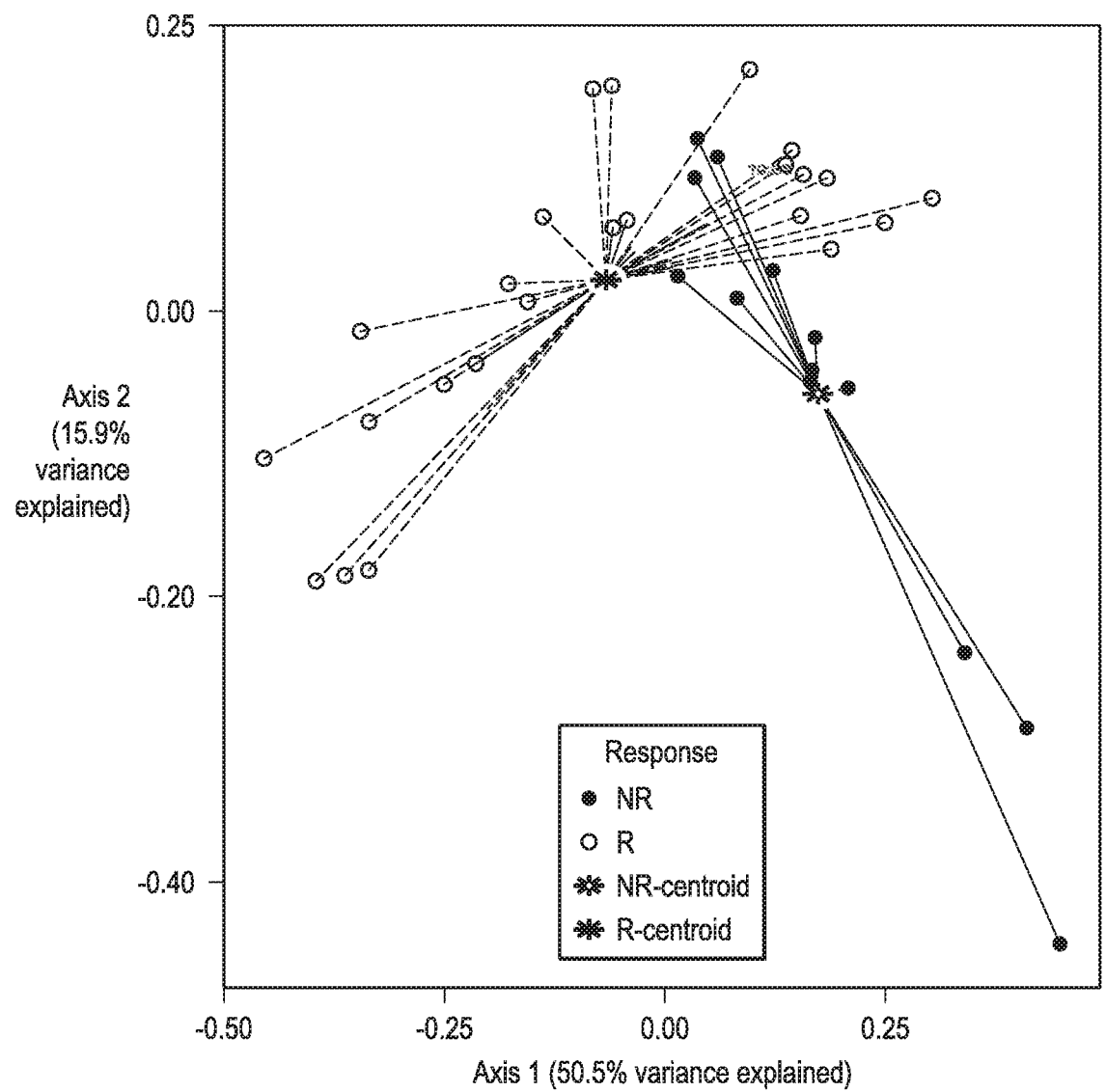

Loss of diversity (dysbiosis) is associated with chronic health conditions (Turnbaugh et al., 2008; Qin et al., 2010) and cancer (Garrett et al., 2015; Segre et al., 2015; Drewes et al., 2016)), and is also associated with poor outcomes to certain forms of cancer therapy including allogeneic stem cell transplant (Taur et al., 2014). Based on these data diversity of the oral and gut microbiomes was tested in patients on PD-1 blockade, and found that diversity of the gut microbiome was significantly higher in R compared to NR using several indices (p=0.009, FIGS. 1D and 7). No significant differences were observed in the oral microbiome (p=0.11, FIG. 8). The relationship of diversity with progression-free survival (PFS) was tested in the cohort, demonstrating that patients with a high diversity in the fecal microbiome had significantly prolonged PFS compared to those with intermediate or low diversity (p=0.021 and 0.041, respectively; FIGS. 1E-F and 9). No differences in PFS were noted when comparing diversity of the oral microbiome (FIG. 10A-D).

Compositional differences in the microbiome may also influence cancer development and response to therapy (Sivan et al., 2015; Lida et al., 2013; Viaud et al., 2013; Vetizou et al., 2015), thus it was also sought to determine if differences existed in component microbiota in the oral or gut microbiomes of R and NR to PD-1 blockade. To test this, enrichment index (ei) of operational taxonomic units (OTUs) was calculated and compared R versus NR, demonstrating that distinct sets of bacteria were associated with response to anti-PD-1 therapy, with enrichment of Clostridiales in R and Bacteroidales in NR in the gut microbiome (p<0.001, FIGS. 2A-B and 11). No significant differences in enrichment were noted in the oral microbiome of R versus NR (FIG. 12A-B). To further explore these findings, high dimensional class comparisons were performed via linear discriminant analysis of effect size (LEfSe) (Segata et al., 2011), which again demonstrated differentially abundant bacteria in the fecal microbiome of R versus NR to PD-1 blockade, with Clostridiales/Ruminococcaceae enriched in R and Bacteroidales enriched in NR (FIG. 2C-D). No significant differences were observed in the oral microbiome between R and NR, with the exception of higher Bacteroidales in NR to PD-1 blockade (FIG. 13A-B). Pairwise comparisons were then performed for bacterial taxa at all levels by response. In addition to confirming the previous taxonomic differences, these analyses identified *Faecalibacterium prausnitzii* species as significantly enriched in R (FIG. 2E, Table 4). Metagenomic WGS further revealed enrichment of *Faecalibacterium* species in addition to others including *Akkermansia* in R, whilst *Bacteroides thetaiotaomicron, Escherichia coli*, and *Anaerotruncus colihominis* were enriched in NR (FIG. 2F, Table 4). Of note, the gut microbiome was shown to be relatively stable over time in a limited number of longitudinal samples tested (FIG. 14A-C).

Figure 3A:
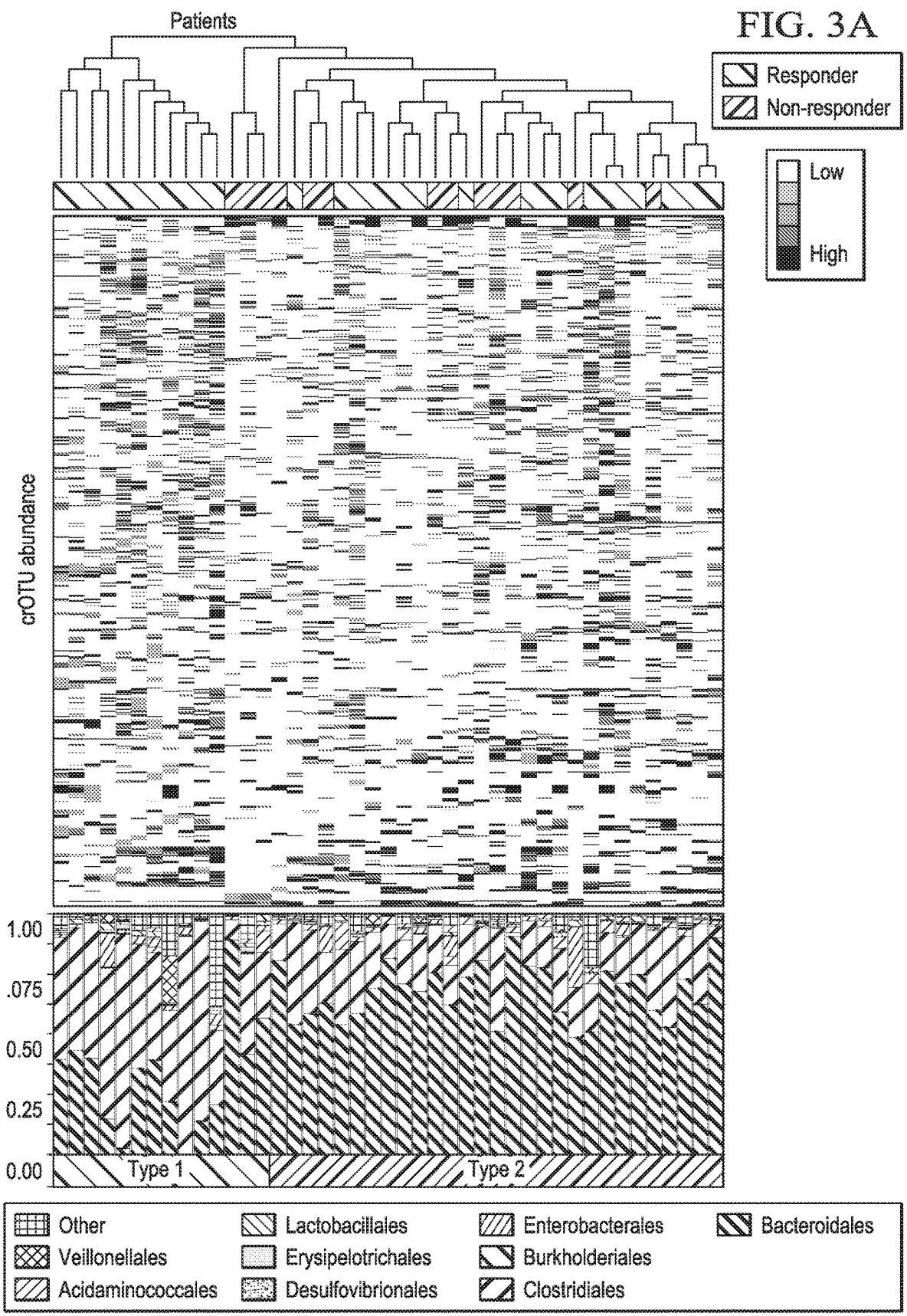
Figure 3B:
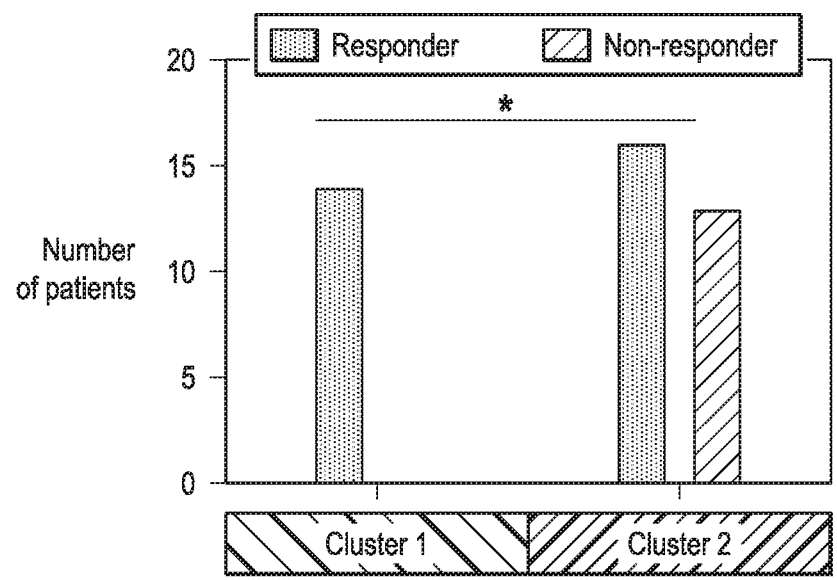
Figure 3C:
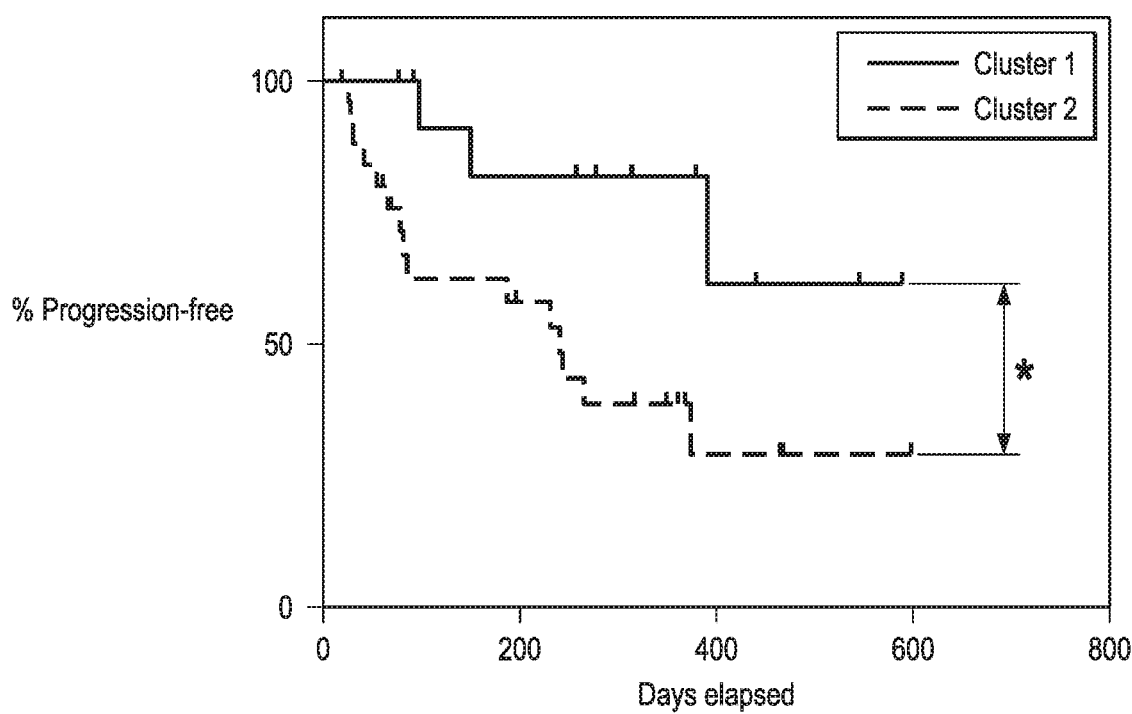
Figure 3D:
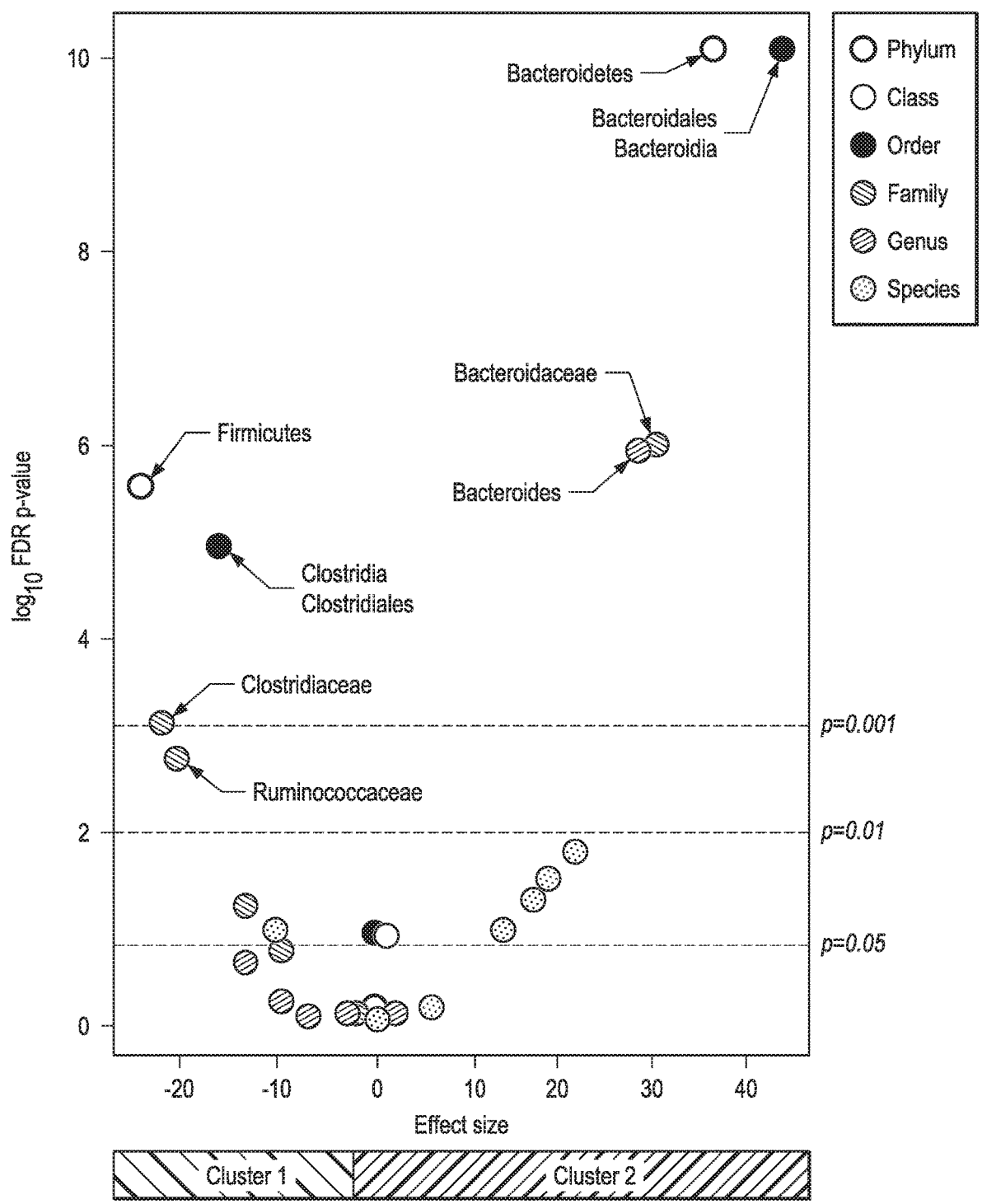

Based on these insights, it was next asked whether bacterial composition and abundances within the gut and/or oral microbiomes could predict response to PD-1 blockade in the inventors' cohort. To do this, all identified OTUs were grouped into clusters of related OTUs (crOTUs) via construction of a phylogenetic tree from sequence alignment data (Peled et al., 2017). This technique involves comparison of abundances of different potential groupings of bacteria based on 16S sequence similarity and helps address the sparse distribution of OTU abundances observed in the absence of this approach (FIG. 15A-B). Unsupervised hierarchical clustering of crOTU abundances within the gut and oral microbiomes was then performed without input of response data. Results demonstrated that patients segregated into 2 distinct clusters, with one cluster (cluster 1) comprised entirely of R and the other (cluster 2) comprised of a mixture of R and NR (p=0.02) with enrichment of Clostridiales in cluster 1 and Bacteroidales in cluster 2 (FIG. 3A-B). PFS was then assessed in each of these clusters, demonstrating a significantly shorter time to progression on PD-1 blockade among patients in cluster 1 compared to those in cluster 2 (p=0.02) (FIG. 3C). To better understand compositional differences in these clusters, pairwise comparisons of the gut microbiota were performed, and identified a pattern very similar to that seen when clustering by response, with Clostridiales/Ruminococcaceae enriched in cluster 1, and Bacteroidales enriched in cluster 2 (FIG. 3D, Table 5). Analysis of crOTUs in the oral microbiome revealed no apparent relationship to treatment response (FIG. 16A-B).

Figure 3E:
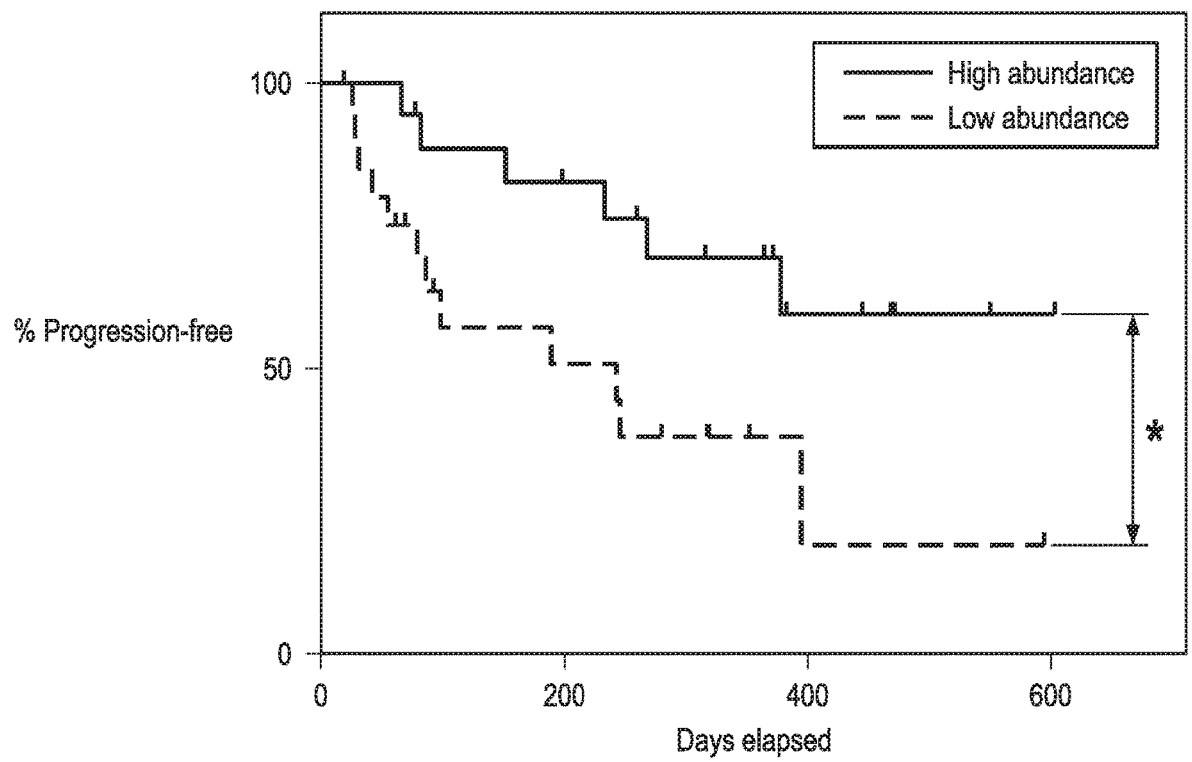
Figure 3E:
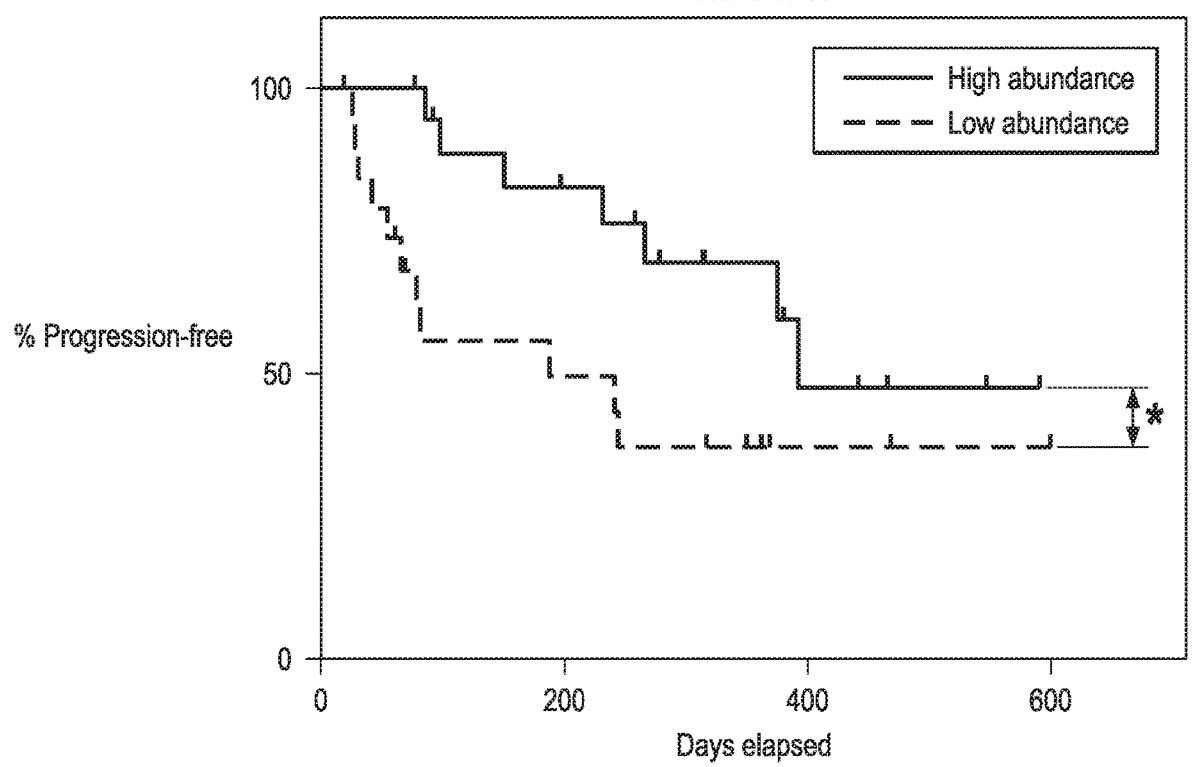

To explore the association of specific bacterial taxa and treatment response, the inventors compared PFS to anti-PD-1 therapy as it related to the "top hits" consistently observed across analyses (*F. prausnitzii* in R and Bacteroidales in NR), dichotomizing patients into high versus low categories based on the median relative abundance of these taxa in the gut microbiome. Patients with high *F. prausnitzii* abundance had a significantly prolonged PFS versus those with a low abundance (p=0.03). Conversely, patients with a high abundance of Bacteroidales had a shortened PFS compared to those with a low abundance (p=0.05) (FIG. 3E). This is in line with recently published data in a small cohort of patients on CTLA-4 blockade, where patients with a higher abundance of *Faecalibacterium* had a prolonged PFS compared to those with a higher abundance of *Bacteroides* in the gut microbiome (Chaput et al., 2017)). In addition, Cox proportional hazards analyses were performed in the inventors' cohort, demonstrating that the strongest predictors of response to PD-1 blockade were alpha-diversity (HR=3.94; 95% C.I.=1.02-12.52), abundance of *F. prausnitzii* (HR=2.92; 95% C.I.=1.08-7.89) and crOTU clusters (HR=3.80; 95% C.I.=1.09-13.21) in the fecal microbiome. These effects remained significant in multivariate analyses after adjusting for prior treatment with immunotherapy (Table 6).

TABLE 4

Pairwise comparisons of bacterial taxa between R and NR by 2-sided MW test within each level of taxonomy.

| Taxon | p-value | Effect Size | FDR-Adjusted p-Value | Taxonomy Level |
|---|---|---|---|---|
| Bacteroidetes | 0.000939 | 19.06232 | 0.002664 | Phylum |
| Firmicutes | 0.001776 | −16.9273 | 0.002664 | Phylum |
| Proteobacteria | 0.927224 | 0 | 0.927224 | Phylum |
| Bacteroidia | 0.000939 | 21.3498 | 0.002165 | Class |
| Clostridia | 0.001443 | −14.9449 | 0.002165 | Class |
| Gammaproteobacteria | 0.628911 | 0 | 0.628911 | Class |
| Bacteroidales | 0.000939 | 19.67232 | 0.002165 | Order |
| Clostridiales | 0.001443 | −16.6223 | 0.002165 | Order |
| Enterobacterales | 0.842779 | 0 | 0.842779 | Order |
| Bacteroidaceae | 0.159028 | 9.721784 | 0.307087 | Family |
| Clostridiaceae | 0.175479 | −6.44306 | 0.307087 | Family |
| Enterobacteriaceae | 0.863521 | 0.419371 | 0.863521 | Family |
| Lachnospiraceae | 0.48832 | −2.6306 | 0.683647 | Family |
| Porphyromonadaceae | 0.061699 | −9.34054 | 0.215948 | Family |
| Rikenellaceae | 0.750983 | −0.41937 | 0.863521 | Family |
| Ruminococcaceae | 0.000118 | −19.5579 | 0.000827 | Family |
| *Alistipes* | 0.750983 | −3.43122 | 0.844806 | Genus |
| *Bacteroides* | 0.159028 | 6.709937 | 0.424075 | Genus |
| *Blautia* | 0.844806 | −0.305 | 0.844806 | Genus |
| *Escherichia* | 0.551319 | 1.982481 | 0.844806 | Genus |
| *Faecalibacterium* | 0.005128 | −17.3848 | 0.041026 | Genus |
| *Lachnoclostridium* | 0.539046 | 2.13498 | 0.844806 | Genus |
| *Parabacteroides* | 0.098795 | −11.1324 | 0.395182 | Genus |
| *Roseburia* | 0.804154 | 0 | 0.844806 | Genus |
| *Alistipes onderdonkii* | 0.577459 | 0.038125 | 0.577459 | Species |
| *Bacteroides caccae* | 0.569645 | −0.03812 | 0.577459 | Species |
| *Bacteroides ovatus* | 0.397414 | −1.63936 | 0.577459 | Species |

TABLE 4-continued

Pairwise comparisons of bacterial taxa between R and
NR by 2-sided MW test within each level of taxonomy.

| Taxon | p-value | Effect Size | FDR-Adjusted p-Value | Taxonomy Level |
|---|---|---|---|---|
| Bacteroides thetaiotaomicron | 0.412328 | 8.120549 | 0.577459 | Species |
| Bacteroides uniformis | 0.475213 | 7.510555 | 0.577459 | Species |
| Bacteroides vulgatus | 0.300376 | −2.7831 | 0.577459 | Species |
| Escherichia coli | 0.551319 | 6.824311 | 0.577459 | Species |
| Faecalibacterium prausnitzii | 0.005128 | −12.543 | 0.046155 | Species |
| Parabacteroides merdae | 0.440288 | −1.18186 | 0.577459 | Species |

TABLE 5

Pairwise comparisons of 16S-derived bacterial taxa between
crOTU community type 1 and crOTU community type 2 by 2
sided Mann-Whitney test within each level of taxonomy.

| Taxon | p-value | Effect Size | FDR-adjusted p-value[a] | Taxonomic Level |
|---|---|---|---|---|
| Bacteroidetes | 6.95e−10 | −25.62 | 2.09e−09 | Phylum |
| Firmicutes | 3.37e−08 | 26.53 | 5.06e−08 | Phylum |
| Proteobacteria | 0.86 | 0.00 | 0.86 | Phylum |
| Bacteroidia | 6.95e−10 | −37.97 | 2.09e−09 | Class |
| Clostridia | 9.42e−08 | 13.72 | 1.41e−07 | Class |
| Gammaproteobacteria | 0.04 | 0.00 | 0.04 | Class |
| Bacteroidales | 6.95e−10 | −38.12 | 2.09e−09 | Order |
| Clostridiales | 9.42e−08 | 13.57 | 1.41e−07 | Order |
| Enterobacterales | 0.04 | 0.00 | 0.04 | Order |
| Bacteroidaceae | 4.83e−08 | −27.75 | 3.38e−07 | Family |
| Ruminococcaceae | 0.00 | 15.55 | 0.00 | Family |
| Clostridiaceae | 0.0011 | 14.79 | 0.00 | Family |
| Lachnospiraceae | 0.01 | 11.59 | 0.02 | Family |
| Enterobacteriaceae | 0.04 | 8.84 | 0.06 | Family |
| Rikenellaceae | 0.36 | −7.55 | 0.42 | Family |
| Porphyromonadaceae | 0.67 | 0.00 | 0.67 | Family |
| Bacteroides | 4.83e−08 | −28.52 | 3.87e−07 | Genus |
| Blautia | 0.07 | 6.86 | 0.19 | Genus |
| Faecalibacterium | 0.07 | 6.71 | 0.19 | Genus |
| Roseburia | 0.18 | 4.27 | 0.36 | Genus |
| Alistipes | 0.36 | −8.31 | 0.57 | Genus |
| Lachnoclostridium | 0.57 | 0.00 | 0.76 | Genus |
| Escherichia | 0.71 | −1.07 | 0.79 | Genus |
| Parabacteroides | 0.79 | −4.73 | 0.79 | Genus |
| Bacteroides.vulgatus | 0.00 | −20.47 | 0.00 | Species |
| Bacteroides.uniformis | 0.00 | −18.72 | 0.01 | Species |
| Bacteroides.thetaiotaomicron | 0.00 | −17.80 | 0.01 | Species |
| Bacteroides.ovatus | 0.07 | −11.86 | 0.13 | Species |
| Faecalibacterium.prausnitzii | 0.07 | 8.20 | 0.13 | Species |
| Bacteroides.caccae | 0.21 | −8.73 | 0.31 | Species |
| Alistipes.onderdonkii | 0.36 | −6.82 | 0.46 | Species |
| Escherichia.coli | 0.71 | 0.42 | 0.80 | Species |
| Parabacteroides.merdae | 0.82 | −0.42 | 0.82 | Species |

[a]FDR p-values are adjusted within each level of taxonomy level

Figure 3F:
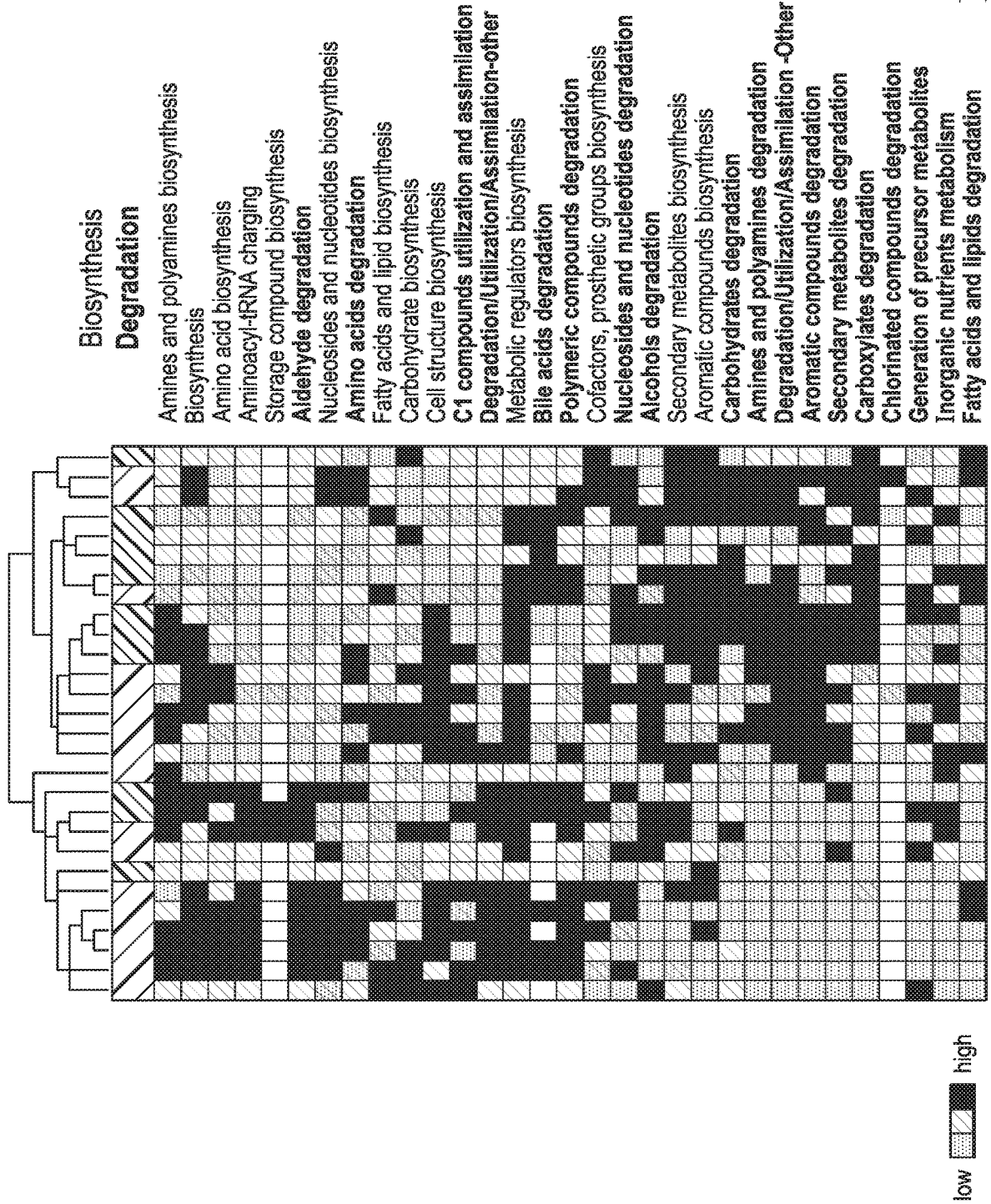

Next, it was sought to gain insight into the mechanism through which the gut microbiome may influence response to anti-PD-1 therapy, and first conducted functional genomic profiling of gut microbiome samples via metagenomic WGS in R vs NR to therapy. Organism-specific gene hits were assigned to the Kyoto Encyclopedia of Genes and Genomes (KEGG) orthology (KO), and based on these annotations, metagenomes for each sample were reconstructed into metabolic pathways using the MetaCyc hierarchy of pathway classifications (Caspi et al., 2008; Kanehisa et al., 2000). Unsupervised hierarchical clustering on relative abundances of both KOs and predicted pathways identified three groups of patient samples, with response rates of 72.7%, 57.1%, and 42.9%. Comparisons of gene function abundances across these groups showed changes in metabolic functions, with anabolic functions predominating in R including amino acid biosynthesis (FIG. 3F), which may promote host immunity (Blacher et al., 2017), whereas catabolic functions predominated in NR (FIG. 3F, 17, Table 7).

Figure 4A:
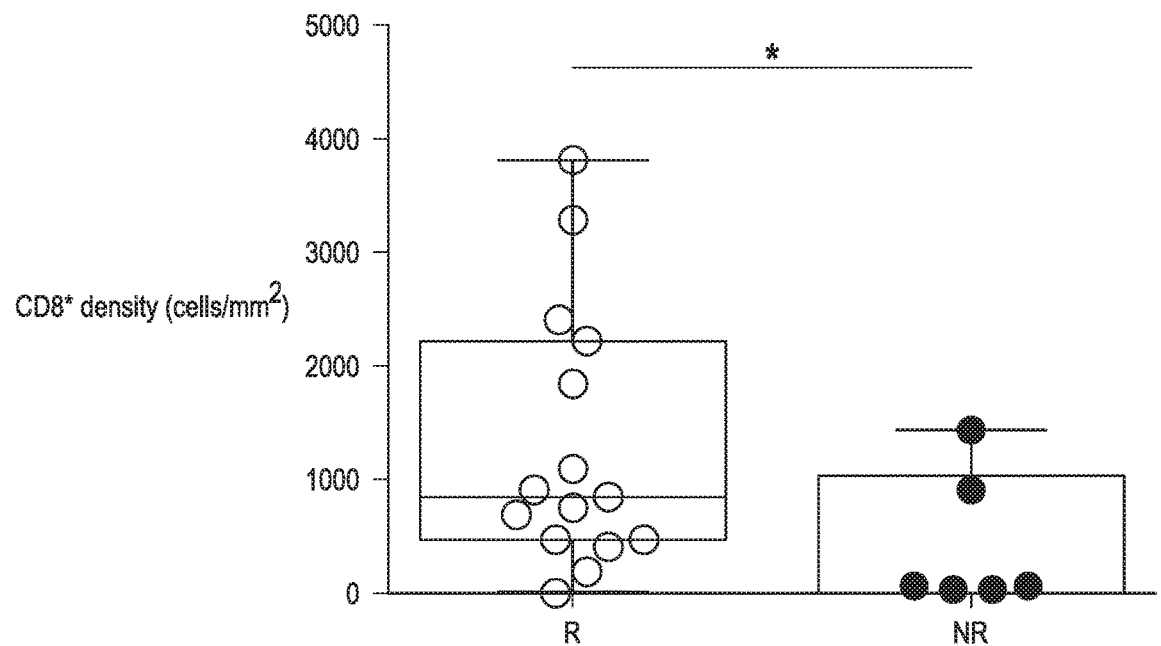
Figure 4B:
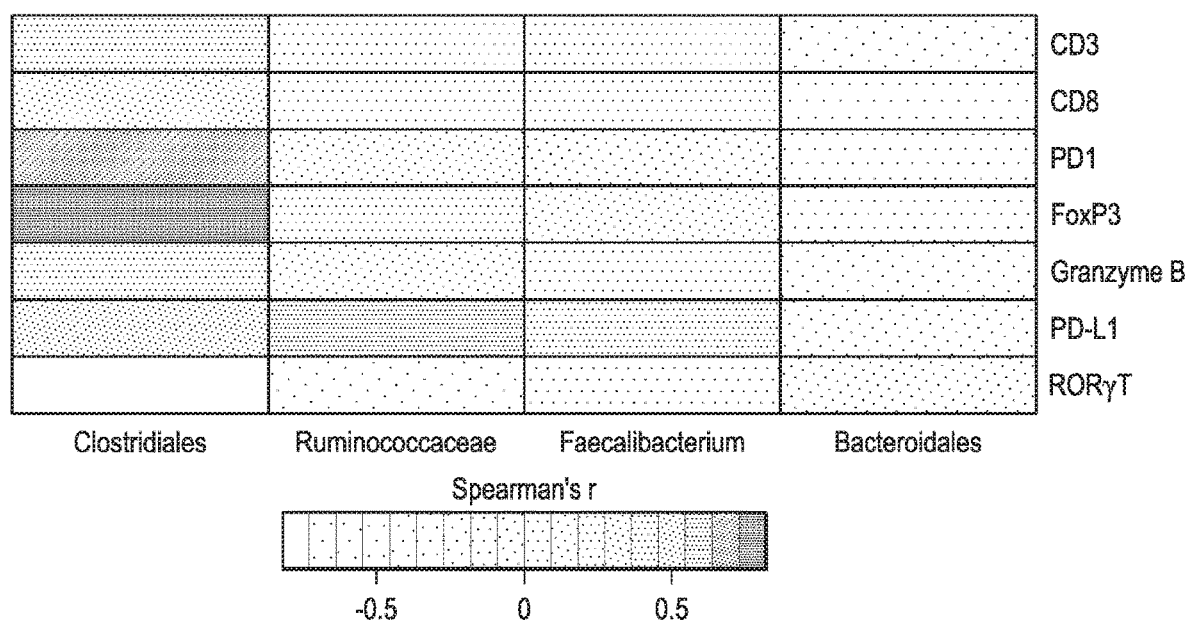
Figure 4C:
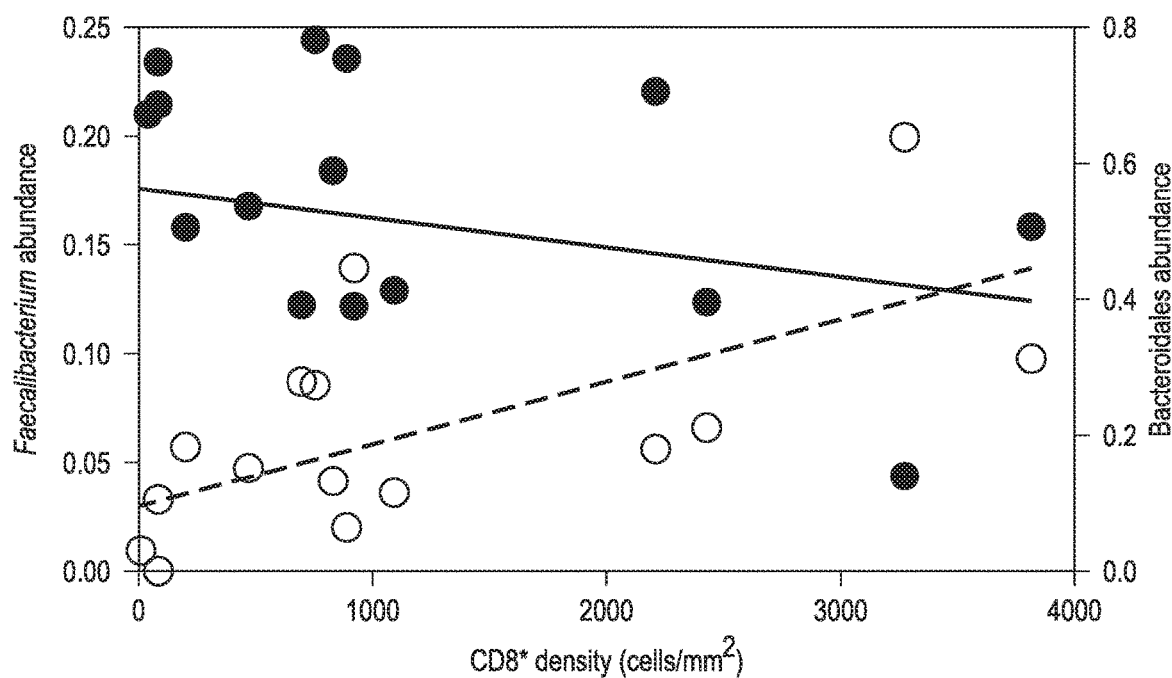
Figure 4D:
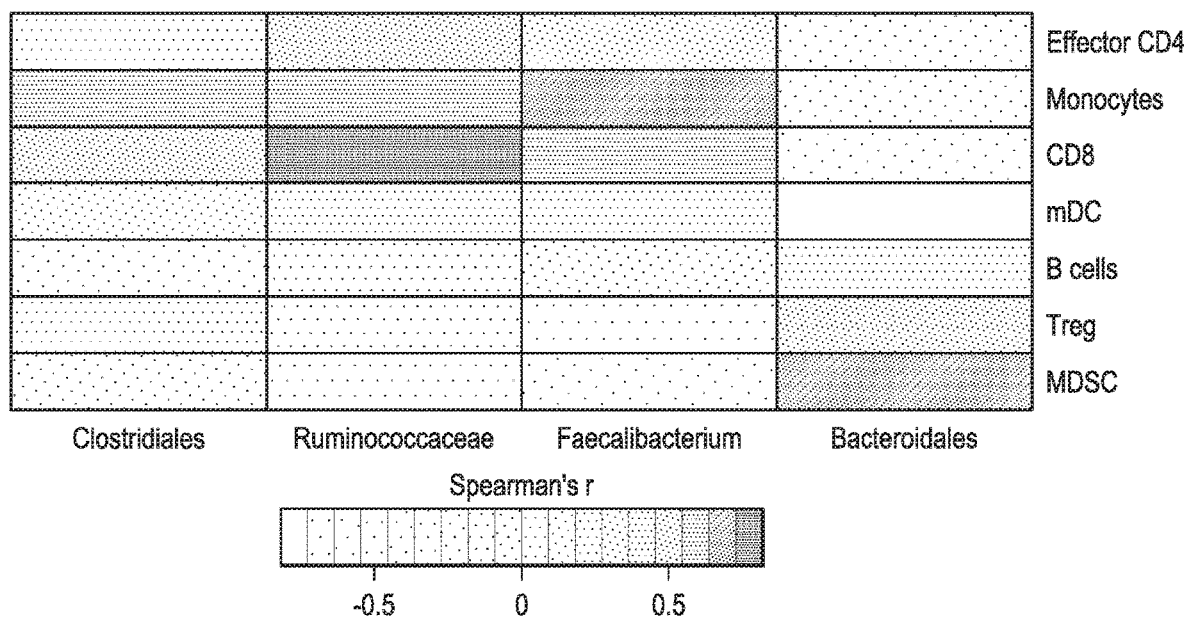
Figure 4E:
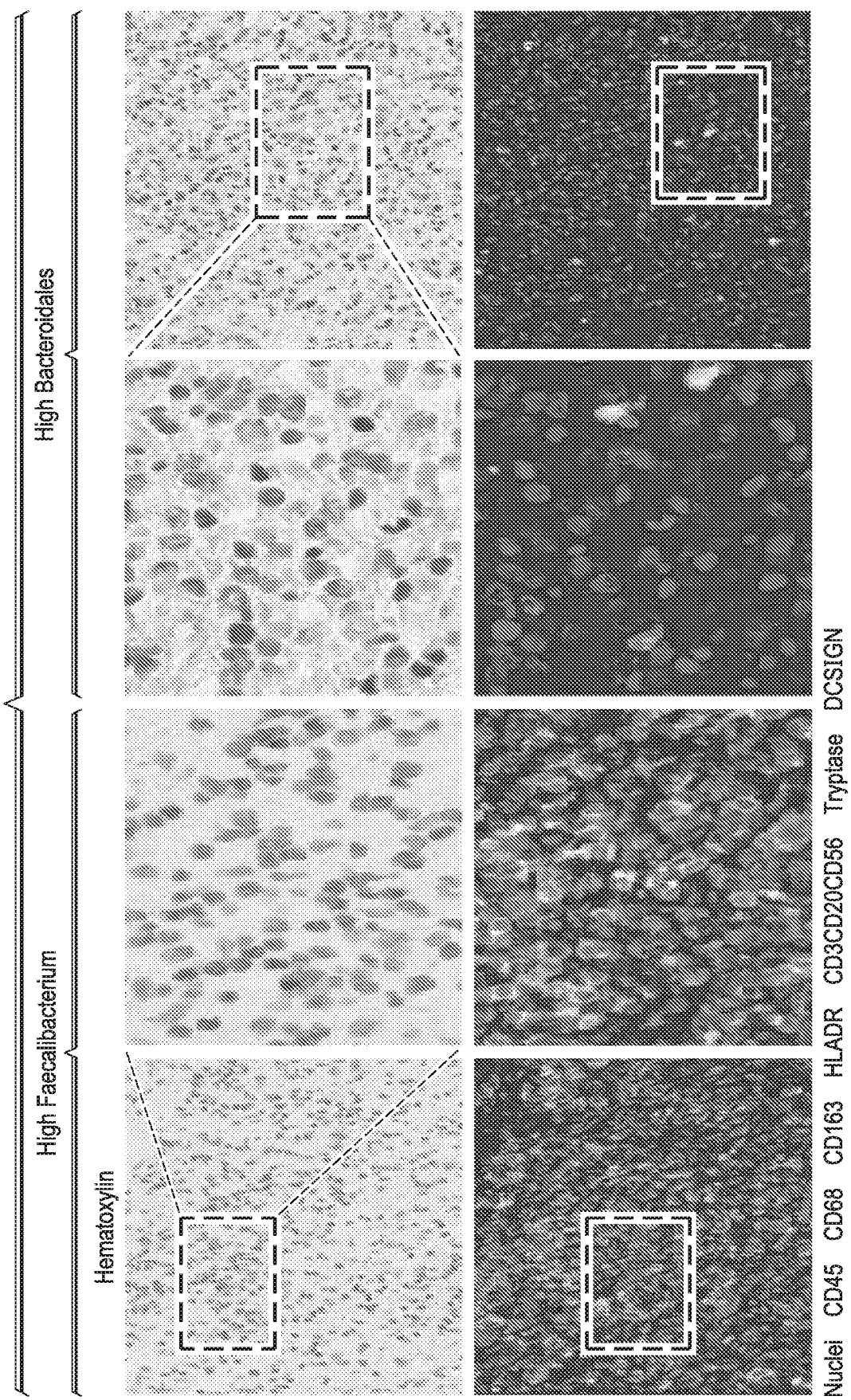
Figure 4F:
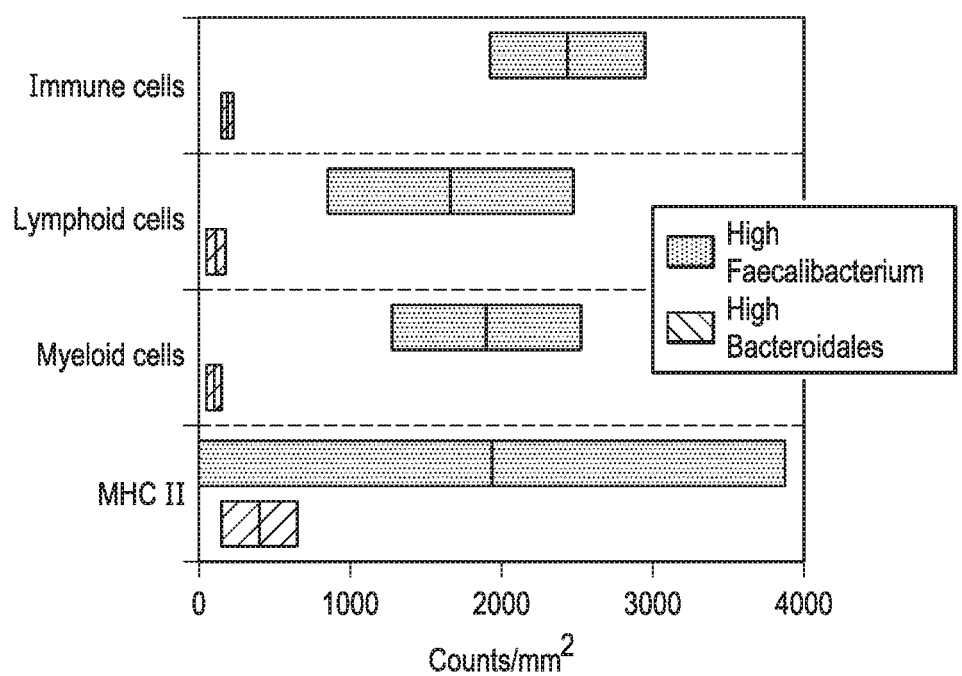

There is clear evidence in pre-clinical models that differential composition of the gut microbiome may influence therapeutic responses to PD-1 blockade at the level of the tumor microenvironment (Sivan et al., 2015), thus the relationship between the gut microbiota and systemic and anti-tumor immune responses was interrogated in the cohort of patients on PD-1 blockade. To do this the tumor associated immune infiltrates were compared via multi-parameter IHC, and observed a higher density of $CD8^+$ T lymphocytes in baseline samples of R versus NR (p=0.04), consistent with prior reports (FIGS. 4A and 18A-F) (Tumeh et al., 2014; Chen et al., 2016). Pairwise comparisons using Spearman rank correlation were then performed between specific bacterial taxa enriched in the gut microbiome of R and NR and immune markers in the tumor microenvironment, demonstrating a strong positive correlation between the abundance of Ruminococcaceae/*Faecalibacterium* in the gut and cytotoxic T-cell infiltrate in the tumor, and a strong negative correlation with Bacteroidales (FIGS. 4B-C and 19-20). Analysis of systemic immune responses via flow cytometry and cytokine assays revealed that patients with a high abundance of Ruminococcaceae in the gut had higher levels of effector CD4$^+$ and CD8$^+$ T cells in the systemic circulation with a preserved cytokine response to PD-1 blockade, whereas patients with a higher abundance of Bacteroidales in the gut microbiome had higher levels of regulatory T cells (Treg) and myeloid derived suppressor cells (MDSC) in the systemic circulation, with a blunted cytokine response (FIGS. 4D and 21-22). To better understand the influence of compositional differences in the gut microbiome on antigen processing and presentation within the tumor microenvironment, multiplex IHC targeting the myeloid compartment was performed (Tsujikawa et al., 2017). In these studies, patients with a high abundance of *Faecalibacterium* in the gut microbiome had a higher density of immune cells and markers of antigen processing and presentation compared to those with a high abundance of Bacteroidales (FIGS. 4E-F and 23-24), suggesting a possible mechanism through which the gut microbiome may modulate anti-tumor immune responses (Sivan et al., 2015).

Figure 4G:
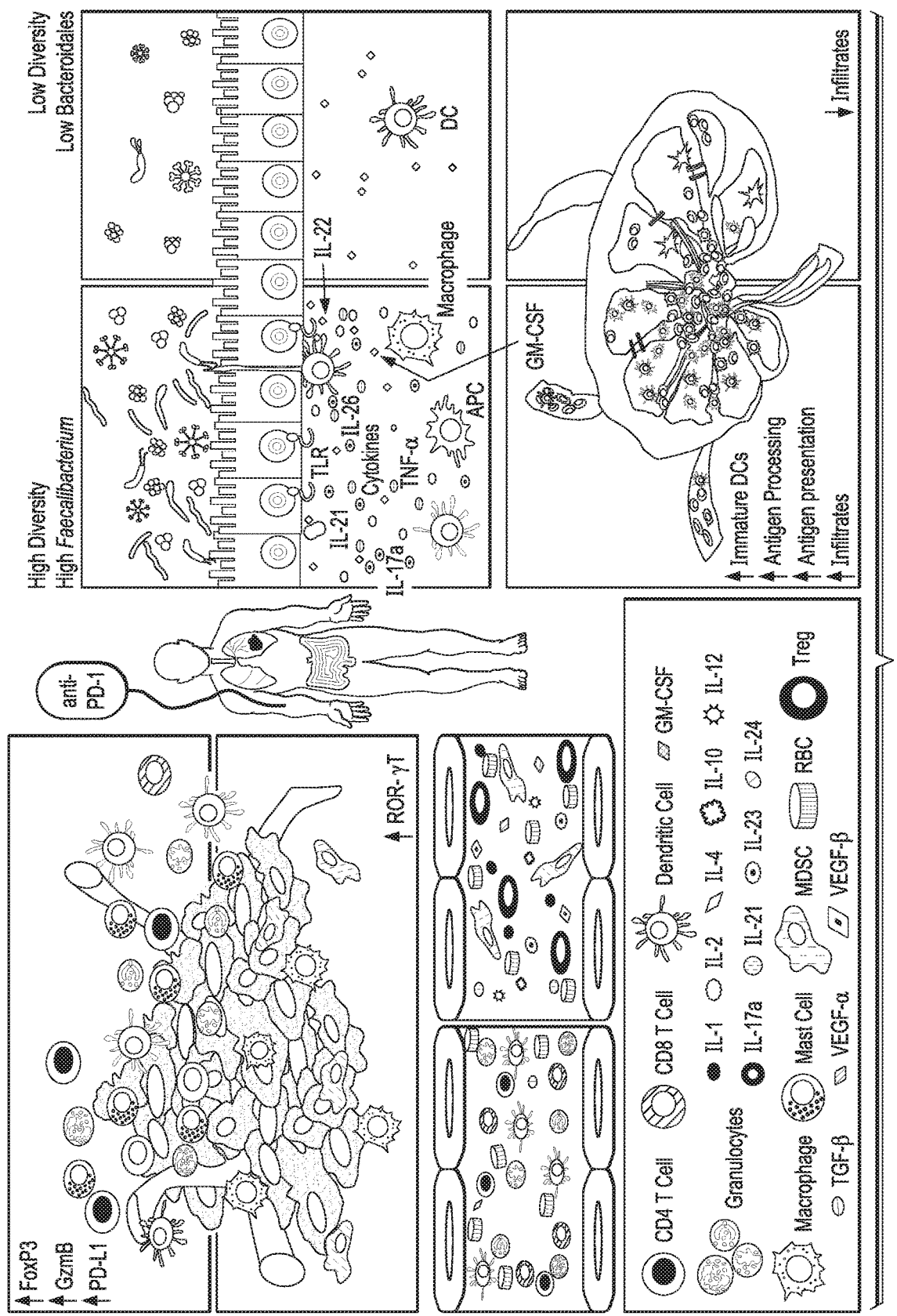

Placing these insights in the context of published literature, it was proposed that the gut microbiome modulates responses to treatment with anti-PD-1 therapy (FIG. 4G). Specifically, it was proposed that patients with a "favorable" gut microbiome (with high diversity and abundance of Ruminococcaceae/*Faecalibacterium*) have enhanced systemic and anti-tumor immune responses mediated by enhanced antigen presentation at the level of the lymph node and tumor, as well as preserved effector T cell function in the periphery and the tumor microenvironment. In contrast, patients with an "unfavorable" gut microbiome (with low diversity and high relative abundance of Bacteroidales) have impaired systemic and anti-tumor immune responses mediated by limited intratumoral infiltration of both lymphoid and myeloid elements, weakened antigen presentation capacity, and skewing towards immunoregulatory cellular and humoral elements in the periphery, including Treg and MDSC. These findings highlight the potential for parallel modulation of the gut microbiome to significantly enhance checkpoint blockade efficacy.

TABLE 6

Univariate and multivariate Cox proportional hazards models for progression-free survival in the fecal analysis cohort.

| Variable | Univariate HR$_a$ (95% C.I.) | p-value | HR$_a$- Final model$_b$ (95% C.I.)$_a$ | p-value |
|---|---|---|---|---|
| alpha-diversity (Inverse Simpson)$_c$ | | | | |
| High (ref) | | | | |
| Intermediate | 3.57 (1.01-12.74) | 0.05 | | |
| Low | 3.94 (1.02-12.52) | 0.05 | | |
| *Faecalibacterium* abundance$_d$ | | | | |
| High (ref) | | | | |
| Low | 2.92 (1.08-7.89) | 0.03 | 3.64 (1.28-10.40) | 0.02 |
| Bacteroidales abundance$_d$ | | | | |
| High (ref) | | | | |
| Low | 0.39 (0.15-1.03) | 0.06 | | |
| crOTU Cluster | | | | |
| Cluster 1 (ref) | | | | |
| Cluster 2 | 3.80 (1.09-13.21) | 0.04 | | |
| Sex | | | | |
| Male (ref) | | | | |
| Female | 0.84 (0.30-2.35) | 0.11 | | |
| Ethnicity | | | | |
| White (ref) | | | | |
| Other | 3.23 (0.86-12.09) | 0.08 | | |
| Age | 1.01 (0.98-1.03) | 0.10 | | |
| Primary Site | | | | |
| Cutaneous (ref) | | | | |
| Other | 1.02 (0.23-4.52) | 0.98 | | |
| Stage | | | | |
| III (ref) | | | | |
| IV | 1.18 (0.34-4.16) | 0.08 | | |
| Baseline LDH | | | | |
| Normal (ref) | | | | |
| Elevated$_c$ | 2.24 (0.79-6.32) | 0.13 | | |
| Prior Immunotherapy | | | | |
| No (ref) | | | | |
| Yes | 2.28 (1.11-7.18) | 0.03 | | |
| Prior Targeted therapy | | | | |
| No (ref) | | | | |
| Yes | 1.88 (0.66-5.31) | 0.24 | | |

TABLE 6-continued

Univariate and multivariate Cox proportional hazards models for progression-free survival in the fecal analysis cohort.

| Variable | Univariate HR$_a$ (95% C.I.) | p-value | HR$_a$- Final model$_b$ (95% C.I.)$_a$ | p-value |
|---|---|---|---|---|
| Anti-PD-1 combination vs monotherapy | | | | |
| Monotherapy (ref) | | | | |
| Combinations | 1.40 (0.23-6.13) | 0.20 | | |
| CD8+ density in baseline tumor$_d$ | 0.99 (0.99-1.00) | 0.07 | | |

$_a$HRs represent 4 patients excluded from analysis due to insufficient follow up data
$_b$Final model determine by forwards selection and best subsets approach. Alpha Diversity was included as a binary variable based on the median cut point.
$_c$elevated LDH: exceeding the upper limit of normal (618 IU/mL), all samples assayed in a common laboratory
$_d$CD8+ density based on samples from 15 patients with baseline tumor available

TABLE 7

Pairwise comparison of MetaCyc pathway class by response.

| Pathway | Estimate$^a$ | p-value | Enrichment Index | Enriched In |
|---|---|---|---|---|
| glycolate and glyoxylate degradation I | 0.05 | 0.00 | −0.52 | NR |
| oxalate degradation II | 0.08 | 0.03 | −0.36 | NR |
| formate to trimethylamine N-oxide electron transfer | 0.11 | 0.04 | −0.29 | NR |
| D-sorbitol degradation II | 0.00 | 0.05 | −0.22 | NR |
| ketogluconate metabolism | 0.00 | 0.05 | −0.22 | NR |
| phenylacetate degradation I (aerobic) | 0.14 | 0.09 | −0.23 | NR |
| pyridoxal 5'-phosphate biosynthesis I | 0.18 | 0.10 | −0.31 | NR |
| superpathway of pyridoxal 5'-phosphate biosynthesis and salvage | 0.18 | 0.10 | −0.31 | NR |
| 4-aminobutanoate degradation III | 0.00 | 0.11 | −0.17 | NR |
| hydrogen to trimethylamine N-oxide electron transfer | 0.00 | 0.11 | −0.17 | NR |
| 4-hydroxybenzoate biosynthesis II (microbes) | 0.22 | 0.11 | −0.34 | NR |
| glycocholate metabolism (bacteria) | 0.24 | 0.12 | −0.38 | NR |
| malonate decarboxylase activation | 0.21 | 0.18 | −0.52 | NR |
| 4-aminobutanoate degradation II | 0.19 | 0.18 | −0.17 | NR |
| aspartate superpathway | 0.19 | 0.18 | −0.17 | NR |
| D-malate degradation | 0.19 | 0.18 | −0.17 | NR |
| formate to dimethyl sulfoxide electron transfer | 0.19 | 0.18 | −0.17 | NR |
| L-lysine degradation I | 0.19 | 0.18 | −0.17 | NR |
| NAD biosynthesis I (from aspartate) | 0.19 | 0.18 | −0.17 | NR |
| nitrate reduction III (dissimilatory) | 0.19 | 0.18 | −0.17 | NR |
| 2-methylcitrate cycle I | 0.24 | 0.21 | −0.24 | NR |
| GDP-D-glycero-alpha-D-manno-heptose biosynthesis | 0.24 | 0.21 | −0.24 | NR |
| sulfoquinovose degradation I | 0.24 | 0.21 | −0.24 | NR |
| superpathway of 4-aminobutanoate degradation | 0.24 | 0.21 | −0.24 | NR |
| tetrahydromonapterin biosynthesis | 0.24 | 0.21 | −0.24 | NR |
| mevalonate pathway I | 0.30 | 0.23 | −0.26 | NR |
| superpathway of geranylgeranyldiphosphate biosynthesis I (via mevalonate) | 0.30 | 0.23 | −0.26 | NR |
| D-galactonate degradation | 0.00 | 0.23 | −0.12 | NR |
| trehalose degradation I (low osmolarity) | 0.00 | 0.23 | −0.12 | NR |
| 4-aminobutanoate degradation I | 0.31 | 0.23 | −0.18 | NR |
| adenine and adenosine salvage V | 0.31 | 0.23 | −0.18 | NR |
| guanine and guanosine salvage III | 0.31 | 0.23 | −0.18 | NR |
| superpathway of guanine and guanosine salvage | 0.31 | 0.23 | −0.18 | NR |
| L-ascorbate degradation II (bacterial, aerobic) | 0.33 | 0.24 | −0.28 | NR |
| fatty acid beta-oxidation I | 0.26 | 0.34 | −0.12 | NR |
| glucose and glucose-1-phosphate degradation | 0.26 | 0.34 | −0.12 | NR |
| glyoxylate cycle | 0.26 | 0.34 | −0.12 | NR |
| L-gulonate degradation | 0.26 | 0.34 | −0.12 | NR |
| superpathway of glyoxylate bypass and TCA | 0.26 | 0.34 | −0.12 | NR |
| 3-phenylpropanoate and 3-(3-hydroxyphenyl)propanoate degradation to 2-oxopent-4-enoate | 0.34 | 0.39 | −0.36 | NR |
| L-phenylalanine biosynthesis II | 0.34 | 0.39 | −0.36 | NR |
| tetrathionate reduction I (to thiosulfate) | 0.34 | 0.39 | −0.36 | NR |
| urate degradation to allantoin II | 0.34 | 0.39 | −0.36 | NR |
| cob(II)yrinate a,c-diamide biosynthesis I (early cobalt insertion) | 0.41 | 0.41 | −0.12 | NR |
| glycerol-3-phosphate to cytochrome bo oxidase electron transfer | 0.41 | 0.41 | −0.12 | NR |
| NADH to cytochrome bo oxidase electron transfer I | 0.41 | 0.41 | −0.12 | NR |
| proline to cytochrome bo oxidase electron transfer | 0.41 | 0.41 | −0.12 | NR |
| pyruvate to cytochrome bo oxidase electron transfer | 0.41 | 0.41 | −0.12 | NR |
| succinate to cytochrome bo oxidase electron transfer | 0.41 | 0.41 | −0.12 | NR |
| cinnamate and 3-hydroxycinnamate degradation to 2-oxopent-4-enoate | 0.39 | 0.41 | −0.19 | NR |
| Entner-Doudoroff pathway I | 0.39 | 0.41 | −0.19 | NR |
| superpathway of glycolysis and Entner-Doudoroff | 0.39 | 0.41 | −0.19 | NR |
| glycerol degradation II | 0.44 | 0.43 | −0.20 | NR |
| L-threonine degradation III (to methylglyoxal) | 0.44 | 0.43 | −0.20 | NR |

TABLE 7-continued

Pairwise comparison of MetaCyc pathway class by response.

| Pathway | Estimate[a] | p-value | Enrichment Index | Enriched In |
|---|---|---|---|---|
| neurosporene biosynthesis | 0.44 | 0.43 | −0.20 | NR |
| phenylethylamine degradation I | 0.44 | 0.43 | −0.20 | NR |
| trans-lycopene biosynthesis I (bacteria) | 0.44 | 0.43 | −0.20 | NR |
| acetate formation from acetyl-CoA II | 0.49 | 0.43 | −0.23 | NR |
| crotonate fermentation (to acetate and cyclohexane carboxylate) | 0.49 | 0.43 | −0.23 | NR |
| D-allose degradation | 0.49 | 0.43 | −0.23 | NR |
| 2-O-alpha-mannosyl-D-glycerate degradation | 0.48 | 0.43 | −0.21 | NR |
| galactitol degradation | 0.48 | 0.43 | −0.21 | NR |
| malonate degradation I (biotin-independent) | 0.48 | 0.43 | −0.21 | NR |
| (R)-acetoin biosynthesis I | 0.48 | 0.43 | −0.21 | NR |
| (R,R)-butanediol biosynthesis | 0.48 | 0.43 | −0.21 | NR |
| (R,R)-butanediol degradation | 0.48 | 0.43 | −0.21 | NR |
| aerobactin biosynthesis | 0.00 | 0.44 | −1.00 | NR |
| benzoyl-CoA degradation I (aerobic) | 0.00 | 0.44 | −1.00 | NR |
| glutaryl-CoA degradation | 0.00 | 0.44 | −1.00 | NR |
| nitrate reduction I (denitrification) | 0.00 | 0.44 | −1.00 | NR |
| pectin degradation II | 0.00 | 0.44 | −1.00 | NR |
| fluoroacetate and fluorothreonine biosynthesis | 0.00 | 0.49 | −0.08 | NR |
| catechol degradation to beta-ketoadipate | 0.36 | 0.56 | −0.44 | NR |
| chondroitin sulfate degradation I (bacterial) | 0.36 | 0.56 | −0.44 | NR |
| dermatan sulfate degradation I (bacterial) | 0.36 | 0.56 | −0.44 | NR |
| L-methionine salvage cycle III | 0.36 | 0.56 | −0.44 | NR |
| phenylmercury acetate degradation | 0.36 | 0.56 | −0.44 | NR |
| urea degradation I | 0.36 | 0.56 | −0.44 | NR |
| 4-hydroxyphenylpyruvate biosynthesis | 0.38 | 0.60 | −0.07 | NR |
| glutathionylspermidine biosynthesis | 0.38 | 0.60 | −0.07 | NR |
| L-phenylalanine biosynthesis I | 0.38 | 0.60 | −0.07 | NR |
| methylerythritol phosphate pathway II | 0.38 | 0.60 | −0.07 | NR |
| nitrate reduction IX (dissimilatory) | 0.38 | 0.60 | −0.07 | NR |
| nitrate reduction X (periplasmic, dissimilatory) | 0.38 | 0.60 | −0.07 | NR |
| paraoxon degradation | 0.38 | 0.60 | −0.07 | NR |
| parathion degradation | 0.38 | 0.60 | −0.07 | NR |
| superpathway of aromatic amino acid biosynthesis | 0.38 | 0.60 | −0.07 | NR |
| 3-methylthiopropanoate biosynthesis | 0.49 | 0.66 | −0.26 | NR |
| allantoin degradation to glyoxylate III | 0.49 | 0.66 | −0.26 | NR |
| gallate degradation I | 0.49 | 0.66 | −0.26 | NR |
| sulfoacetaldehyde degradation III | 0.49 | 0.66 | −0.26 | NR |
| syringate degradation | 0.49 | 0.66 | −0.26 | NR |
| (5Z)-dodec-5-enoate biosynthesis | 0.57 | 0.66 | −0.07 | NR |
| fatty acid beta-oxidation III (unsaturated, odd number) | 0.57 | 0.66 | −0.07 | NR |
| formaldehyde oxidation II (glutathione-dependent) | 0.57 | 0.66 | −0.07 | NR |
| oleate biosynthesis IV (anaerobic) | 0.57 | 0.66 | −0.07 | NR |
| superpathway of fatty acids biosynthesis (*E. coli*) | 0.57 | 0.66 | −0.07 | NR |
| superpathway of unsaturated fatty acids biosynthesis (*E. coli*) | 0.57 | 0.66 | −0.07 | NR |
| NAD salvage pathway III | 0.51 | 0.68 | −0.12 | NR |
| NAD salvage pathway IV | 0.51 | 0.68 | −0.12 | NR |
| superpathway of ubiquinol-8 biosynthesis (prokaryotic) | 0.51 | 0.68 | −0.12 | NR |
| ubiquinol-7 biosynthesis (prokaryotic) | 0.51 | 0.68 | −0.12 | NR |
| ubiquinol-8 biosynthesis (prokaryotic) | 0.51 | 0.68 | −0.12 | NR |
| ubiquinol-9 biosynthesis (prokaryotic) | 0.51 | 0.68 | −0.12 | NR |
| dTDP-N-acetylthomosamine biosynthesis | 0.58 | 0.69 | −0.12 | NR |
| putrescine degradation II | 0.58 | 0.69 | −0.12 | NR |
| taurine degradation IV | 0.58 | 0.69 | −0.12 | NR |
| bile acids degradation | 0.64 | 0.70 | −0.12 | NR |
| guanine and guanosine salvage II | 0.64 | 0.70 | −0.12 | NR |
| guanosine nucleotides degradation II | 0.64 | 0.70 | −0.12 | NR |
| superpathway of phenylethylamine degradation | 0.64 | 0.70 | −0.12 | NR |
| formaldehyde assimilation I (serine pathway) | 0.68 | 0.70 | −0.12 | NR |
| L-arginine degradation II (AST pathway) | 0.68 | 0.70 | −0.12 | NR |
| S-methyl-5'-thioadenosine degradation II | 0.68 | 0.70 | −0.12 | NR |
| superpathway of (R,R)-butanediol biosynthesis | 0.68 | 0.70 | −0.12 | NR |
| 2,3-dihydroxybenzoate biosynthesis | 0.94 | 1.00 | −0.01 | NR |
| 2-oxoisovalerate decarboxylation to isobutanoyl-CoA | 0.00 | 1.00 | −0.04 | NR |
| acyl carrier protein metabolism | 0.77 | 1.00 | −0.05 | NR |
| allantoin degradation IV (anaerobic) | 0.61 | 1.00 | −0.03 | NR |
| allantoin degradation to ureidoglycolate II (ammonia producing) | 0.61 | 1.00 | −0.03 | NR |
| allantoin degradation to ureidoglycolate I (urea producing) | 0.78 | 1.00 | −0.12 | NR |
| anthranilate degradation I (aerobic) | 0.78 | 1.00 | −0.12 | NR |
| *Bifidobacterium* shunt | 0.69 | 1.00 | −0.06 | NR |
| cyanate degradation | 0.71 | 1.00 | −0.12 | NR |
| D-glucarate degradation II | 0.00 | 1.00 | −0.04 | NR |
| D-gluconate degradation | 0.00 | 1.00 | −0.04 | NR |
| D-glucosaminate degradation | 0.76 | 1.00 | −0.12 | NR |
| D-serine degradation | 0.00 | 1.00 | −0.04 | NR |
| glucose degradation (oxidative) | 0.84 | 1.00 | −0.04 | NR |
| glutathione-glutaredoxin redox reactions | 0.00 | 1.00 | −0.04 | NR |

TABLE 7-continued

Pairwise comparison of MetaCyc pathway class by response.

| Pathway | Estimate[a] | p-value | Enrichment Index | Enriched In |
|---|---|---|---|---|
| heme biosynthesis I (aerobic) | 0.94 | 1.00 | −0.01 | NR |
| heptadecane biosynthesis | 0.61 | 1.00 | −0.03 | NR |
| lactose and galactose degradation I | 0.71 | 1.00 | −0.12 | NR |
| L-methionine degradation I (to L-homocysteine) | 0.74 | 1.00 | −0.12 | NR |
| L-methionine salvage cycle I (bacteria and plants) | 0.76 | 1.00 | −0.12 | NR |
| maltose degradation | 0.00 | 1.00 | −0.04 | NR |
| mannitol degradation I | 0.00 | 1.00 | −0.04 | NR |
| mannosylglycerate biosynthesis I | 0.90 | 1.00 | −0.03 | NR |
| PRPP biosynthesis II | 0.77 | 1.00 | −0.05 | NR |
| pseudouridine degradation | 0.69 | 1.00 | −0.06 | NR |
| purine nucleotides degradation II (aerobic) | 0.00 | 1.00 | −0.04 | NR |
| pyrimidine deoxyribonucleotides de novo biosynthesis III | 0.94 | 1.00 | −0.01 | NR |
| pyrimidine deoxyribonucleotides dephosphorylation | 0.90 | 1.00 | −0.03 | NR |
| pyrimidine nucleobases salvage II | 0.00 | 1.00 | −0.04 | NR |
| pyrroloquinoline quinone biosynthesis | 0.76 | 1.00 | −0.12 | NR |
| pyruvate decarboxylation to acetyl CoA | 0.00 | 1.00 | −0.04 | NR |
| quinate degradation I | 0.90 | 1.00 | −0.03 | NR |
| (R)-acetoin biosynthesis II | 0.82 | 1.00 | −0.02 | NR |
| (S)-acetoin biosynthesis | 0.77 | 1.00 | −0.05 | NR |
| salicylate biosynthesis I | 0.90 | 1.00 | −0.03 | NR |
| shikimate degradation I | 0.90 | 1.00 | −0.03 | NR |
| S-methyl-5'-thioadenosine degradation I | 0.90 | 1.00 | −0.03 | NR |
| S-methyl-5-thio-alpha-D-ribose 1-phosphate degradation | 0.76 | 1.00 | −0.12 | NR |
| (S,S)-butanediol biosynthesis | 0.77 | 1.00 | −0.05 | NR |
| (S,S)-butanediol degradation | 0.77 | 1.00 | −0.05 | NR |
| sulfate reduction I (assimilatory) | 0.00 | 1.00 | −0.04 | NR |
| sulfate reduction III (assimilatory) | 0.00 | 1.00 | −0.04 | NR |
| sulfite oxidation III | 0.00 | 1.00 | −0.04 | NR |
| sulfur reduction II (via polysulfide) | 0.78 | 1.00 | −0.12 | NR |
| superpathway of L-arginine, putrescine, and 4-aminobutanoate degradation | 0.90 | 1.00 | −0.03 | NR |
| superpathway of ornithine degradation | 0.90 | 1.00 | −0.03 | NR |
| TCA cycle I (prokaryotic) | 0.00 | 1.00 | −0.04 | NR |
| trehalose biosynthesis IV | 0.00 | 1.00 | −0.04 | NR |
| trehalose biosynthesis V | 0.78 | 1.00 | −0.12 | NR |
| trehalose degradation II (trehalase) | 0.61 | 1.00 | −0.03 | NR |
| trehalose degradation VI (periplasmic) | 0.61 | 1.00 | −0.03 | NR |
| two-component alkanesulfonate monooxygenase | 0.94 | 1.00 | −0.01 | NR |
| UDP-2,3-diacetamido-2,3-dideoxy-alpha-D-mannuronate biosynthesis | 0.61 | 1.00 | −0.03 | NR |
| urate biosynthesis/inosine 5'-phosphate degradation | 0.00 | 1.00 | −0.04 | NR |
| vanillin and vanillate degradation II | 0.90 | 1.00 | −0.03 | NR |
| vancomycin resistance II | Inf | 0.02 | 1.00 | R |
| inosine-5'-phosphate biosynthesis III | Inf | 0.11 | 1.00 | R |
| fructan biosynthesis | 4.48 | 0.11 | 0.40 | R |
| putrescine degradation I | 6.84 | 0.13 | 0.19 | R |
| L-cysteine degradation II | 4.66 | 0.18 | 0.22 | R |
| D-serine metabolism | 5.21 | 0.18 | 0.59 | R |
| bis(guanylyl molybdenum cofactor) biosynthesis | Inf | 0.18 | 0.10 | R |
| gentisate degradation I | Inf | 0.23 | 1.00 | R |
| kojibiose degradation | Inf | 0.23 | 1.00 | R |
| methanogenesis from H2 and CO2 | Inf | 0.23 | 1.00 | R |
| phosphopantothenate biosynthesis III | Inf | 0.23 | 1.00 | R |
| reductive acetyl coenzyme A pathway II (autotrophic methanogens) | Inf | 0.23 | 1.00 | R |
| (R)-cysteate degradation | 3.00 | 0.24 | 0.28 | R |
| L-cysteine biosynthesis III (from L-homocysteine) | 2.86 | 0.24 | 0.22 | R |
| glycolysis IV (plant cytosol) | 3.26 | 0.35 | 0.15 | R |
| UDP-N-acetyl-D-galactosamine biosynthesis I | 2.91 | 0.39 | 0.18 | R |
| formaldehyde oxidation I | 2.41 | 0.41 | 0.33 | R |
| trehalose degradation IV | 2.41 | 0.41 | 0.33 | R |
| heme biosynthesis II (anaerobic) | 2.56 | 0.41 | 0.29 | R |
| superpathway of heme biosynthesis from uroporphyrinogen-III | 2.56 | 0.41 | 0.29 | R |
| 8-amino-7-oxononanoate biosynthesis III | 2.25 | 0.43 | 0.22 | R |
| 2-oxoglutarate decarboxylation to succinyl-CoA | Inf | 0.44 | 0.05 | R |
| CMP-N-acetylneuraminate biosynthesis II (bacteria) | Inf | 0.44 | 0.05 | R |
| cob(II)yrinate a,c-diamide biosynthesis II (late cobalt incorporation) | Inf | 0.44 | 0.05 | R |
| cyclopropane fatty acid (CFA) biosynthesis | Inf | 0.44 | 0.05 | R |
| guanylyl molybdenum cofactor biosynthesis | Inf | 0.44 | 0.05 | R |
| hydrogen production III | Inf | 0.44 | 0.05 | R |
| hydrogen production VI | Inf | 0.44 | 0.05 | R |
| L-arginine degradation I (arginase pathway) | Inf | 0.44 | 0.05 | R |
| L-arginine degradation VI (arginase 2 pathway) | Inf | 0.44 | 0.05 | R |
| L-citrulline biosynthesis | Inf | 0.44 | 0.05 | R |
| L-ornithine biosynthesis II | Inf | 0.44 | 0.05 | R |
| L-proline biosynthesis III | Inf | 0.44 | 0.05 | R |
| pectin degradation III | Inf | 0.44 | 0.05 | R |
| putrescine biosynthesis IV | Inf | 0.44 | 0.05 | R |
| adenine and adenosine salvage VI | Inf | 0.49 | 1.00 | R |

TABLE 7-continued

Pairwise comparison of MetaCyc pathway class by response.

| Pathway | Estimate[a] | p-value | Enrichment Index | Enriched In |
|---|---|---|---|---|
| alginate degradation | Inf | 0.49 | 1.00 | R |
| glycine biosynthesis III | Inf | 0.49 | 1.00 | R |
| sulfolactate degradation I | Inf | 0.49 | 1.00 | R |
| superpathway of L-cysteine biosynthesis (mammalian) | Inf | 0.49 | 1.00 | R |
| L-histidine degradation III | 2.77 | 0.56 | 0.06 | R |
| nitrogen fixation I (ferredoxin) | 2.77 | 0.56 | 0.06 | R |
| chlorosalicylate degradation | 2.63 | 0.60 | 0.40 | R |
| methylsalicylate degradation | 2.63 | 0.60 | 0.40 | R |
| salicylate degradation I | 2.63 | 0.60 | 0.40 | R |
| acrylate degradation | 2.18 | 0.62 | 0.08 | R |
| L-methionine degradation II | 2.18 | 0.62 | 0.08 | R |
| cyanophycin metabolism | 1.76 | 0.66 | 0.22 | R |
| TCA cycle VII (acetate-producers) | 1.76 | 0.66 | 0.22 | R |
| Kdo transfer to lipid IVA II | 1.95 | 0.68 | 0.22 | R |
| aminopropanol phosphate biosynthesis I | 1.71 | 0.69 | 0.16 | R |
| hopanoid biosynthesis (bacteria) | 1.57 | 0.70 | 0.11 | R |
| D-galactarate degradation I | 1.48 | 0.70 | 0.08 | R |
| D-glucarate degradation I | 1.48 | 0.70 | 0.08 | R |
| formaldehyde assimilation II (RuMP Cycle) | 1.48 | 0.70 | 0.08 | R |
| ribose degradation | 1.48 | 0.70 | 0.08 | R |
| superpathway of D-glucarate and D-galactarate degradation | 1.48 | 0.70 | 0.08 | R |
| 1,2-dichloroethane degradation | Inf | 1.00 | 1.00 | R |
| 1,4-dihydroxy-2-naphthoate biosynthesis | 0.00 | 1.00 | 0.00 | R |
| 2-aminoethylphosphonate degradation I | 0.00 | 1.00 | 0.00 | R |
| 2'-deoxy-alpha-D-ribose 1-phosphate degradation | 0.00 | 1.00 | 0.00 | R |
| [2Fe—2S] iron-sulfur cluster biosynthesis | 0.00 | 1.00 | 0.00 | R |
| 2-heptyl-3-hydroxy-4(1H)-quinolone biosynthesis | Inf | 1.00 | 1.00 | R |
| 3-dehydroquinate biosynthesis I | 0.00 | 1.00 | 0.00 | R |
| 4-amino-2-methyl-5-diphosphomethylpyrimidine biosynthesis | 0.00 | 1.00 | 0.00 | R |
| 4-aminobenzoate biosynthesis | 0.00 | 1.00 | 0.00 | R |
| 4-deoxy-L-threo-hex-4-enopyranuronate degradation | 0.00 | 1.00 | 0.00 | R |
| 5-aminoimidazole ribonucleotide biosynthesis I | 0.00 | 1.00 | 0.00 | R |
| 6-hydroxymethyl-dihydropterin diphosphate biosynthesis I | 0.00 | 1.00 | 0.00 | R |
| 8-amino-7-oxononanoate biosynthesis I | 0.00 | 1.00 | 0.00 | R |
| acetate conversion to acetyl-CoA | 0.00 | 1.00 | 0.00 | R |
| acetate formation from acetyl-CoA I | 0.00 | 1.00 | 0.00 | R |
| adenine and adenosine salvage I | 0.00 | 1.00 | 0.00 | R |
| adenine and adenosine salvage III | 0.00 | 1.00 | 0.00 | R |
| adenine salvage | 0.00 | 1.00 | 0.00 | R |
| adenosine deoxyribonucleotides de novo biosynthesis | 0.00 | 1.00 | 0.00 | R |
| adenosine deoxyribonucleotides de novo biosynthesis II | 0.00 | 1.00 | 0.00 | R |
| adenosine nucleotides degradation II | 0.00 | 1.00 | 0.00 | R |
| adenosine nucleotides degradation III | 0.00 | 1.00 | 0.00 | R |
| adenosine ribonucleotides de novo biosynthesis | 0.00 | 1.00 | 0.00 | R |
| adenosylcobalamin biosynthesis from cobyrinate a,c-diamide I | 0.00 | 1.00 | 0.00 | R |
| adenosylcobalamin biosynthesis from cobyrinate a,c-diamide II | 0.00 | 1.00 | 0.00 | R |
| adenosylcobalamin salvage from cobalamin | 0.00 | 1.00 | 0.00 | R |
| adenosylcobalamin salvage from cobinamide I | 0.00 | 1.00 | 0.00 | R |
| ADP-L-glycero-beta-D-manno-heptose biosynthesis | 1.32 | 1.00 | 0.02 | R |
| aerobic respiration I (cytochrome c) | 1.63 | 1.00 | 0.22 | R |
| allantoin degradation to glyoxylate I | Inf | 1.00 | 1.00 | R |
| ammonia assimilation cycle III | 0.00 | 1.00 | 0.00 | R |
| androstenedione degradation | Inf | 1.00 | 1.00 | R |
| anhydromuropeptides recycling | 0.00 | 1.00 | 0.00 | R |
| arginine dependent acid resistance | 0.00 | 1.00 | 0.00 | R |
| arsenate detoxification II (glutaredoxin) | 0.00 | 1.00 | 0.00 | R |
| autoinducer AI-2 biosynthesis I | 0.00 | 1.00 | 0.00 | R |
| autoinducer AI-2 degradation | 0.00 | 1.00 | 0.00 | R |
| base-degraded thiamine salvage | 0.00 | 1.00 | 0.00 | R |
| beta-alanine biosynthesis II | Inf | 1.00 | 1.00 | R |
| beta-alanine biosynthesis III | 0.00 | 1.00 | 0.00 | R |
| beta-D-glucuronide and D-glucuronate degradation | 0.00 | 1.00 | 0.00 | R |
| biotin biosynthesis from 8-amino-7-oxononanoate I | 0.00 | 1.00 | 0.00 | R |
| biotin biosynthesis I | 0.00 | 1.00 | 0.00 | R |
| biotin-carboxyl carrier protein assembly | 0.00 | 1.00 | 0.00 | R |
| C4 photosynthetic carbon assimilation cycle, NAD-ME type | 0.00 | 1.00 | 0.00 | R |
| Calvin-Benson-Bassham cycle | Inf | 1.00 | 1.00 | R |
| CDP-diacylglycerol biosynthesis I | 0.00 | 1.00 | 0.00 | R |
| CDP-diacylglycerol biosynthesis II | 0.00 | 1.00 | 0.00 | R |
| cellulose and hemicellulose degradation (cellulolosome) | 1.29 | 1.00 | 0.01 | R |
| cellulose biosynthesis | 1.32 | 1.00 | 0.02 | R |
| chitin degradation II | 0.00 | 1.00 | 0.00 | R |
| chitobiose degradation | 0.00 | 1.00 | 0.00 | R |
| chorismate biosynthesis from 3-dehydroquinate | 0.00 | 1.00 | 0.00 | R |
| chorismate biosynthesis I | 0.00 | 1.00 | 0.00 | R |
| cis-genanyl-CoA degradation | 1.63 | 1.00 | 0.22 | R |

TABLE 7-continued

Pairwise comparison of MetaCyc pathway class by response.

| Pathway | Estimate[a] | p-value | Enrichment Index | Enriched In |
|---|---|---|---|---|
| cis-vaccenate biosynthesis | 0.00 | 1.00 | 0.00 | R |
| citrate degradation | 0.00 | 1.00 | 0.00 | R |
| citrate lyase activation | 0.00 | 1.00 | 0.00 | R |
| CMP-3-deoxy-D-manno-octulosonate biosynthesis | 0.00 | 1.00 | 0.00 | R |
| CMP phosphorylation | 0.00 | 1.00 | 0.00 | R |
| coenzyme A biosynthesis I | 0.00 | 1.00 | 0.00 | R |
| creatinine degradation I | 0.00 | 1.00 | 0.00 | R |
| cytidylyl molybdenum cofactor biosynthesis | 0.00 | 1.00 | 0.00 | R |
| D-arabinose degradation I | 0.00 | 1.00 | 0.00 | R |
| demethylmenaquinol-6 biosynthesis I | 0.00 | 1.00 | 0.00 | R |
| demethylmenaquinol-8 biosynthesis I | 0.00 | 1.00 | 0.00 | R |
| demethylmenaquinol-9 biosynthesis | 0.00 | 1.00 | 0.00 | R |
| D-fructuronate degradation | 0.00 | 1.00 | 0.00 | R |
| D-galactarate degradation II | 0.00 | 1.00 | 0.00 | R |
| D-galactose degradation I (Leloir pathway) | 0.00 | 1.00 | 0.00 | R |
| D-galactose degradation V (Leloir pathway) | 0.00 | 1.00 | 0.00 | R |
| D-galacturonate degradation I | 0.00 | 1.00 | 0.00 | R |
| di-trans, poly-cis-undecaprenyl phosphate biosynthesis | 0.00 | 1.00 | 0.00 | R |
| D-mannose degradation | 0.00 | 1.00 | 0.00 | R |
| D-sorbitol degradation I | 0.00 | 1.00 | 0.00 | R |
| dTDP-L-rhamnose biosynthesis I | 0.00 | 1.00 | 0.00 | R |
| ethanolamine utilization | 0.00 | 1.00 | 0.00 | R |
| ethanol degradation I | 0.00 | 1.00 | 0.00 | R |
| ethanol degradation II | 0.00 | 1.00 | 0.00 | R |
| fatty acid biosynthesis initiation I | 0.00 | 1.00 | 0.00 | R |
| fatty acid biosynthesis initiation III | Inf | 1.00 | 1.00 | R |
| fatty acid elongation -- saturated | 0.00 | 1.00 | 0.00 | R |
| fatty acid salvage | Inf | 1.00 | 1.00 | R |
| flavin biosynthesis I (bacteria and plants) | 0.00 | 1.00 | 0.00 | R |
| fluoroacetate degradation | Inf | 1.00 | 1.00 | R |
| folate polyglutamylation | 0.00 | 1.00 | 0.00 | R |
| folate transformations I | 0.00 | 1.00 | 0.00 | R |
| formate assimilation into 5,10-methylenetetrahydrofolate | 0.00 | 1.00 | 0.00 | R |
| formate oxidation to CO2 | 0.00 | 1.00 | 0.00 | R |
| fructose degradation | 0.00 | 1.00 | 0.00 | R |
| fucose degradation | 0.00 | 1.00 | 0.00 | R |
| GABA shunt | Inf | 1.00 | 1.00 | R |
| GDP-L-fucose biosynthesis I (from GDP-D-mannose) | 0.00 | 1.00 | 0.00 | R |
| GDP-mannose biosynthesis | 0.00 | 1.00 | 0.00 | R |
| geranyl diphosphate biosynthesis | 0.00 | 1.00 | 0.00 | R |
| geranylgeranyl diphosphate biosynthesis | 0.00 | 1.00 | 0.00 | R |
| gluconeogenesis I | 0.00 | 1.00 | 0.00 | R |
| glutaminyl-tRNAgln biosynthesis via transamidation | 0.00 | 1.00 | 0.00 | R |
| glutathione biosynthesis | 0.00 | 1.00 | 0.00 | R |
| glutathione-peroxide redox reactions | 0.00 | 1.00 | 0.00 | R |
| glycerol-3-phosphate to fumarate electron transfer | 0.00 | 1.00 | 0.00 | R |
| glycerol and glycerophosphodiester degradation | 0.00 | 1.00 | 0.00 | R |
| glycerol degradation I | 0.00 | 1.00 | 0.00 | R |
| glycerophosphodiester degradation | 0.00 | 1.00 | 0.00 | R |
| glycine biosynthesis I | 0.00 | 1.00 | 0.00 | R |
| glycine cleavage | 0.00 | 1.00 | 0.00 | R |
| glycogen biosynthesis I (from ADP-D-Glucose) | 0.00 | 1.00 | 0.00 | R |
| glycolysis I (from glucose 6-phosphate) | 0.00 | 1.00 | 0.00 | R |
| glycolysis III (from glucose) | 0.00 | 1.00 | 0.00 | R |
| gondoate biosynthesis (anaerobic) | 0.00 | 1.00 | 0.00 | R |
| guanine and guanosine salvage | 0.00 | 1.00 | 0.00 | R |
| guanosine deoxyribonucleotides de novo biosynthesis I | 0.00 | 1.00 | 0.00 | R |
| guanosine deoxyribonucleotides de novo biosynthesis II | 0.00 | 1.00 | 0.00 | R |
| guanosine nucleotides degradation III | 0.00 | 1.00 | 0.00 | R |
| guanosine ribonucleotides de novo biosynthesis | 0.00 | 1.00 | 0.00 | R |
| heptaprenyl diphosphate biosynthesis | 0.00 | 1.00 | 0.00 | R |
| histamine biosynthesis | 1.36 | 1.00 | 0.04 | R |
| homolactic fermentation | 0.00 | 1.00 | 0.00 | R |
| hyaluronan degradation | 0.00 | 1.00 | 0.00 | R |
| hydrogen oxidation I (aerobic) | 0.00 | 1.00 | 0.00 | R |
| hydrogen oxidation III (anaerobic, NADP) | 0.00 | 1.00 | 0.00 | R |
| hydrogen to dimethyl sulfoxide electron transfer | 0.00 | 1.00 | 0.00 | R |
| hydrogen to fumarate electron transfer | 0.00 | 1.00 | 0.00 | R |
| hydroxymethylpyrimidine salvage | 0.00 | 1.00 | 0.00 | R |
| hypotaurine degradation | Inf | 1.00 | 1.00 | R |
| incomplete reductive TCA cycle | 0.00 | 1.00 | 0.00 | R |
| inosine-5'-phosphate biosynthesis I | 0.00 | 1.00 | 0.00 | R |
| L-1,2-propanediol degradation | 1.03 | 1.00 | 0.01 | R |
| lactose degradation III | 0.00 | 1.00 | 0.00 | R |
| L-alanine biosynthesis I | 0.00 | 1.00 | 0.00 | R |
| L-alanine biosynthesis II | 0.00 | 1.00 | 0.00 | R |

TABLE 7-continued

Pairwise comparison of MetaCyc pathway class by response.

| Pathway | Estimate$^a$ | p-value | Enrichment Index | Enriched In |
|---|---|---|---|---|
| L-alanine biosynthesis III | 0.00 | 1.00 | 0.00 | R |
| L-alanine degradation IV | 0.00 | 1.00 | 0.00 | R |
| L-arabinose degradation I | 0.00 | 1.00 | 0.00 | R |
| L-arginine biosynthesis II (acetyl cycle) | 0.00 | 1.00 | 0.00 | R |
| L-arginine biosynthesis I (via L-ornithine) | 0.00 | 1.00 | 0.00 | R |
| L-arginine degradation III (arginine decarboxylase/agmatinase pathway) | 0.00 | 1.00 | 0.00 | R |
| L-arginine degradation V (arginine deiminase pathway) | 0.00 | 1.00 | 0.00 | R |
| L-asparagine biosynthesis I | 0.00 | 1.00 | 0.00 | R |
| L-asparagine biosynthesis II | 0.00 | 1.00 | 0.00 | R |
| L-asparagine biosynthesis III (tRNA-dependent) | 0.00 | 1.00 | 0.00 | R |
| L-asparagine degradation I | 0.00 | 1.00 | 0.00 | R |
| L-aspartate biosynthesis | 0.00 | 1.00 | 0.00 | R |
| L-aspartate degradation I | 0.00 | 1.00 | 0.00 | R |
| L-citrulline degradation | 0.00 | 1.00 | 0.00 | R |
| L-cysteine biosynthesis I | 0.00 | 1.00 | 0.00 | R |
| leucine degradation IV | Inf | 1.00 | 1.00 | R |
| L-glutamate biosynthesis I | 0.00 | 1.00 | 0.00 | R |
| L-glutamate biosynthesis II | 0.00 | 1.00 | 0.00 | R |
| L-glutamate biosynthesis III | 0.00 | 1.00 | 0.00 | R |
| L-glutamate degradation I | 0.00 | 1.00 | 0.00 | R |
| L-glutamate degradation II | 0.00 | 1.00 | 0.00 | R |
| L-glutamate degradation IX (via 4-aminobutanoate) | 0.00 | 1.00 | 0.00 | R |
| L-glutamate degradation X | 0.00 | 1.00 | 0.00 | R |
| L-glutamine biosynthesis I | 0.00 | 1.00 | 0.00 | R |
| L-glutamine biosynthesis III | 0.00 | 1.00 | 0.00 | R |
| L-glutamine degradation I | 0.00 | 1.00 | 0.00 | R |
| L-glutamine degradation II | 0.00 | 1.00 | 0.00 | R |
| L-histidine biosynthesis | 0.00 | 1.00 | 0.00 | R |
| L-histidine degradation I | 0.00 | 1.00 | 0.00 | R |
| L-homocysteine biosynthesis | 0.00 | 1.00 | 0.00 | R |
| L-homoserine and L-methionine biosynthesis | 0.00 | 1.00 | 0.00 | R |
| L-homoserine biosynthesis | 0.00 | 1.00 | 0.00 | R |
| L-idonate degradation | 0.00 | 1.00 | 0.00 | R |
| lipid IVA biosynthesis | 0.00 | 1.00 | 0.00 | R |
| lipoate biosynthesis and incorporation I | 0.00 | 1.00 | 0.00 | R |
| lipoate biosynthesis and incorporation II | 0.00 | 1.00 | 0.00 | R |
| lipoate salvage I | 0.00 | 1.00 | 0.00 | R |
| L-isoleucine biosynthesis I (from threonine) | 0.00 | 1.00 | 0.00 | R |
| L-isoleucine degradation I | 0.00 | 1.00 | 0.00 | R |
| L-lactaldehyde degradation (anaerobic) | 0.00 | 1.00 | 0.00 | R |
| L-leucine biosynthesis | 0.00 | 1.00 | 0.00 | R |
| L-leucine degradation I | 1.63 | 1.00 | 0.22 | R |
| L-lysine biosynthesis I | 0.00 | 1.00 | 0.00 | R |
| L-lysine biosynthesis III | 0.00 | 1.00 | 0.00 | R |
| L-lysine biosynthesis VI | 0.00 | 1.00 | 0.00 | R |
| L-lysine fermentation to acetate and butanoate | 0.00 | 1.00 | 0.00 | R |
| L-malate degradation II | 0.00 | 1.00 | 0.00 | R |
| L-methionine biosynthesis I | 0.00 | 1.00 | 0.00 | R |
| L-methionine biosynthesis III | 0.00 | 1.00 | 0.00 | R |
| long-chain fatty acid activation | 0.00 | 1.00 | 0.00 | R |
| L-ornithine biosynthesis I | 0.00 | 1.00 | 0.00 | R |
| L-phenylalanine degradation I (aerobic) | Inf | 1.00 | 1.00 | R |
| L-proline biosynthesis I | 0.00 | 1.00 | 0.00 | R |
| L-proline degradation | 0.00 | 1.00 | 0.00 | R |
| L-rhamnose degradation I | 0.00 | 1.00 | 0.00 | R |
| L-selenocysteine biosynthesis I (bacteria) | 0.00 | 1.00 | 0.00 | R |
| L-serine biosynthesis | 0.00 | 1.00 | 0.00 | R |
| L-serine degradation | 0.00 | 1.00 | 0.00 | R |
| L-threonine biosynthesis | 0.00 | 1.00 | 0.00 | R |
| L-threonine degradation II | 0.00 | 1.00 | 0.00 | R |
| L-threonine degradation IV | 0.00 | 1.00 | 0.00 | R |
| L-tryptophan biosynthesis | 0.00 | 1.00 | 0.00 | R |
| L-tryptophan degradation II (via pyruvate) | 0.00 | 1.00 | 0.00 | R |
| L-tryptophan degradation I (via anthranilate) | Inf | 1.00 | 1.00 | R |
| L-tryptophan degradation to 2-amino-3-carboxymuconate semialdehyde | Inf | 1.00 | 1.00 | R |
| L-tyrosine biosynthesis I | 0.00 | 1.00 | 0.00 | R |
| L-valine biosynthesis | 0.00 | 1.00 | 0.00 | R |
| mannan degradation | 0.00 | 1.00 | 0.00 | R |
| melibiose degradation | 0.00 | 1.00 | 0.00 | R |
| menaquinol-6 biosynthesis | 0.00 | 1.00 | 0.00 | R |
| menaquinol-7 biosynthesis | 0.00 | 1.00 | 0.00 | R |
| menaquinol-8 biosynthesis | 0.00 | 1.00 | 0.00 | R |
| menaquinol-9 biosynthesis | 0.00 | 1.00 | 0.00 | R |
| methylerythritol phosphate pathway I | 0.00 | 1.00 | 0.00 | R |
| methylglyoxal degradation I | 0.00 | 1.00 | 0.00 | R |
| methylphosphonate degradation I | 0.00 | 1.00 | 0.00 | R |

TABLE 7-continued

Pairwise comparison of MetaCyc pathway class by response.

| Pathway | Estimate[a] | p-value | Enrichment Index | Enriched In |
|---|---|---|---|---|
| mevalonate degradation | 1.32 | 1.00 | 0.02 | R |
| mixed acid fermentation | 0.00 | 1.00 | 0.00 | R |
| molybdenum cofactor biosynthesis | 0.00 | 1.00 | 0.00 | R |
| myo-, chiro- and scillo-inositol degradation | 0.00 | 1.00 | 0.00 | R |
| myo-inositol biosynthesis | 0.00 | 1.00 | 0.00 | R |
| myo-inositol degradation I | 0.00 | 1.00 | 0.00 | R |
| N10-formyl-tetrahydrofolate biosynthesis | 0.00 | 1.00 | 0.00 | R |
| N6-L-threonylcarbamoyladenosine37-modified tRNA biosynthesis | 0.00 | 1.00 | 0.00 | R |
| N-acetylglucosamine degradation I | 0.00 | 1.00 | 0.00 | R |
| N-acetylglucosamine degradation II | 1.03 | 1.00 | 0.01 | R |
| N-acetylneuraminate and N-acetylmannosamine degradation I | 0.00 | 1.00 | 0.00 | R |
| NAD biosynthesis from 2-amino-3-carboxymuconate semialdehyde | 0.00 | 1.00 | 0.00 | R |
| NAD biosynthesis II (from tryptophan) | Inf | 1.00 | 1.00 | R |
| NAD biosynthesis III | 1.22 | 1.00 | 0.08 | R |
| NADH repair | 0.00 | 1.00 | 0.00 | R |
| NADH to cytochrome bd oxidase electron transfer I | 0.00 | 1.00 | 0.00 | R |
| NAD phosphorylation and dephosphorylation | 0.00 | 1.00 | 0.00 | R |
| NAD salvage pathway II | 0.00 | 1.00 | 0.00 | R |
| octane oxidation | Inf | 1.00 | 1.00 | R |
| octaprenyl diphosphate biosynthesis | 0.00 | 1.00 | 0.00 | R |
| oleate beta-oxidation | 0.00 | 1.00 | 0.00 | R |
| oxidized GTP and dGTP detoxification | 0.00 | 1.00 | 0.00 | R |
| palmitate biosynthesis II (bacteria and plants) | 0.00 | 1.00 | 0.00 | R |
| palmitoleate biosynthesis I (from (5Z)-dodec-5-enoate) | 0.00 | 1.00 | 0.00 | R |
| pantothenate and coenzyme A biosynthesis I | 0.00 | 1.00 | 0.00 | R |
| partial TCA cycle (obligate autotrophs) | 0.00 | 1.00 | 0.00 | R |
| pentose phosphate pathway | 0.00 | 1.00 | 0.00 | R |
| pentose phosphate pathway (non-oxidative branch) | 0.00 | 1.00 | 0.00 | R |
| pentose phosphate pathway (oxidative branch) | 0.00 | 1.00 | 0.00 | R |
| peptidoglycan biosynthesis I (meso-diaminopimelate containing) | 0.00 | 1.00 | 0.00 | R |
| peptidoglycan maturation (meso-diaminopimelate containing) | 0.00 | 1.00 | 0.00 | R |
| phosphate acquisition | 0.00 | 1.00 | 0.00 | R |
| phosphatidylethanolamine biosynthesis I | 0.00 | 1.00 | 0.00 | R |
| phosphatidylglycerol biosynthesis II (non-plastidic) | 0.00 | 1.00 | 0.00 | R |
| phosphatidylglycerol biosynthesis I (plastidic) | 0.00 | 1.00 | 0.00 | R |
| phospholipases | 0.00 | 1.00 | 0.00 | R |
| phosphopantothenate biosynthesis I | 0.00 | 1.00 | 0.00 | R |
| polyisoprenoid biosynthesis (E. coli) | 0.00 | 1.00 | 0.00 | R |
| ppGpp biosynthesis | 0.00 | 1.00 | 0.00 | R |
| preQ0 biosynthesis | 0.00 | 1.00 | 0.00 | R |
| propanoyl CoA degradation I | 0.00 | 1.00 | 0.00 | R |
| protocatechuate degradation II (ortho-cleavage pathway) | 0.00 | 1.00 | 0.00 | R |
| PRPP biosynthesis I | 0.00 | 1.00 | 0.00 | R |
| purine deoxyribonucleosides degradation I | 0.00 | 1.00 | 0.00 | R |
| purine ribonucleosides degradation | 0.00 | 1.00 | 0.00 | R |
| putrescine biosynthesis I | 0.00 | 1.00 | 0.00 | R |
| putrescine biosynthesis III | 0.00 | 1.00 | 0.00 | R |
| pyridoxal 5'-phosphate biosynthesis II | 0.00 | 1.00 | 0.00 | R |
| pyridoxal 5'-phosphate salvage I | 0.00 | 1.00 | 0.00 | R |
| pyrimidine deoxyribonucleosides degradation | 0.00 | 1.00 | 0.00 | R |
| pyrimidine deoxyribonucleosides salvage | 0.00 | 1.00 | 0.00 | R |
| pyrimidine deoxyribonucleotide phosphorylation | 0.00 | 1.00 | 0.00 | R |
| pyrimidine deoxyribonucleotides de novo biosynthesis I | 0.00 | 1.00 | 0.00 | R |
| pyrimidine deoxyribonucleotides de novo biosynthesis II | 0.00 | 1.00 | 0.00 | R |
| pyrimidine nucleobases salvage I | 0.00 | 1.00 | 0.00 | R |
| pyrimidine ribonucleosides degradation | 0.00 | 1.00 | 0.00 | R |
| pyrimidine ribonucleosides salvage I | 0.00 | 1.00 | 0.00 | R |
| pyruvate fermentation to acetate and lactate II | 0.00 | 1.00 | 0.00 | R |
| pyruvate fermentation to acetate I | 0.00 | 1.00 | 0.00 | R |
| pyruvate fermentation to acetate IV | 0.00 | 1.00 | 0.00 | R |
| pyruvate fermentation to ethanol I | 0.00 | 1.00 | 0.00 | R |
| pyruvate fermentation to ethanol III | 0.00 | 1.00 | 0.00 | R |
| pyruvate fermentation to lactate | 0.00 | 1.00 | 0.00 | R |
| pyruvate to cytochrome bd terminal oxidase electron transfer | 0.00 | 1.00 | 0.00 | R |
| queuosine biosynthesis | 0.00 | 1.00 | 0.00 | R |
| reactive oxygen species degradation | 0.00 | 1.00 | 0.00 | R |
| reductive acetyl coenzyme A pathway I (homoacetogenic bacteria) | 0.00 | 1.00 | 0.00 | R |
| reductive monocarboxylic acid cycle | 0.00 | 1.00 | 0.00 | R |
| rhamnogalacturonan type I degradation II (bacteria) | 0.00 | 1.00 | 0.00 | R |
| Rubisco shunt | Inf | 1.00 | 1.00 | R |
| S-adenosyl-L-methionine biosynthesis | 0.00 | 1.00 | 0.00 | R |
| S-adenosyl-L-methionine cycle I | 0.00 | 1.00 | 0.00 | R |
| S-adenosyl-L-methionine cycle II | 0.00 | 1.00 | 0.00 | R |
| salicylate degradation II | Inf | 1.00 | 1.00 | R |
| selenate reduction | 0.00 | 1.00 | 0.00 | R |
| siroheme biosynthesis | 0.00 | 1.00 | 0.00 | R |

TABLE 7-continued

Pairwise comparison of MetaCyc pathway class by response.

| Pathway | Estimate[a] | p-value | Enrichment Index | Enriched In |
|---|---|---|---|---|
| S-methyl-5′-thioadenosine degradation III | 1.06 | 1.00 | 0.02 | R |
| spermidine biosynthesis I | 0.00 | 1.00 | 0.00 | R |
| stearate biosynthesis II (bacteria and plants) | 0.00 | 1.00 | 0.00 | R |
| succinate to cytochrome bd oxidase electron transfer | 0.00 | 1.00 | 0.00 | R |
| sucrose degradation III (sucrose invertase) | 0.00 | 1.00 | 0.00 | R |
| sucrose degradation IV (sucrose phosphorylase) | 0.00 | 1.00 | 0.00 | R |
| sulfate activation for sulfonation | 0.00 | 1.00 | 0.00 | R |
| sulfate reduction IV (dissimilatory) | Inf | 1.00 | 1.00 | R |
| sulfoacetaldehyde degradation I | Inf | 1.00 | 1.00 | R |
| sulfolactate degradation III | Inf | 1.00 | 1.00 | R |
| superoxide radicals degradation | 0.00 | 1.00 | 0.00 | R |
| superpathway of acetate utilization and formation | 0.00 | 1.00 | 0.00 | R |
| superpathway of adenosine nucleotides de novo biosynthesis I | 0.00 | 1.00 | 0.00 | R |
| superpathway of adenosine nucleotides de novo biosynthesis II | 0.00 | 1.00 | 0.00 | R |
| superpathway of beta-D-glucuronide and D-glucuronate degradation | 0.00 | 1.00 | 0.00 | R |
| superpathway of branched chain amino acid biosynthesis | 0.00 | 1.00 | 0.00 | R |
| superpathway of demethylmenaquinol-8 biosynthesis | 0.00 | 1.00 | 0.00 | R |
| superpathway of geranylgeranyl diphosphate biosynthesis II (via MEP) | 0.00 | 1.00 | 0.00 | R |
| superpathway of glucose and xylose degradation | 0.00 | 1.00 | 0.00 | R |
| superpathway of guanosine nucleotides de novo biosynthesis I | 0.00 | 1.00 | 0.00 | R |
| superpathway of guanosine nucleotides de novo biosynthesis II | 0.00 | 1.00 | 0.00 | R |
| superpathway of L-alanine biosynthesis | 0.00 | 1.00 | 0.00 | R |
| superpathway of L-asparagine biosynthesis | 0.00 | 1.00 | 0.00 | R |
| superpathway of L-aspartate and L-asparagine biosynthesis | 0.00 | 1.00 | 0.00 | R |
| superpathway of L-isoleucine biosynthesis I | 0.00 | 1.00 | 0.00 | R |
| superpathway of L-lysine, L-threonine and L-methionine biosynthesis I | 0.00 | 1.00 | 0.00 | R |
| superpathway of L-methionine biosynthesis (by sulfhydrylation) | 0.00 | 1.00 | 0.00 | R |
| superpathway of L-methionine biosynthesis (transsulfuration) | 0.00 | 1.00 | 0.00 | R |
| superpathway of L-serine and glycine biosynthesis I | 0.00 | 1.00 | 0.00 | R |
| superpathway of L-threonine biosynthesis | 0.00 | 1.00 | 0.00 | R |
| superpathway of menaquinol-7 biosynthesis | 0.00 | 1.00 | 0.00 | R |
| superpathway of menaquinol-8 biosynthesis I | 0.00 | 1.00 | 0.00 | R |
| superpathway of N-acetylglucosamine, N-acetylmannosamine and N-acetylneuraminate degradation | 0.00 | 1.00 | 0.00 | R |
| superpathway of purine deoxyribonucleosides degradation | 0.00 | 1.00 | 0.00 | R |
| superpathway of pyrimidine deoxyribonucleoside salvage | 0.00 | 1.00 | 0.00 | R |
| superpathway of pyrimidine deoxyribonucleosides degradation | 0.00 | 1.00 | 0.00 | R |
| superpathway of pyrimidine deoxyribonucleotides de novo biosynthesis | 0.00 | 1.00 | 0.00 | R |
| superpathway of pyrimidine deoxyribonucleotides de novo biosynthesis (*E. coli*) | 0.00 | 1.00 | 0.00 | R |
| superpathway of pyrimidine nucleobases salvage | 0.00 | 1.00 | 0.00 | R |
| superpathway of pyrimidine ribonucleotides de novo biosynthesis | 0.00 | 1.00 | 0.00 | R |
| superpathway of sulfate assimilation and cysteine biosynthesis | 0.00 | 1.00 | 0.00 | R |
| superpathway of tetrahydrofolate biosynthesis | 0.00 | 1.00 | 0.00 | R |
| superpathway of thiamine diphosphate biosynthesis I | 0.00 | 1.00 | 0.00 | R |
| superpathway of UDP-glucose-derived O-antigen building blocks biosynthesis | 0.00 | 1.00 | 0.00 | R |
| taurine degradation I | Inf | 1.00 | 1.00 | R |
| taurine degradation III | 1.32 | 1.00 | 0.02 | R |
| TCA cycle VIII (helicobacter) | 1.36 | 1.00 | 0.04 | R |
| tetrahydrofolate biosynthesis | 0.00 | 1.00 | 0.00 | R |
| tetrahydrofolate salvage from 5,10-methenyltetrahydrofolate | 0.00 | 1.00 | 0.00 | R |
| tetrapyrrole biosynthesis I (from glutamate) | 0.00 | 1.00 | 0.00 | R |
| thiamine diphosphate biosynthesis I (*E. coli*) | 0.00 | 1.00 | 0.00 | R |
| thiamine diphosphate biosynthesis II (*Bacillus*) | 0.00 | 1.00 | 0.00 | R |
| thiamine salvage II | 0.00 | 1.00 | 0.00 | R |
| thiamine salvage III | 0.00 | 1.00 | 0.00 | R |
| thiamine salvage IV (yeast) | 0.00 | 1.00 | 0.00 | R |
| thiazole biosynthesis I (facultative anaerobic bacteria) | 0.00 | 1.00 | 0.00 | R |
| thioredoxin pathway | 0.00 | 1.00 | 0.00 | R |
| thiosulfate disproportionation III (rhodanese) | 1.29 | 1.00 | 0.01 | R |
| thymine degradation | 0.00 | 1.00 | 0.00 | R |
| trans, trans-farnesyl diphosphate biosynthesis | 0.00 | 1.00 | 0.00 | R |
| trehalose biosynthesis I | 0.00 | 1.00 | 0.00 | R |
| triacylglycerol degradation | 1.22 | 1.00 | 0.08 | R |
| tRNA charging | 0.00 | 1.00 | 0.00 | R |
| tRNA processing | 0.00 | 1.00 | 0.00 | R |
| UDP-alpha-D-glucuronate biosynthesis (from UDP-glucose) | 0.00 | 1.00 | 0.00 | R |
| UDP-D-galactose biosynthesis | 0.00 | 1.00 | 0.00 | R |
| UDP-D-galacturonate biosynthesis I (from UDP-D-glucuronate) | 0.00 | 1.00 | 0.00 | R |
| UDP-galactofuranose biosynthesis | 0.00 | 1.00 | 0.00 | R |
| UDP-glucose biosynthesis | 0.00 | 1.00 | 0.00 | R |
| UDP-N-acetyl-alpha-D-galactosaminuronate biosynthesis | Inf | 1.00 | 1.00 | R |
| UDP-N-acetyl-alpha-D-mannosaminouronate biosynthesis | 0.00 | 1.00 | 0.00 | R |
| UDP-N-acetyl-D-glucosamine biosynthesis I | 0.00 | 1.00 | 0.00 | R |
| UDP-N-acetylmuramoyl-pentapeptide biosynthesis II (lysine-containing) | 1.32 | 1.00 | 0.02 | R |

TABLE 7-continued

Pairwise comparison of MetaCyc pathway class by response.

| Pathway | Estimate[a] | p-value | Enrichment Index | Enriched In |
|---|---|---|---|---|
| UDP-N-acetylmuramoyl-pentapeptide biosynthesis I (meso-diaminopimelate containing) | 0.00 | 1.00 | 0.00 | R |
| UMP biosynthesis | 0.00 | 1.00 | 0.00 | R |
| uracil degradation III | 1.63 | 1.00 | 0.22 | R |
| urea cycle | 0.00 | 1.00 | 0.00 | R |
| urea degradation II | 0.00 | 1.00 | 0.00 | R |
| UTP and CTP de novo biosynthesis | 0.00 | 1.00 | 0.00 | R |
| UTP and CTP dephosphorylation I | 0.00 | 1.00 | 0.00 | R |
| xanthine and xanthosine salvage | 0.00 | 1.00 | 0.00 | R |
| xylose degradation I | 0.00 | 1.00 | 0.00 | R |

[a]Estimates apply to a subset of 25 patients who had Metagenomic WGS data available

TABLE 8

Individual values and summary statistics of metabolic reconstructions.

| Sample | Genes | Genes of known or predicted molecular function | Pathways | Metabolic Reactions | Transport Reactions | Compounds |
|---|---|---|---|---|---|---|
| 1 | 36475 | 23417 | 451 | 2016 | 276 | 1669 |
| 2 | 36914 | 23811 | 459 | 2089 | 281 | 1751 |
| 3 | 44948 | 28820 | 498 | 2312 | 323 | 1895 |
| 4 | 31710 | 20446 | 397 | 1861 | 234 | 1583 |
| 5 | 25541 | 15702 | 500 | 2272 | 339 | 1877 |
| 6 | 41761 | 26459 | 507 | 2372 | 324 | 1943 |
| 7 | 27071 | 17620 | 404 | 1851 | 245 | 1559 |
| 8 | 29091 | 18566 | 481 | 2163 | 328 | 1793 |
| 9 | 27740 | 17946 | 486 | 2255 | 328 | 1854 |
| 10 | 44204 | 27899 | 523 | 2471 | 344 | 2009 |
| 11 | 26897 | 17433 | 400 | 1814 | 240 | 1547 |
| 12 | 22879 | 14385 | 490 | 2248 | 334 | 1857 |
| 13 | 37311 | 24090 | 435 | 2017 | 274 | 1708 |
| 14 | 35781 | 22589 | 444 | 2094 | 287 | 1770 |
| 15 | 23732 | 15066 | 491 | 2253 | 331 | 1886 |
| 16 | 19793 | 12789 | 395 | 1899 | 240 | 1619 |
| 17 | 23184 | 14702 | 436 | 2020 | 276 | 1695 |
| 18 | 31203 | 19760 | 517 | 2329 | 354 | 1919 |
| 19 | 24237 | 15593 | 458 | 2117 | 311 | 1785 |
| 20 | 35021 | 22007 | 498 | 2251 | 336 | 1853 |
| 21 | 32373 | 21032 | 492 | 2218 | 314 | 1825 |
| 22 | 30518 | 19678 | 463 | 2114 | 277 | 1792 |
| 23 | 29535 | 19148 | 467 | 2165 | 316 | 1793 |
| 24 | 24410 | 15301 | 506 | 2305 | 349 | 1894 |
| 25 | 38701 | 24639 | 515 | 2325 | 358 | 1928 |
| 26 | 28840 | 18767 | 399 | 1879 | 245 | 1601 |
| 27 | 26919 | 17486 | 439 | 2012 | 306 | 1684 |
| 28 | 28250 | 18066 | 449 | 2004 | 282 | 1715 |
| Mean | 30894 | 19758 | 464 | 2133 | 302 | 1779 |

Example 2—Materials and Methods

Patient Cohort:

An initial cohort of 112 patients with metastatic melanoma were included in this study. These patients were treated with anti-PD1 immune checkpoint blockade therapy at The University of Texas (UT) MD Anderson Cancer Center between April 2015 and March 2016 and signed voluntary informed consent for collection and analysis of tumor, blood and microbiome samples under Institutional Review Board (IRB)-approved protocols. Patients who were diagnosed with uveal melanoma (n=10), or who got anti-PD1 in combination with targeted agents or with adoptive T-cell transfer therapy (n=8), or in whom response could not be determined (n=6) were excluded from this analysis. Electronic medical charts were reviewed independently by three investigators to assign clinical response group and document other clinical parameters (Table 3). The primary outcome of clinical response (responder) (R) was defined by radiographic evidence of complete response (CR), partial response (PR) or stable disease (SD) per RECIST 1.1 criteria for at least 6 months. Lack of a clinical response (non responder) (NR) was defined by disease progression (PD) on serial CT scans or a clinical benefit lasting less than 6 months (minimal benefit).

Microbiome Sample Collection:

Bucccal samples were collected during routine pre-treatment clinic visits using the Catch-All Sample Collection Swab (Epicentre, Madison, Wis.). All patients were also given outpatient OMNIgene GUT kit (OMR-200) (DNA Genotek fecal sample collection kits and asked to return). Importantly, this kit helps maintain microbiome profile stability at room temperature for up to 60 days. All samples were frozen at −80 degree C. before DNA extraction and analysis.

The final cohort consisted of buccal samples collected from 87 patients, of whom 52 were R and 34 were NR, and fecal samples collected from 43 patients (of whom 30 were R and 13 were NR. All but 2 buccal and 2 fecal samples were collected at baseline. These were included as a baseline surrogate as a subset analysis on longitudinal samples which showed no change after treatment intervention in this cohort.

Tumor and Blood Sample Collection:

Available tumor samples (n=23) at matched pre-treatment time points were obtained from the MD Anderson Cancer Center Department of Pathology archive and Institutional Tissue Bank. After samples underwent quality control checks for percent tumor viability by an MD Anderson pathologist, the inventors included 17 samples from R and 6 from NR. Blood samples collected and stored for research (protocols previously listed) at baseline (n=11) were also queried for study inclusion yielding samples from 8R and 3 NR.

DNA Extraction and Bacterial 16S Sequencing:

Preparation and sequencing was done in collaboration with the Center for Metagenomics and Microbiome Research (CMMR) at The Baylor College of Medicine. 16S rRNA gene sequencing methods were adapted from the methods developed for the NIH-Human Microbiome Project (A framework for human microbiome research, 2012).

Briefly, bacterial genomic DNA was extracted using MO BIO PowerSoil DNA Isolation Kit (MO BIO Laboratories, USA). The 16S rDNA V4 region was amplified by PCR and sequenced in the MiSeq platform (Illumina, Inc, San Diego, Calif.) using the 2×250 bp paired-end protocol yielding pair-end reads that overlap almost completely. The primers used for amplification contain adapters for MiSeq sequencing and single-end barcodes allowing pooling and direct sequencing of PCR products (Caporaso et al., 2012).

Quality filtered sequences with >97% identity were clustered into bins known as Operational Taxonomic Units (OTUs), using open-reference OTU picking (Edgar, 2010; Rognes et al., 2016; Caporaso et al., 2010), and classified at the species level against the NCBI 16S ribosomal RNA 16S sequence database using ncbi-blast+ package 2.5.0. Phylogenetic classification was obtained from the NCBI taxonomy database. The relative abundance of each OTU was determined for all samples. Taxonomic classification was validated using the Greengenes, SILVA and RDP databases.

A phylogenetic tree was empirically constructed using the FastTree algorithm (Price et al., 2010) in the QIIME software package, as described previously (Peled et al., 2016). Briefly, all nodes of the tree were considered as clusters of related OTU (crOTU), where the abundance of each crOTU was the sum of abundances of its member OTUs. The trees were constructed from a sequence alignment of all observed OTU's within both oral 1152 (97.5%% of 1182 OTUs) and gut 1434 (98.6% of 1455 OTUs) microbiomes. The resultant oral and gut microbiome crOTU trees contained 1152 and 1434 nodes respectively.

Taxonomical alpha-diversity was estimated using the Inverse Simpson Index. Rarefaction limits were set based on the least number of reads in all oral (13000) and fecal samples (8000) that were analyzed, where $D=1/\Sigma_{k=1}^{S} pi^2$, where pi is the proportion of the total species S that is comprised by the species i. Since, it captures variance of the taxonomical abundance distribution, it is often considered to be among the most meaningful and robust diversity metrics (Shannon et al., 2013).

Bipartite Network to Compare and Contrast the Oral and Gut Microbiota:

The biparitie network was constructed using make_biparitite_network.py script in QIIME using default parameters (Caporaso et al., 2010) and then visualized in Cytoscape using edge-weighted spring-embedded layout. 2 networks were generated, using all buccal and fecal samples (FIG. 6) and using only paired samples (FIG. 1A), when both samples were obtained from the same patients.

Enrichment Index to Visualize Differences in Oral and Gut Microbiome Between R and NR:

OTU Representation Index (ri):

is used to quantify the representation of each species in R; (riR), and NR (riNR), as the proportion of samples within each group that had non-zero abundance for a particular species. The values of ri ranged from 0 (OTU not found in any sample within a group) to 1 (OTU found in all samples within a group).

OTU Enrichment Index (ei):

was used to quantify and compare the enrichment of each OTU in R vs NR, where ei=(riR−riNR)/(riR+riNR). This index has values ranging from −1 and +1. When a species is identified in all R samples but not in any NR samples, ei=+1. The contrary is true for ei=−1.

The distribution ei scores was used to classify all species into 3 sets, Set 1-differentially enriched in R, Set 2—found in both groups, and Set 3-differentially enriched in NR. Within each set, all OTU's were sorted by abundance and then visualized as a heatmap of log(10)-transformed OTU abundances in all sample given as columns. Thresholds for the OTU abundances (low, medium and high) were derived from the distribution of the abundances for all OTUs.

Figure 2A:
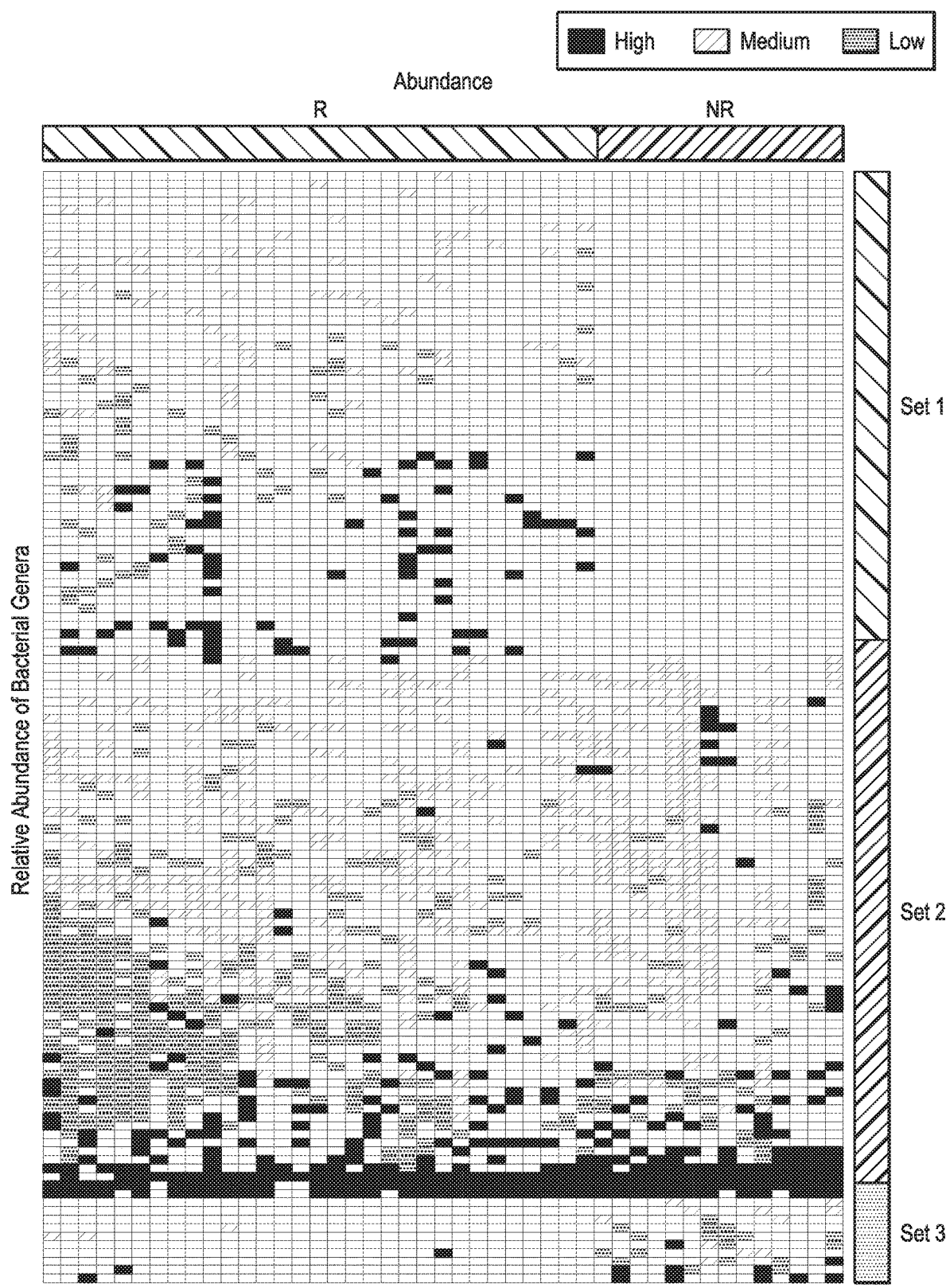
Figure 2B:
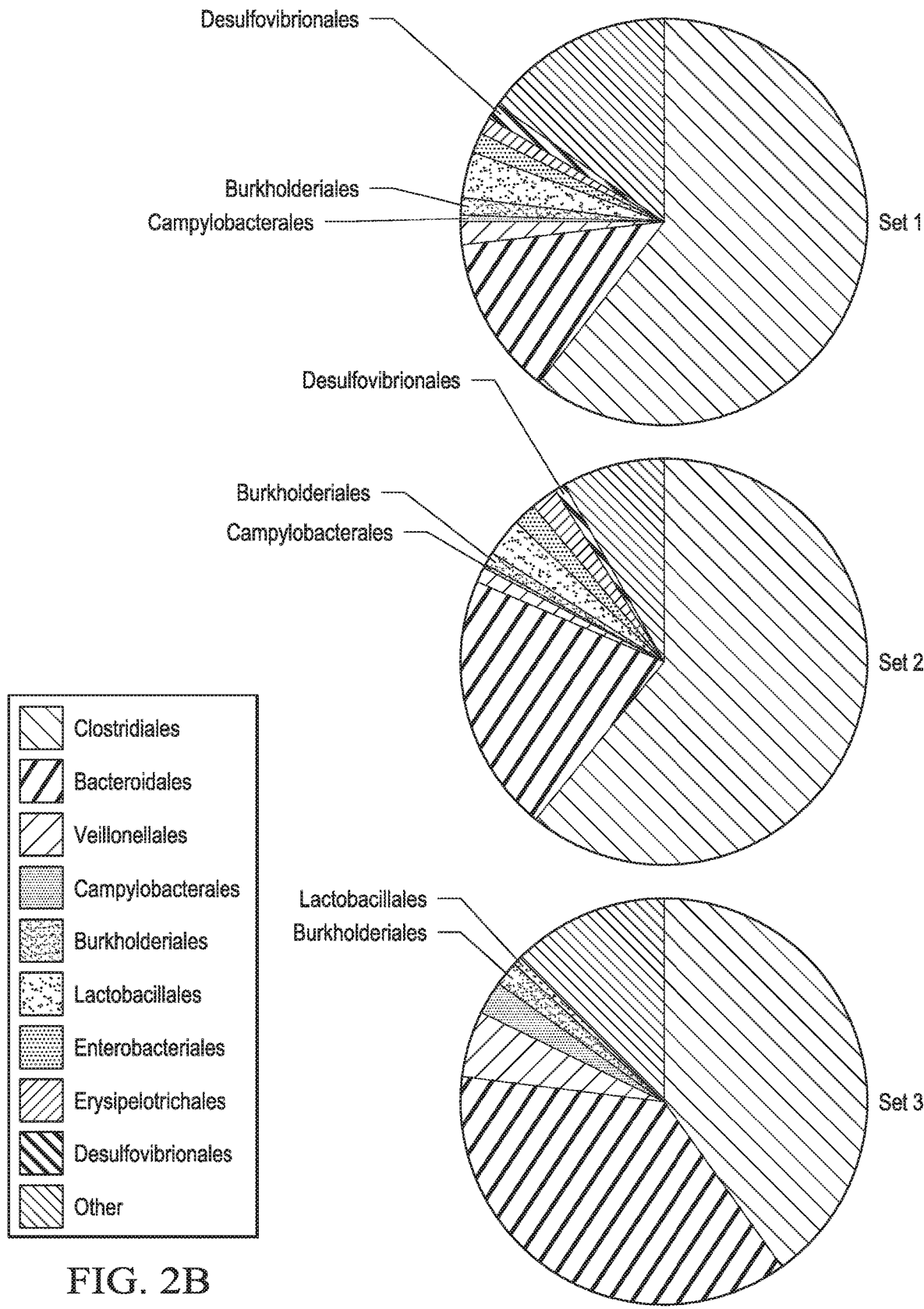
Figure 2C:
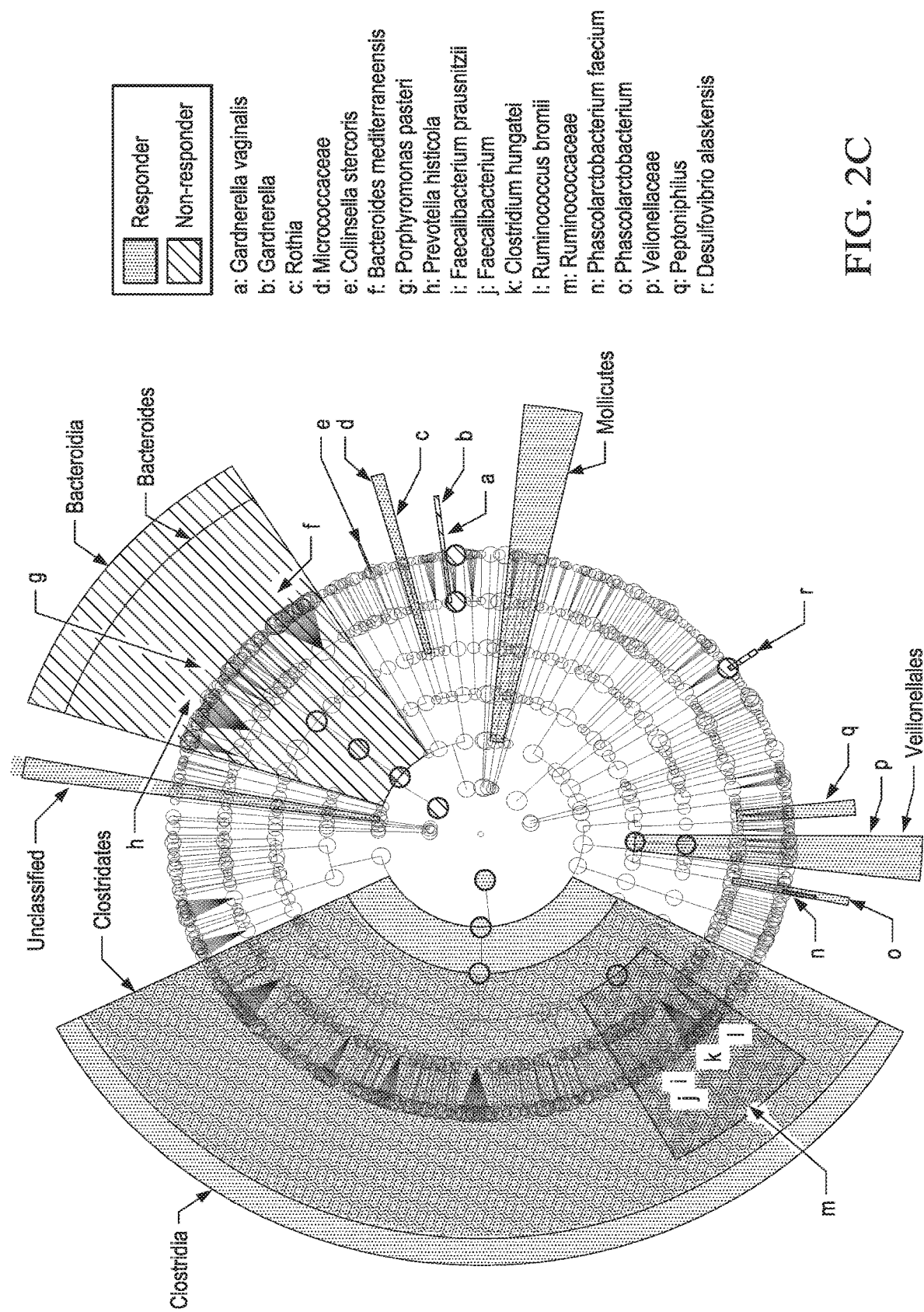
Figure 2D:
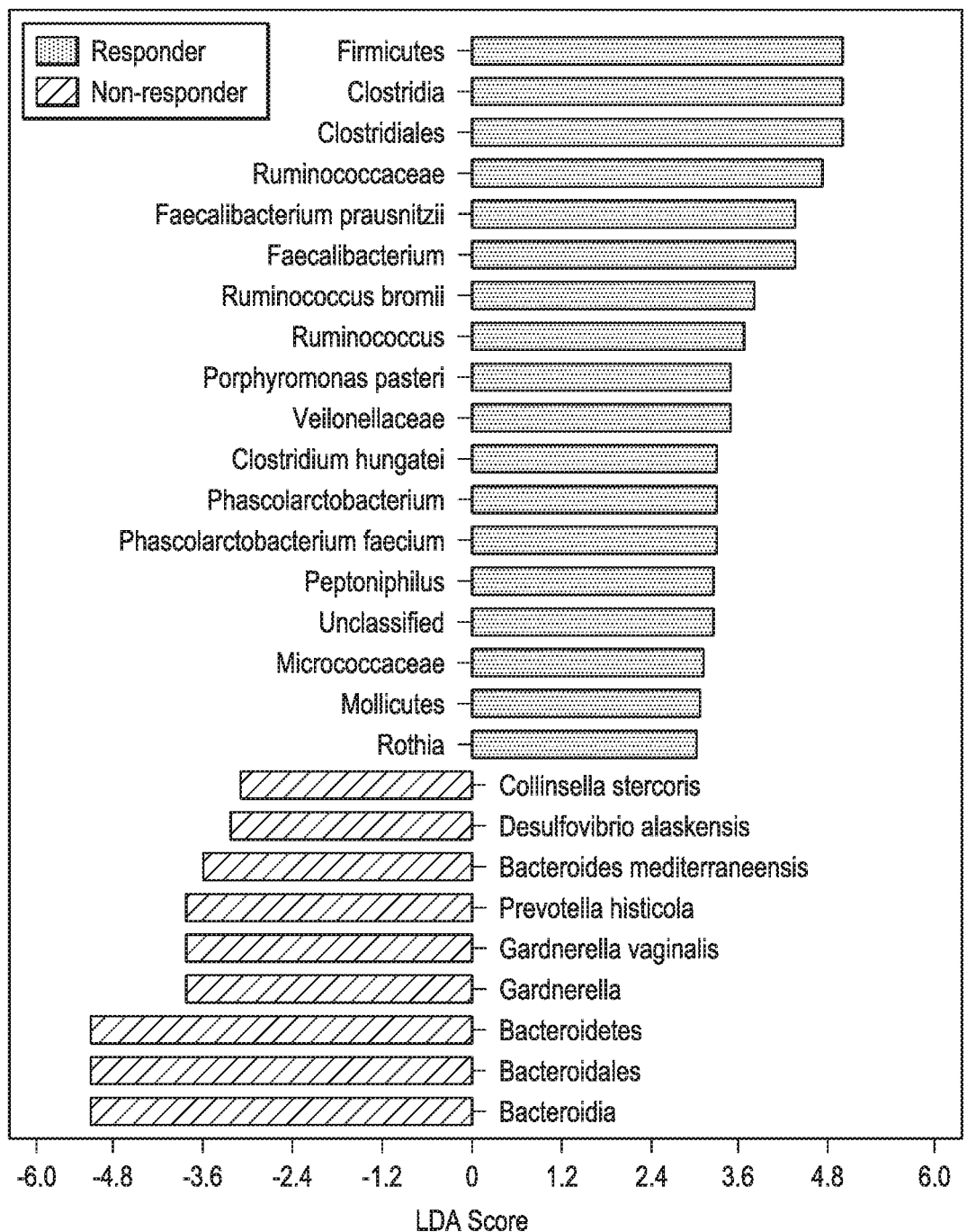
Figure 2E:
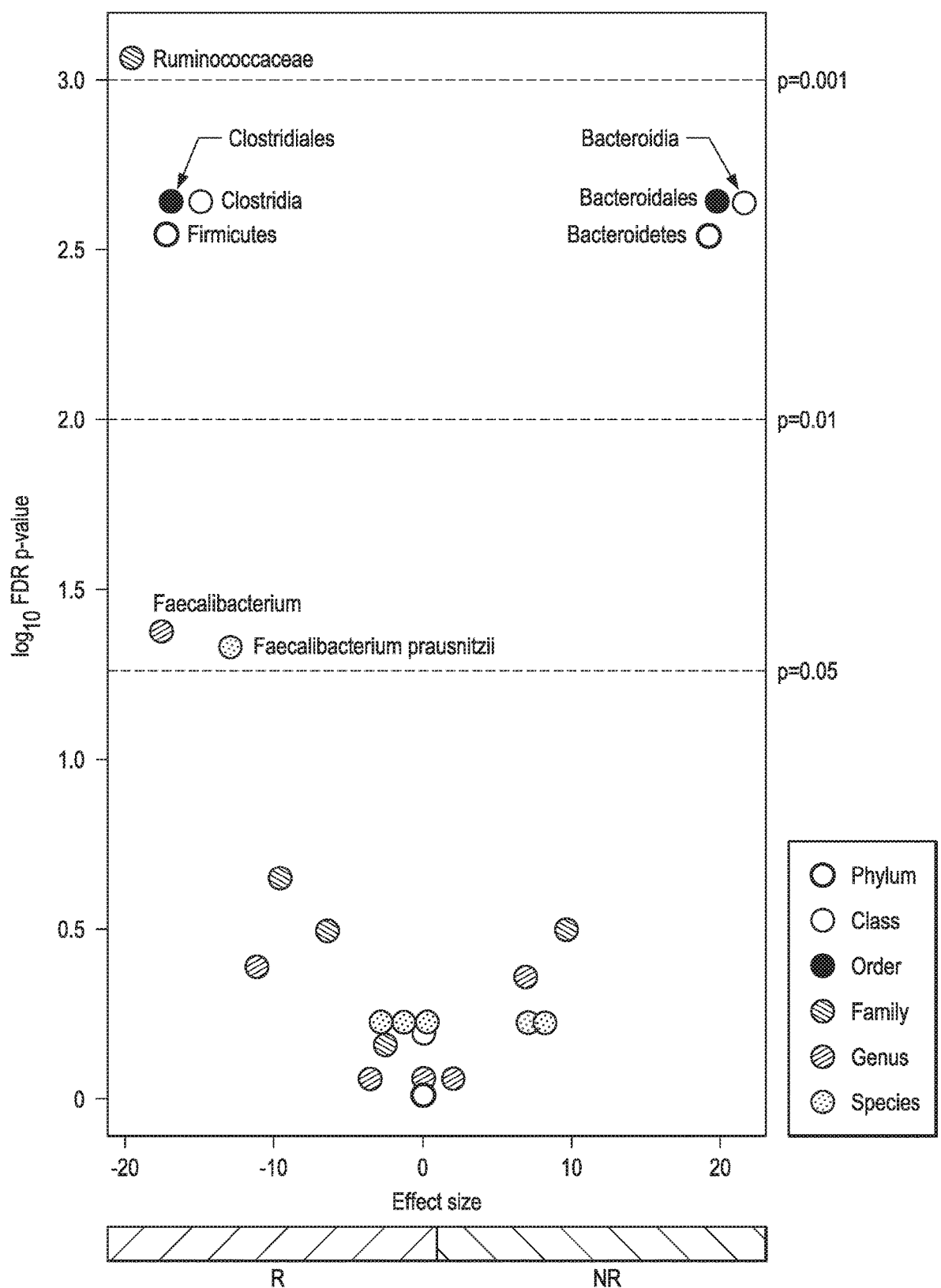
Figure 2F:
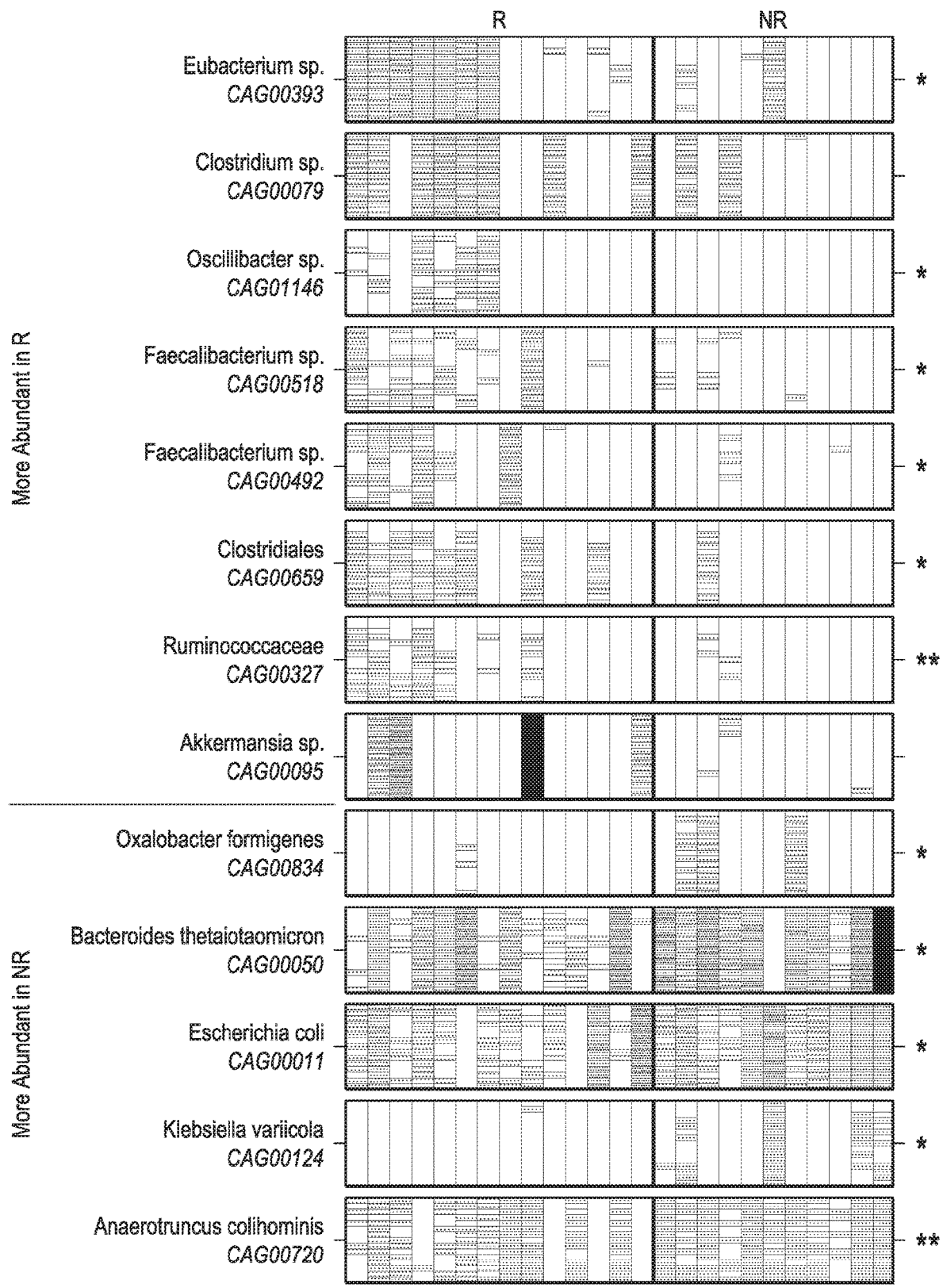

Statistical Assessment of Biomarkers Using LEfSe:

The LEfSe method of analysis first compares abundances of all bacterial clades between R and NR in the oral and gut microbiomes, using the Kruskal-Wallis test at a pre-defined a of 0.05, Significantly different vectors resulting from the comparison of abundances (e.g., *Faecalibacterium* relative abundance) between groups are used as input to linear discriminant analysis (LDA), which produces an effect size (FIG. 2B). The primary advantage of LEfSe over traditional statistical tests is that an effect size is produced in addition to a p-value. This allows sorting of results of multiple tests by the magnitude of the difference between groups. In the case of hierarchically organized bacterial clades, there may be a lack of correlation between p values and effect sizes due to differences in the number of hypotheses considered at different levels since a greater number of comparisons would need to be made at the genus and species levels when compared to the phylum and class levels.

Metagenomic Whole Genome Shotgun (WGS) Sequencing:

This was also done in collaboration with CMMR and Metagenopolis (MGP). Briefly, metagenomic sequencing data provides species-level resolution of the bacteria, and the near-complete genomic content of the collection of microbes in a particular sample, also referred to as the pangenome (depth of sequencing directly relates to the amount of the pangenome that is covered in a particular dataset).

Whole Genome Shotgun (WGS) sequencing utilizes the same extracted bacterial genomic DNA used for 16S rRNA gene compositional analysis. However, WGS sequencing achieves a higher depth of sequencing by employing a more powerful sequencing platform. Individual libraries were constructed from each sample and loaded into the HiSeq platform (Illumina) and sequenced using the 2×100 bp pair-end read protocol. The process of quality filtering, trimming, and demultiplexing was carried out by in-house pipeline developed by assembling publicly available tools such as Casava v1.8.3 (Illumina) for the generation of fastqs, Trim Galore and cutadapt for adapter and quality trimming, and PRINSEQ for sample demultiplexing.

Gut microbiota analysis was performed using the quantitative metagenomics pipeline developed at MGP. This approach allow the analysis of the microbiota at the gene and species level. High quality reads were selected and cleaned to eliminate possible contaminants as human reads. These were mapped and counted using the MetaHIT hs_9.9M genes catalogue (Li et al., 2014) using the METEOR Studio in house pipeline using a two steps procedure: first using uniquely mapping reads, then attributing shared reads (mapping different genes from the catalogue) according to their mapping ratio using unique reads. Mapping was performed using a >95% identity threshold to account gene variability and the no redundant nature of the catalogue.

After a downsizing step at 14M reads (to correct for the different sequencing depth) and normalization (RPKM), a gene frequency profile matrix was obtained which was used as the reference to perform the analyses using MetaOMineR, a suite of R packages developed at MGP and dedicated to the analysis of large quantitative metagenomics datasets.

The hs_9.9M gene catalogue has been clustered into 1438 MGS (MetaGenomic Species, groups of >500 genes that co-vary in abundance among hundreds samples and thus belong to the same microbial species (Nielson et al., 2014). The taxonomical annotation of the MGS was performed using the homology of its genes with previously sequenced organisms (using blastN against nt and wgs databanks). MGS signal among samples was calculated as the mean or median signal of 50 marker genes. A MGS frequency profile matrix was constructed using the MGS mean signals and after normalization (sum of the MGS frequency of a sample=1).

Reads whose genomic coordinates overlap with known KEGG orthologs were tabulated, and KEGG modules were calculated step-wise and determined to be complete if 65% of the reaction steps were present per detected species and for the metagenome. Pathways were constructed for each taxa and metagenome by calculating the minimum set through MinPath resulting from the gene orthologs present.

Pathway Metagenome Databases (PGDB):

Databases were generated for each WGS sample using the PathoLogic program from the Pathway Tools software [PMID:26454094]. Inputs for the program were produced using predicted gene functions based on KEGG orthology and their taxonomy assignment in the metagenomes Thus, if the same function (KO group) had several taxonomic annotations, each of the annotations was considered as a separate gene. The definition of the KO group in KEGG was used as the gene function and the first name of the KO group, if available, was used as the gene name. EC numbers were assigned to the gene according to annotations of the KO group by the numbers in KEGG. The metabolic reconstructions were made in the automatic mode as described in the Pathway Tools manual with the option –tip to automatically predict transport reactions. The DOMAIN value 'TAX-2 (Bacteria)' was used as the organism class for the PGDB and the CODON-TABLE value to be equal 1. The generated PGDB were summarized and compared using Pathway Tools. The generated PGDBs are available upon request.

Statistical Analyses:

Alpha-diversity was compared between R and NR using the Wilcoxon rank-sum or Mann-Whitney (MW) test. All patients were classified into high, intermediate or low diversity groups based on tertiles of the distribution. Pairwise comparisons of taxonomic abundances by both response and cluster were conducted using the MW test. Within each level (phylum, class, order, family, genus and species), the low abundance (<0.1%) and low variance taxa (<0.001) were excluded. Adjustments for multiple comparisons were done using the false-discovery rate method at an alpha level of 0.05. An effect size was estimated for each taxon as $U/\sqrt{n}$, where U is test statistic for the MW test, and n is the total sample size (n=43) (Fritz et al., 2012), and volcano plots were generated for log 10(FDR-adjusted p values) on the y-axis and median-adjusted effect sizes on the x-axis. In addition, patients were also classified as having high or low abundance of *Faecalibacterium prausnitzii* or Bacteroidales based on the median abundance of these taxa in the gut microbiome. Kaplan-Meier estimates were estimated for each group and compared using the log-rank test. Hazard ratios were estimated using the Cox-proportional hazard model.

In general the MW test was used for comparisons between binary outcome variables (R vs NR), and the Spearman correlation test was used to compare continuous variables. Additionally, the Fishers exact test was used when proportions were compared between binary variables. Hypothesis testing was done using both one-sided and two-sided tests as appropriate at a 95% significance level. All analyses were conducted in R and GraphPad Prism (La Jolla, Calif.).

Immunohistochemistry:

Briefly, sections (4 μm thickness) were prepared from formalin fixed paraffin embedded (FFPE) tissues. The presence of tumor was confirmed by a pathologist on hematoxylin & eosin-stained slides (H&E). Slides were then stained using a Leica Bond RX automated slide stainer (Leica Biosystems, Buffalo Grove, Ill.) for CD3 (n=17) (DAKO, Santa Clara, Calif., 1:100), CD8 (n=21) (Thermo Scientific, Waltham, Mass., 1:100), PD-1 (n=16) (Abcam, Cambridge, UK, 1:250), PD-L1 (n=15) (1:100, Cell Signaling, Danvers, Mass.), GzmB (n=17), RORγT (n=14) (1:800, EMD Millipore, Billerica, Mass.), FoxP3 (n=16) (1:50, BioLegend, San Diego, Calif.) and counter-stained with hematoxylin. Stained slides were then scanned using an automated Aperio Slide Scanner (Leica), and the density of the immune infiltrate was quantified in tumor regions using a modified version of the default "Nuclear v9" algorithm and expressed as positive counts/mm2 for CD3, CD8, PD-1, FoxP3, and RORγT and as an H-score for PD-L1 which takes into account a percentage of positive cells multiplied by their intensity on a scale of 1 to 3 for a score between 1-300.

Flow cytometry was performed on peripheral blood mononuclear cells (PBMC). PBMCs were stained with CD3 (UCHT1, BioLegend), CD4 (SK3, eBioscience, Thermo Scientific), CD8 (RPAT8, BD Biosciences, Mississauga, Canada), FoxP3 (PCH101, eBioscience), CD127 (HIL-7R-M21, BD Biosciences), CD19 (HIB-19, BioLegend), CD14 (61D3, eBioscience), HLA-DR (L243, BD Biosciences), CD33 (WM53, BD Biosciences), CD56 (NCAM1, BD Biosciences), and CD11b (ICRF44, BD Biosciences) and acquisition was carried out on a Fortessa Flow Cytometer (BD Biosciences). Analysis was performed with FlowJo version 10 (Tree Star Inc., Ashland, Oreg.). version 10 (Tree Star Inc., Ashland, Oreg.).

Multiplex Immunohistochemistry:

Sequential 12-marker myeloid multiplex immunohistochemistry was performed as described previously (Tsujikawa, *Cell Reports*, 2017). Briefly, FFPE sections underwent sequential staining, scanning and destaining cycles using AEC as chromagen and scanned with an Aperio Slide Scanner (Leica). Following staining and scanning with hematoxylin for nuclei, CD68, Tryptase, CSF1R, DC-SIGN, CD66b, CD83, CD163, HLA-DR, PD-L1, CD3/CD20/CD56, and CD45. CD45-positive regions of all images were then extracted using ImageScope, aligned, overlayed and segmented using CellProfiler and layers pseudocolored for analysis and quantification using FCS Express.

Cytokine Multiplexing:

41 plasma cytokine levels were assessed using multiplex bead assay (Bio-Rad, Hercules, Calif.). Cytokines, chemokines and soluble mediators quantified included IL-1b, IL-1ra, IL-2, IL-4, IL-5, IL-6, IL-7, IL-8, IL-9, IL-10, IL-12(p70), IL-13, IL-15, IL-17, Eotaxin, FGF basic, G-CSF, GM-CSF, IFN-g, IP-10, MIP-1a, PDGF-bb, MIP-1b, RANTES, TNF-α, VEGF, IL-2ra, HGF, TRAIL, IL-17A, IL-17F, IL-23, SDF1/CXCL12, CCL22, MCP-1/CCL2, Gro-a/CXCL1, ENA78/CXCL5, EGF, TGF-b1, TGF-b2, and TGF-b3.

Example 3—Modulation of the Gut Microbiome Enhances Anti-Tumor Responses in a Murine Melanoma Model Next, it was sought to use insights gained from human studies to test the hypothesis that modulating the gut microbiome could enhance anti-tumor responses in a murine model of melanoma. Studies were performed to determine if modulation of the gut microbiome to enrich for short-chain fatty acid producing bacteria would enhance anti-tumor responses.

In these studies, a murine tumor model with a common driver mutation that is found in melanoma (BRAF) was used. The cells were implanted into genetically identical mice (C57BL6) purchased from 2 different vendors (Taconic farms versus Jackson laboratories) that differ significantly in their microbiome (with enriched short chain fatty acid producing bacteria in Taconic mice). The BRAF(V600E)/Pten$^{-/-}$ tumor cells were implanted into Taconic and Jackson mice, and substantial differences were observed in tumor growth (FIG. 33A) and survival (FIG. 33B) in these genetically identical mice with differing microbiomes. Interestingly, modulation of the gut microbiome by co-housing Taconic and Jackson (FIG. 33C) (as mice are normally copropahgic) or by fecal transplant abrogated these differences, suggesting that modulation of the gut microbiome can alter tumor growth in the BRAF-mutant tumor model. As mice are copraphagic, cohousing leads the emrgence of a merged microbiome that draws from both individual microbiomes. 16S sequencing was performed on single-housed versus co-housed Taconic and Jackson mice, demonstrating distinct microbiomes in the single-housed mice and co-housed mice (FIGS. 33D & E), confirming modulation of the gut microbiome in these mice.

Based on the data in human patients, it was tested whether oral administration of butyrate (a short chain fatty acid) would enhance anti-tumor responses by providing adequate substrate to facilitate a favorable gut microbiome. In these studies, butyrate was administered orally to Taconic and Jackson mice. Treatment with butyrate was associated with an enhanced anti-tumor response in these studies (FIG. 33F), further suggesting that modulation of the gut microbiome may enhance anti-tumor responses.

Thus, these studies provide novel data regarding the diversity and composition of the oral and gut microbiome in patients with metastatic melanoma on systemic therapy, and importantly demonstrate that differential bacterial "signatures" exist in responders versus non-responders to immune checkpoint blockade (specifically PD-1 based therapy).

Example 4—Fecal Microbiota Transplantation

Fecal Microbiota Transplantation (FMT) of a Favorable Gut Microbiome in Germ-Free (GF) Mice Reduces Tumor Growth (FMT1):

To investigate a causal link between a "favorable" gut microbiome and response to immune checkpoint blockade, Fecal Microbiome Transplantation (FMT) experiments were performed in germ-free (GF) recipient mice. A well-established syngeneic model of injectable murine melanoma driven by oncogenic BRAFv600E expression and PTEN deletion (BP cells) was used. In the first experiment (FMT1), it was sought to determine if FMT could have any impact on tumor growth. GF mice (n=3 per group) were transplanted by oral gavage with stool from a responder (R-FMT group) or from a non-responder (NR-FMT group) to anti-PD-1 therapy. Control group mice were transplanted with PBS alone. Two weeks after FMT, each mouse was injected subcutaneously with 8×10$^5$ BP cells, and tumor growth was checked twice a week (FIG. 25A). Blood and fecal pellets were collected at different time points during the experiment.

Results from FMT1 demonstrated significantly delayed tumor growth by day 14 in R-FMT group compared to mice in those transplanted with stool from NR to anti-PD-1 (p=0.04, FIG. 1B).

Next, the systemic impact of FMT on the immune system was investigated using multicolor fluorescence activated cell sorting (FACS) analysis. Notably, mice receiving R-FMT had a higher percentage of innate effector cells (expressing CD45$^+$CD11b$^+$Ly6G$^+$) and lower frequency of suppressive myeloid cells (expressing CD11b$^+$CD11c$^+$) in the spleen compared to mice in the NR-FMT group (FIG. 26). These data suggested that specific subpopulations in the innate immune compartment play a role in the anti-tumoral response elicited by transplantation of a favorable gut microbiota in GF recipient mice.

This conclusion was further confirmed by quantitative confocal imaging on gut and tumor sections from mice that received FMT. Indeed, tumors of mice receiving R-FMT had a higher density of CD45$^+$ and CD8$^+$ T cells than mice receiving NR-FMT (FIGS. 27A, and 27C upper panel). Moreover, FMT from R locally increased the number of CD45$^+$ immune and CD8$^+$ T cells in the gut compared to NR-FMT (FIGS. 27B and 27C lower panel).

Additionally, taxonomic characterization using 16S sequencing revealed stark differences in the gut microbiome of germ-free mice before and after fecal microbiota transplantation (FMT), with major increases in Bacteroidales and Clostridiales taxa. As expected, control mice that received PBS, harbored markedly different taxa in their gut microbiome when compared to mice that received stool from responders (R-FMT) or non-responders (NR-FMT) to anti-PD1 therapy. Furthermore, the gut microbiomes of mice receiving R-FMT and NR-FMT remained fairly stable over time post transplantation.

FMT of a Favorable Gut Microbiome in GF Mice Reduces Tumor Growth and Enhances Response to α-PD-L1 Therapy (FMT2):

In the second FMT experiment (FMT2), it was asked if the microbiome from an R patient could enhance response to immune therapy when transplanted in mouse model of melanoma. To address this question, GF mice were transplanted by oral gavage with stool from a responder (n=2, R-FMT group) or from a non-responder (n=3, NR-FMT group) to anti-PD-1 therapy. Control group mice (n=2) were transplanted with PBS alone. Two weeks after FMT, each mouse was injected with $8\times10^5$ BP cells and tumor growth was checked twice a week. When tumor volume reached 250-500 mm$^3$, mice were treated with anti-PD-L1 antibody, administered by intra-peritoneal injection (FIG. 28A).

Results from FMT2 demonstrated significantly delayed tumor growth by day 14 in R-FMT group compared to mice in those transplanted with stool from NR to anti-PD-1 (p=0.04, FIG. 28B). Importantly, mice transplanted with R-FMT also exhibited improved responses to anti-PD-L1 therapy (FIG. 28C) compared to mice that were transplanted with stool from NR (NR-FMT).

Figure 29A:
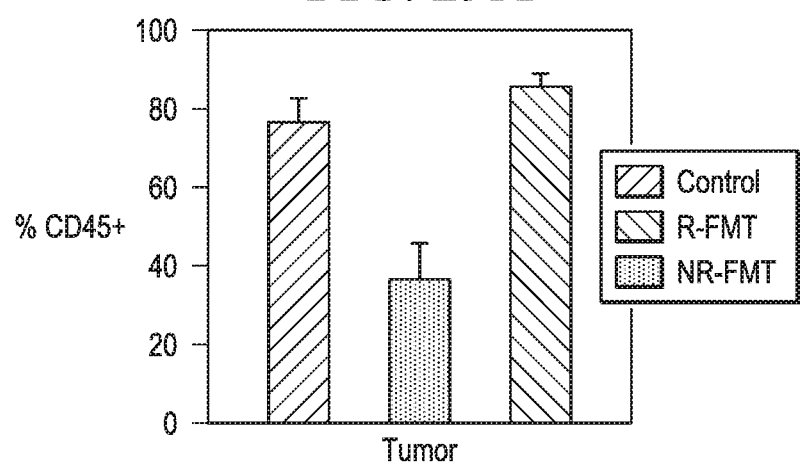
Figure 29B:
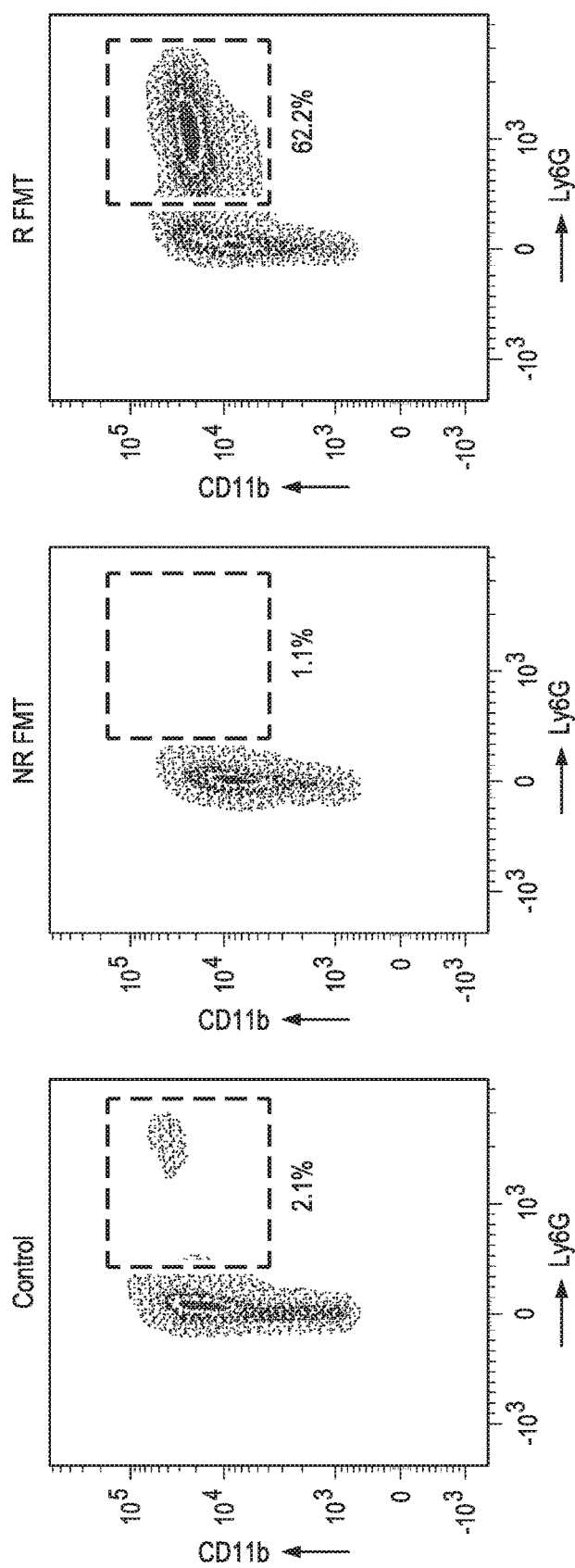
Figure 29C:
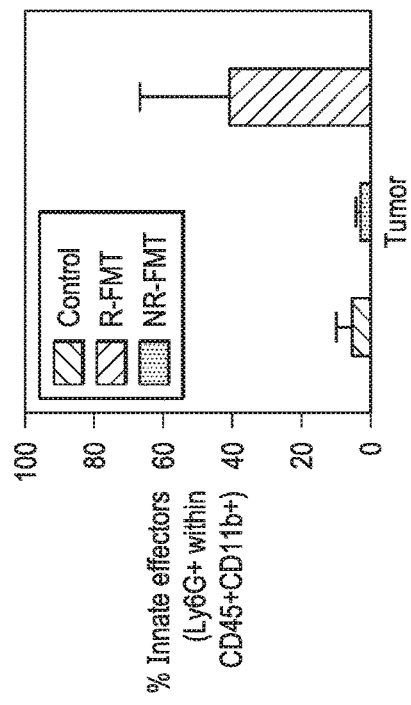
Figure 29D:
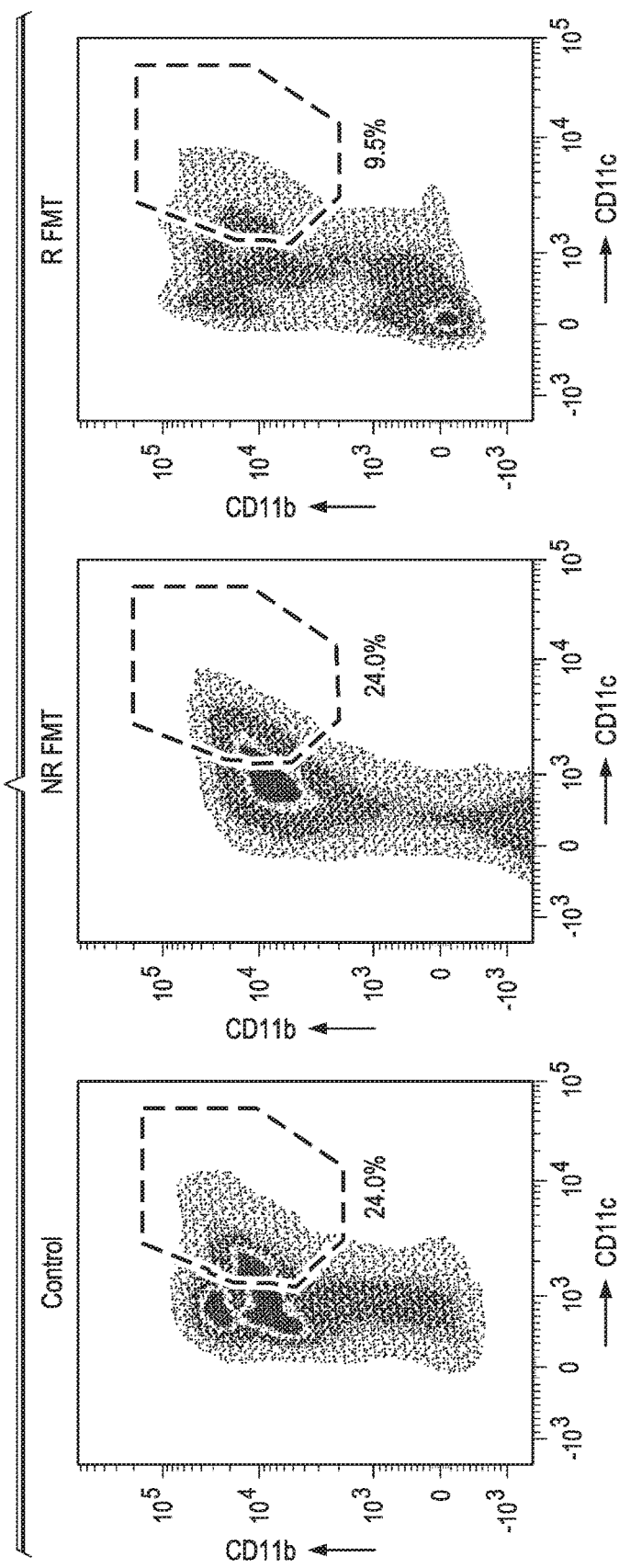
Figure 29E:
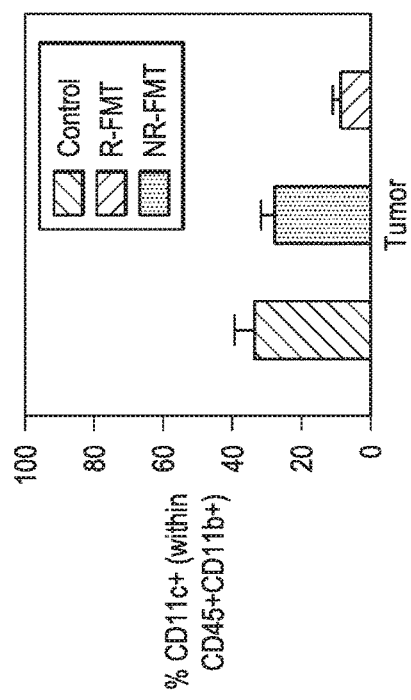

Next, the mechanism through which the gut microbiome may influence systemic and anti-tumor immune responses was determined. FACS analysis of tumors and spleen immune infiltrates demonstrated that mice receiving R-FMT had higher percentage of CD45$^+$ myeloid cells infiltrating the tumor compared to mice in the NR-FMT group (FIG. 29A). In particular, a higher percentage of innate effector cells (expressing CD45$^+$CD11b$^+$Ly6G$^+$) and lower frequency of suppressive myeloid cells (expressing CD11b$^+$ CD11c$^+$) were found in tumor immune infiltrates from R-FMT compared to NR-FMT (FIG. 29B-E). These data correlated specific subpopulations of the innate immune compartment to the anti-tumoral response induced by FMT from an R patient, both at peripheral (as showed in FMT1) and tumor level.

An increase in the frequency of RORγT$^+$ Th17 cells in the tumor was also detected in NR-FMT mice (FIGS. 30A and B), in line with observations made in tumors from patients who failed to respond to PD-1 blockade. Moreover, mice receiving NR-FMT also demonstrated higher levels of regulatory CD4$^+$ FOXP3$^+$ T cells (FIG. 30C) and CD4$^+$ IL-17$^+$ (FIG. 31D) cells in the spleen, suggesting impaired host immune responses.

Mass cytometry (CyTOF) analysis using t-SNE dimension reduction was performed on tumors from mice, and demonstrated up-regulation of PD-L1 in the tumor microenvironment of mice receiving R-FMT versus NR-FMT (FIG. 31A), suggesting the development of a "hot" tumor microenvironment. CyTOF analysis also confirmed that distinct myeloid subpopulation preferentially infiltrate tumors in R-FMT or non-responders NR-FMT (FIG. 31B)

Longitudinal sampling and microbiome characterization of fecal pellets from FMT2 experiment showed results similar to FMT1, with relative stability in the gut microbiome over time.

Stability of the microbiome in germ-free mice post engraftment with FMT.

16S sequencing was performed on longitudinal fecal pellets collected from germ-free mice that received stool from a patient who responded to PD-1 blockade to versus a patient who did not. Examination of phylogenetic taxa at the order level and comparison of baseline pellets with those collected two weeks after FMT completion revealed successful engraftment. Moreover, persistence of the most abundant orders over time suggested that the engrafted microbiome was stable during the whole experiment.

Based on the hypotheses that certain bacteria within the R-FMT mice flora help slow tumor growth, and that certain bacteria in NR-FMT mice flora help stimulate tumor growth, we compared OTUs that were either present in R-FMT mice or NR-FMT mice only (or also missing from control mice).

These were done in representative mice from each group from the 2 FMT experiments. The inventors also looked at the OTUs that showed consistent transfer results in both FMT experiments. This analysis revealed that OTUs classified as *Acetanaerobacterium elongatum*, *Alistipes timonensis*, *Anaerocolumna jejuensis*, *Anaerocolumna xylanovorans*, *Bacteroides fragilis*, *Bacteroides nordii*, *Bacteroides stercoris*, *Blautia faecis*, *Blautia glucerasea*, *Blautia hansenii*, *Blautia obeum*, *Blautia schinkii*, *Caproiciproducens galactitolivorans*, *Christensenella minuta*, *Clostridium aldenense*, *Clostridium alkalicellulosi*, *Clostridium amygdalinum*, *Clostridium oroticum*, *Clostridium polysaccharolyticum*, *Clostridium xylanolyticum*, *Coprobacillus cateniformis*, *Emergencia timonensis*, *Eubacterium hallii*, *Extibacter muris*, *Faecalibacterium prausnitzii*, *Ihubacter massiliensis*, *Neglecta timonensis*, *Novibacillus thermophilus*, *Oscillibacter ruminantium*, *Papillibacter cinnamivorans*, *Parabacteroides johnsonii*, *Parasporobacterium paucivorans*, *Peptococcus niger*, *Pseudoflavonifractor capillosus*, *Robinsoniella peoriensis*, *Ruminococcus gauvreauii*, *Ruminococcus gnavus*, *Ruminococcus torques*, and *Slackia piriformis* were found only in R-FMT mice in both experiments.

FMT from different R and NR donors in germ-free GF mice confirms the link between R microbiota and reduced tumor growth (FMT3).

To validate the finding that a "favorable" gut microbiome restrains tumor growth when transplanted in GF mice, an experiment was performed similar to FMT1 using stools from different R and NR patients. In this third experiment (FMT3), GF mice were transplanted by oral gavage with stool from one responder ((n=1, R-FMT group) or from one non-responder ((n=1, NR-FMT group) to anti-PD-1 therapy. Control group mice were transplanted with PBS alone (n=3, Control group). Two weeks after FMT, each mouse was injected subcutaneously with $2.5\times10^5$ BP cells, and tumor growth was checked twice a week (FIG. 32A). Blood and fecal pellets were collected at different time points during the experiment.

Results from FMT3 confirmed significantly delayed tumor growth by day 14 in R-FMT group compared to mice in those transplanted with stool from NR to anti-PD-1 (FIG. 32B). Importantly, this difference was maintained over time until the end point (FIG. 32C).

Example 5—Fecal Microbiota Transplantation Methods

Fecal Microbiota Transplantation (FMT):

All animal studies were approved by the Animal Care and Use Committee, The UT at MD Anderson Cancer Center, in compliance with the Guide for the Care and Use of Laboratory Animals. B6 germ-free mice for murine studies were bought from the gnotobiotic facility of Baylor College of Medicine (Houston). All mice were transported in specialized autoclaved shipping cages, and were housed at MD Anderson Cancer Center mouse facility. All cages, bottles with stoppers and animal drinking water were autoclaved before being used. Food and bedding were double irradiated and tested to ensure sterility prior to being used in the experiment. Within each treatment category, a control group of mice received only pre-reduced PBS. All other mice from experimental groups received FMT from either an R donor or a NR donor, with each donor sample delivered to one, two or three mice. 200 µl cleared supernatant from 0.1 g/µl human fecal suspension was obtained using a 100 µm strainer and gavaged into mice for 3 doses over 1 week, followed by a break of 1-week to allow microbiome establishment. Mice were then injected with BP syngeneic tumor cell line (Day 14), and animals were treated with anti-PD-L1 monoclonal antibody (purified low endotoxin, functional formulation, B7-H1, CD274, Leinco Technologies Inc.) once tumors reached ~250-500 mm$^3$. Tumor growth/survival was assessed. Fecal specimens, blood, spleens and tumors were harvested and processed for further analysis.

Flow Cytometry of Mouse Tumor and Spleen:

Tumors were isolated and minced into small pieces and digested for 1 hour in RPMI containing collagenase A (2 mg/mL; Roche, Cat. No. 11 088 793 001) and DNase I (40 units/mL; Sigma-Aldrich, Cat. No. D5025) with agitation at 37° C. Cell suspensions were passed through a cell strainer, washed in 2% RPMI supplemented with 2 mmol/L EDTA and resuspended in FACS buffer (PBS containing 2% heat-inactivated FBS with 2 mM EDTA supplementation). Spleens were smashed in FACS buffer and red blood cells lysed by incubation in ACK buffer (Gibco) for 2 minutes at room temperature. The pellet was then washed and resuspended in FACS buffer. For analysis of cell surface markers, the following antibodies were used: CD45 (30-F11, BD Biosciences), CD11b (M1/70, eBioscience), CD11c (HL3, BD Pharmigen), Ly6G (RB6-8C5, eBioscience), Ly6C (AL-21, BD Bioscience), F4/80 (BM8, eBioscience). Cells were labeled with LIVE/DEAD viability stain (Life Technologies) and samples were acquired on a LSR Fortessa X20 flow cytometry (BD). Doublets were distinguished and excluded by plotting FSC area versus FSC height and data analyzed using FlowJo software (Tree Star).

Immunofluorescence on FFPE Samples:

Xenograft tumors, mouse gut and spleens were harvested, fixed in buffered 10% formalin first (4 hours at room temperature), then switched to 70% ethanol and stored at 4° C. Tissues were embedded in paraffin and 5 μm sections were mounted on positively charged slides. Tissues were deparaffinized and antigen retrieval was performed in pH 6.0 Citrate buffer (Dako) using a microwave. Sections were blocked in blocking buffer (5% Goat Serum/0.3% BSA/0.01% Triton in PBS) followed by primary antibody incubation overnight at 4° C. Sections were washed and then incubated with Alexa-conjugated secondary antibody (1:500, Molecular Probes) for 1 hour at room temperature. Coverslips were washed 3 times in PBS/0.01% Triton and then incubated for 15 minutes at room temperature in Hoechst stain (1:5000, Invitrogen). After 3 washes in PBS, the samples were mounted in ProLog Diamond mounting media (Molecular Probe). Images where captured using a Nikon A1R+ confocal microscope equipped with a four solid state laser system and a 20× objective.

CyTOF:

Tumors were manually dissociated, digested using liberase TL (Roche) and DNase I for 30 minutes at 37° C., and passed through a 70 μm mesh filter. Samples were then centrifuged using a discontinuous gradient of Histopaque 1119 (Sigma-Aldrich) and RMPI media. Single cell suspensions of up to 2.5×10$^6$ cells per sample were Fc-receptor blocked and stained with a surface antibody mixture for 30 minutes at 4° C. Metal-conjugated antibodies were purchased from Fluidigm or conjugated using X8 polymer antibody labeling kits according to the manufacturer's protocol (Fluidigm). Samples were stained using 2.5 μm 194Pt-cisplatin (Fluidigm) for 1 minute and washed twice with 2% FCS PBS. Cells were barcoded using a palladium mass tag barcoding approach according to the manufacturer's protocol (Fluidigm) and combined after two washes with 2% FCS PBS. Cells were then fixed and permeabilized using FoxP3 transcription factor staining kit according to the manufacturer's protocol (eBioscience). Samples were then stained using a mixture of antibodies against intracellular targets for 30 minutes at room temperature. Samples were washed twice with 2% FCS PBS and then incubated overnight in a 1.6% PFA/100 nM iridium/PBS solution prior to acquisition using a Helios mass cytometer (Fluidigm).

Mass cytometry data were bead normalized and debarcoded using Fluidigm software. Total live and CD45+ cells were manually gated using FlowJo. t-SNE analyses were performed on total live and CD45+ cells using the Cyt package in Matlab. Data were arcsinh transformed using a co-efficient of 4 and randomly down-sampled to 50,000 events per sample prior to t-SNE analysis. t-SNE plots for each experimental group were then generated by merging samples from each group and displaying an equal number of randomly down-sampled events (50,000) from each treatment group.

TABLE 9

CyTOF panel.

| Target | Clone | Metal Tag | Stain | Source |
|---|---|---|---|---|
| CD45 | 30-F11 | 89Y | Surface | Fluidigm |
| c-MYC | 9E10 | 115In | Intracellular | eBioscience |
| MHC-II | M5/114.15.2 | 139La | Surface | Biolegend |
| NK1.1 | PK136 | 141Pr | Surface | Biolegend |
| CD11c | N418 | 142Nd | Surface | Biolegend |
| CD80 | 16-10A1 | 143Nd | Surface | Biolegend |
| MHC-I | 28-14-8 | 144Nd | Surface | Fluidigm |
| CD4 | RM4-5 | 145Nd | Surface | Fluidigm |
| CD8a | 53-6.7 | 146Nd | Surface | Fluidigm |
| CD86 | GL-1 | 147Sm | Surface | Biolegend |
| CD27 | LG.3A10 | 148Nd | Surface | Biolegend |
| OX40 | OX-86 | 149Sm | Surface | eBioscience |
| CD25 | 3C7 | 150Nd | Surface | Fluidigm |
| TIGIT | 1G9 | 151Eu | Surface | Biolegend |
| CD3ε | 145-2C11 | 152Sm | Intracellular | Fluidigm |
| PD-L1 | 10F.9G2 | 153Eu | Surface | Fluidigm |
| BATF | D7C5 | 154Sm | Intracellular | Fluidigm |
| ICOS | 7E.17G9 | 155Gd | Surface | eBioscience |
| CD69 | H1.2F3 | 156Gd | Surface | Biolegend |
| CXCR5 | 2G8 | 158Gd | Surface | BD |
| PD-1 | 29F.1A12 | 159Tb | Surface | Fluidigm |
| CD62L | MEL-14 | 160Gd | Surface | Fluidigm |
| CXCR3 | CXCR3-173 | 161Dy | Surface | Biolegend |
| TIM3 | RMT3-23 | 162Dy | Surface | Fluidigm |
| LAG3 | C9B7W | 163Dy | Surface | Biolegend |
| LAP-TGFβ | TW7-16B4 | 164Dy | Surface | Fluidigm |
| FoxP3 | FJK-16s | 165Ho | Intracellular | Fluidigm |
| BCL2 | BCL/10C4 | 166Er | Intracellular | Biolegend |
| GATA3 | L50-823 | 167Er | Intracellular | BD |
| BCL6 | K112-91 | 168Er | Intracellular | BD |
| CD117 | 2B8 | 169Tm | Surface | Biolegend |
| CD127 | A7R34 | 170Er | Surface | Biolegend |
| CTLA-4 | UC10-4B9 | 171Yb | Intracellular | Biolegend |
| CD11b | M1/70 | 172Yb | Surface | Fluidigm |
| TBET | 4B10 | 173Yb | Intracellular | Biolegend |
| RORγT | Q31-378 | 174Yb | Intracellular | BD |
| CD28 | 37.51 | 175Lu | Surface | Biolegend |
| EOMES | Dan11mag | 176Yb | Intracellular | eBioscience |
| Live/Dead | N/A | 194Pt | Surface | Fluidigm |
| CD19 | 6D5 | 195Pt | Surface | Biolegend |
| TCRγδ | GL3 | 196Pt | Surface | Biolegend |
| KLRG1 | 2F1 | 198Pt | Surface | BD |
| CD44 | IM7 | 209Bi | Surface | Fluidigm |

All of the methods disclosed and claimed herein can be made and executed without undue experimentation in light of the present disclosure. While the compositions and methods of this invention have been described in terms of preferred embodiments, it will be apparent to those of skill in the art that variations may be applied to the methods and in the steps or in the sequence of steps of the method described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

REFERENCES

The following references, to the extent that they provide exemplary procedural or other details supplementary to those set forth herein, are specifically incorporated herein by reference.

A framework for human microbiome research. *Nature* 486, 215-221, 2012.
Caporaso et al., *The ISME journal* 6, 1621-1624, 2012.
Caspi et al., *Nucleic Acids Research* 36, D623-D631, 2008.
Chen et al., *Cancer Discovery* 2016.
Cooper et al., *Cancer Immunology Research* 2015.
Fritz et al., *Journal of experimental psychology: General* 141, 2, 2012.
Hurwitz et al., *Proc Natl Acad Sci USA* 95(17): 10067-10071, 1998.
International Patent Publication No. WO00/37504
International Patent Publication No. WO01/14424
International Patent Publication No. WO01/14424
International Patent Publication No. WO1995/001994
International Patent Publication No. WO1998/042752
International Patent Publication No. WO2000/037504
International Patent Publication No. WO2001/014424
International Patent Publication No. WO2005/003168
International Patent Publication No. WO2005/009465
International Patent Publication No. WO2006/00317
International Patent Publication No. WO2006/072625
International Patent Publication No. WO2006/072626
International Patent Publication No. WO2006/121168
International Patent Publication No. WO2007/042573
International Patent Publication No. WO2008/084106
International Patent Publication No. WO2008132601
International Patent Publication No. WO2009/101611
International Patent Publication No. WO2009/114335
International Patent Publication No. WO2009044273
International Patent Publication No. WO2010/027827
International Patent Publication No. WO2010/065939
International Patent Publication No. WO2011/0008369
International Patent Publication No. WO2011/014438
International Patent Publication No. WO2011/066342
International Patent Publication No. WO2012/071411
International Patent Publication No. WO2012/160448
International Patent Publication No. WO2013/006490
International Patent Publication No. WO2013/025779
International Patent Publication No. WO2013/067492
International Patent Publication No. WO2014/022021
International Patent Publication No. WO2015/016718
International Patent Publication No. WO96/15660
International Patent Publication No. WO98/42752
Jones et al., *J Exp Med.* 205(12):2763-79, 2008.
Kanehisa et al., *Nucleic Acids Res* 28, 27-30, 2000.
Li et al., *Nat Biotech* 32, 834-841, 2014.
Mellman et al., *Nature* 480:480-489, 2011.
Muegge et al., *Science* 332, 970-974, 2011.
Nielsen et al., *Nat Biotech* 32, 822-828, 2014.
Okazaki T et al., *Intern. Immun.* 19(7):813, 2007.
Pardoll, *Nature Rev Cancer* 12:252-264, 2012.
Patent Publication No. EP 2320940
Peled et al., *Journal of Clinical Oncology* 0, JCO.2016.2070.3348.
Price et al., *PLOS ONE* 5, e9490, 2010.
Qin et al., *Nature* 464, 59-65, 2010.
Schwartz et al., RECIST 1.1. *European Journal of Cancer* 62, 132-137, 2016.
Segata et al., *Genome Biology* 12, R60, 2011.
Shannon et al., *BMC Bioinformatics* 14, 217 10.1186/1471-2105-14-217, 2013.
Sivan et al., *Science* (New York, N.Y.) 350, 1084-1089, 2015.
Structure, function and diversity of the healthy human microbiome. *Nature* 486, 207-214, 2012.
Taur et al., *Blood* 124, 1174-1182, 2014.
Tsujikawa et al., *Cell reports*, 2017.
Tumeh et al., *Nature* 515, 568-571, 2014.
Turnbaugh et al., *Nature* 457, 480-484, 2009.
U.S. Pat. No. 4,870,287
U.S. Pat. No. 5,760,395
U.S. Pat. No. 5,763,488
U.S. Pat. No. 5,885,796
U.S. Pat. No. 5,844,905
U.S. Pat. No. 6,207,156
U.S. Pat. No. 8,008,449
U.S. Pat. No. 8,017,114
U.S. Pat. No. 8,119,129
U.S. Pat. No. 8,329,867
U.S. Pat. No. 8,354,509
U.S. Pat. No. 8,735,553
U.S. Patent Publication No. 2012/0177645
U.S. Patent Publication No. 2012/0294796
U.S. Patent Publication No. 2014/0294898
Vetizou et al., *Science* (New York, N.Y.) 350, 1079-1084, 2015.

SEQUENCE LISTING (2676 sequences)

SEQ ID NO: 1 - DNA, 253 bp, Unknown
  Artificial/consensus sequence
tacgtagggcgcgagcgttgtccggaattattgggcgtaaagagcttgtaggcggttggtcgcgtctgctgtgaaaggctggggcttaaccctggttttgcagtgggtacgggctaactagagtgcagtaggggagactggaattcctggtgtagcggtggaatgcgcagatatcaggaggaacaccgatggcgaaggcaggtctctgggctgtaactgacgctgagaagcgaaagcatggggagcgaacagg

SEQ ID NO: 2 - DNA, 253 bp, Unknown
  Artificiall/Consensus sequence
tacggaggatgcgagcgttatccggatttattgggtttaaagggtgcgtaggcggcctgttaagtcagcggtgaaatctaggagcttaactcctaaattgccattgatactggcgggcttgagtgtagatgaggtaggcggaatgcgtggtgtagcggtggaatgcatagatatcacgcagaactccgattgcgaaggcagcttactaaggtacaactgacgctgaagcacgaaagcgtgggtatcaaacagg

SEQ ID NO: 3 - DNA, 253 bp, Unknown
  Artificiall/Consensus sequence
tacggaggatccaagcgttatccggatttattgggtttaaagggtgcgtaggcggtcagataagttagaggtgaaattccggtgcttaacaccggcgctgcctctaatactgtttgactagagagtagttgcggtaggcggaatgtatggtgtagcggtgaaatgcttagagatcatacagaacaccgattgcgaaggcagcttaccaagctatatctgacgttgaggcacgaaagcgtggggagcaaacagg

SEQ ID NO: 4 - DNA, 253 bp, Unknown
  Artificiall/Consensus sequence
tacgaagggggcaagcgttgttcggaattactgggcgtaaagggagtgtaggcggttatgtaagatagtggtgaaatcccagagcttaactttggaattgccattatgactatgtggctagaattacagagaggatagtggaatacccagtgtagaggtgaaattcgtagatattgggtagaacaccagtggcgaaggcgactatctggctgtatattgacgctgaggctcgaaagcatggggatcaaacagg

SEQ ID NO: 5 - DNA, 253 bp, Unknown
  Artificiall/Consensus sequence
tacgtatgtcgcaagcgttatccggaattattgggcataaagggcatctaggcggccctgtaagtctagggtgaaaacctgcggctcaaccgcaggcctgccccggaaactacagggctagagtatcggagaggtggacggaactgcacgagtagaggtgaaattcgtagatatgtgcaggaatgccgatgatgaagatagttcactggacggtaactgacgctgaagtgcgaaagctaggggagcaaacagg

SEQ ID NO: 6 - DNA, 253 bp, Unknown
  Artificiall/Consensus sequence
tacgtagggggcaagcgttatccggatttactgggtgtaaagggagcgtagacggcatcacaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 7 - DNA, 253 bp, Unknown
  Artificiall/Consensus sequence
tacggaggatgcgagcgttattcggaatcattgggtttaaagggtctgtaggcgggctattaagtcaggggtgaaaggtttcagcttaactgagaaattgcctttgatactggtagtcttgaatatctgtgaagttcttggaatgtgtagtgtagcggtgaaatgcttagatattacacagaacaccgattgcgaaggcaggggactaacagacaattgacgctgagagacgaaagcgtggggagcgaacagg

SEQ ID NO: 8 - DNA, 253 bp, Unknown
  Artificiall/Consensus sequence
tacgtagggggcaagcgttatccggatttactgggtgtaaagggagcgtaggtggctaggtaagtcaggtgtgaaagcccggggctcaaccccgggattgcacttgaaactacttagctagagtgcaggagaggtaagtggaattcctagtgtagcggtgaaatgcgtagatattaggaggaacaccagtggcgaaggcggcttactggactgtaactgacactgaggctcgaaagcgtggggagcaaacagg

SEQ ID NO: 9 - DNA, 253 bp, Unknown
  Artificiall/Consensus sequence
tacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacagg

SEQ ID NO: 10 - DNA, 253 bp, Unknown
  Artificiall/Consensus sequence
tacggaaggtccgggcgttatccggatttattgggtttaaagggagtgtaggcggtctgttaagcgtgttgtgaaatttaggtgctcaacatttaacttgcagcgcgaactgtcagacttgagtacacgcagcgcaggcggaattcatggtgtagcggtgaaatgcttagatatcatgaggaactccgatcgcgaaggcagcctgcgggagtgttactgacgcttaagctcgaaggtgcgggtatcgaacagg

SEQ ID NO: 11 - DNA, 252 bp, Unknown
  Artificiall/Consensus sequence
tacggaaggtccgggcgttatccggaattattgggtttaaagggagcgcaggcgggagtataagtcagctgttaaatatcagagcccaactctgttatgcagttgaaactatatttcttgagtacgcacagggatggcggaattcagggtgtagcggtgaaatgcttagatatcctgaagaactccgatcgcgaaggcagccatccggagcgtaactgacgctgaggctcgaaggtgcgggtatcgaacagg

SEQ ID NO: 12 - DNA, 253 bp, Unknown
  Artificiall/Consensus sequence
tacggaggatgcgagcgttatccggatttattgggtttaaagggtgcgtaggcggcacgccaagtcagcggtgaaatttccgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacagg

SEQ ID NO: 13 - DNA, 253 bp, Unknown
  Artificiall/Consensus sequence
tacgtaggtggcaagcgttatccggatttactgggtgtaaagggcgcgtaggcggggatgcaagtcagatgtgaaatctatgggcttaacccataaactgcatttgaaactgtatctcttgagtgtcggagaggtagacggaattcctagtgtagcggtgaaatgcgtagatattaggaggaacaccagtggcgaaggcggtctactggacgataactgacgctgaggcgcgaaagcgtggggagcaaacagg

SEQ ID NO: 14 - DNA, 253 bp, Unknown
  Artificiall/Consensus sequence
tacgtaggtggcaagcgttatccggaattactgggtgtaaagggagcgcaggcgggatagcaagtcagctgtgaaaactatgggctcaacccataaactgcagttgaaactgttattcttgagtggagtagaggcaagcggaattccgagtgtagcggtgaaatgcgtagatattcggaggaacaccagtggcgaaggcggcttgctgggctctaactgacgctgaggctcgaaagtgtggggagcaaacagg

SEQ ID NO: 15 - DNA, 252 bp, Unknown
  Artificiall/Consensus sequence
tacggaggatgcgagcgttatccggatttattgggtttaaagggtgcgtaggcggaagttcaagtcagcggtaaaatcgaggggctcaacccctttaagccgttgaaactgggtttcttgagtgggcgagaagtgtgcggaatgtgtggtgtagcggtgaaatgcatagatatcacacagaactccgattgcgaaggcagcacaccggcgcccaactgacgctgaggcacgaaagcgtggggatcaaacagg

SEQ ID NO: 16 - DNA, 253 bp, Unknown
  Artificiall/Consensus sequence
tacggaaggtccgggcgttatccggatttattgggtttaaagggagcgtaggccggggattaagtgtgttgtgaaatgtaggcgcccaacgtctgacttgcagcgcatactggttcccttgagtacgcgcaacgccggcggaattcgtcgtgtagcggtgaaatgcttagatatgacgaagaaccccgattgcgaaggcagccggcgggagcgcaactgacgctgaagctcgaaggtgcgggtatcgaacagg

SEQ ID NO: 17 - DNA, 253 bp, Unknown
  Artificiall/Consensus sequence
tacgtatgtcgcgagcgttatccggaattattgggcataaagggcatctaggcggcctttcaagtcaggggtgaaaacctgcggctcaaccgcaggcctgcctttgaaactgataggctggagtaccggagaggtggacggaactgcacgagtagaggtgaaattcgtagatatgtgcaggaatgccgatgatgaagatagttcactggacggtaactgacgctgaagtgcgaaagccgggggagcgaacagg

SEQ ID NO: 18 - DNA, 252 bp, Unknown
  Artificiall/Consensus sequence
tacggaaggtccaggcgttatccggatttattgggtttaaagggagcgtaggcggattattaagtcagtggtgaaagacggtggctcaaccatcgttagccattgaaactggtagtcttgagtgcagacagggatgctggaactcgtggtgtagcggtgaaatgcttagatatcacgatgaactccgatcgcgaaggcaggtgtccgggctgcaactgacgctgaggctcgaaagtgtgggtatcaaacagg

SEQ ID NO: 19 - DNA, 253 bp, Unknown
  Artificiall/Consensus sequence
tacgtaggtggcgagcgttatccggaatgattgggcgtaaagggtgcgtaggtggcagatcaagtctggagtaaaaggtatgggctcaacccgtactggctctggaaactgatcagctagagaacagaagaggacggcggaactccatgtgtagcggtaaaatgcgtagatatatggaagaacaccggtggcgaaggcggccgtctggtctggattctgacactgaagcacgaaagcgtggggagcaaatagg

SEQ ID NO: 20 - DNA, 253 bp, Unknown
  Artificiall/Consensus sequence
tacgaagggggcgagcgttgttcggaattactgggcgtaaagggtgtgtaggcggttatgtaagatagcggtgaaatcccggggcttaacctcggaatagccgttataactatgtagctagagttatggagaggatagcggaatacccagtgtagaggtgaaattcgtagatattgggtagaacaccggtggcgaaggcggctatctggccatatactgacgctgaggcacgaaagcatggggatcaaacagg

SEQ ID NO: 21 - DNA, 253 bp, Unknown
  Artificiall/Consensus sequence
tacgaagggggcaagcgttgttcggaattactgggcgtaaagggtgtgtaggcggatttgtaagatagtggtgaaatacctgagctcaacttaggaattgccattataactatagatctggagtgacagagaggatattggaatacccagtgtagaggtgaaattcgtagatattgggtagaacaccagtggcgaaggcgagtatctggctgtcaactgacgctgaggcacgaaagcatggggatcaaacagg

SEQ ID NO: 22 - DNA, 253 bp, Unknown
  Artificiall/Consensus sequence
tacgtagggagcaagcgttatccggatttattgggtgtaaagggtgcgtagacgggacaacaagttagttgtgaaatccctcggcttaactgaggaactgcaactaaaactattgttcttgagtgttggagaggaaagtggaattcctagtgtagcggtgaaatgcgtagatattaggaggaacaccggtggcgaaggcgactttctggacaataactgacgttgaggcacgaaagtgtggggagcaaacagg

SEQ ID NO: 23 - DNA, 253 bp, Unknown
  Artificiall/Consensus sequence
tacggaggatgcgagcgttatccggatttattgggtttaaagggtgcgcaggcgggaacttaagtcagcggtgaaatctcgacgcttaacgtcgaaactgccgttgaaactgggtttcttgagtatagatgaagtaggcggaattcgttgtgtagcggtgacatgcttagatataacgaggaactccgattgcgtaggcagcttactaagctataactgacgctcaagcacgaaagcgtggggatcaaacagg

SEQ ID NO: 24 - DNA, 253 bp, Unknown
  Artificiall/Consensus sequence
tacgtagggggcgagcgttgtccggaattactgggcgtaaagggtgcgtaggcggtttggtaagttggatgtgaaatacccgggcttaacttgggggctgcatccaatactgtcggacttgagtgcaggagaggaaagcggaattcctagtgtagcggtgaaatgcgtagatattaggaggaacaccggtggcgaaggcggctttctggactgtaactgacgctgaggcacgaaagcgtggggagcaaacagg

SEQ ID NO: 25 - DNA, 253 bp, Unknown
  Artificiall/Consensus sequence
tacggaaggtccaggcgttatccggatttattgggtttaaagggagtgtaggcggtttgttaagcgtgttgtgaaatttaggtgctcaacatttaacttgcagcgcgaactgtcagacttgagtacacgcaacgtatgcggaattcatggtgtagcggtgaaatgcttagatatcatgaagaactccgattgcgaaggcagcatacgggagtgtaactgacgcttaagctcgaaggtgcgggtatcgaacagg

SEQ ID NO: 26 - DNA, 254 bp, Unknown
  Artificiall/Consensus sequence
tacgtagggtgcaagcgttgtccggatttactgggcgtaaagagctcgtaggtggtgtgtcgcgtcgtctgtgaaattccggggcttaactccgggcgtgcaggcgatacgggcacgactagagtgctgtaggggtaactggaattcctggtgtagcggtgaaatgcgcagatatcaggaggaacaccgatggcgaaggcaggttactgggcagttactgacgctgaggagcgaaagcatggggagcgaacagg

SEQ ID NO: 27 - DNA, 253 bp, Unknown
  Artificiall/Consensus sequence
tacggagggtgcaagcgttaatcggaattactgggcgtaaagcgcgcgtaggttgttttgtaagtcagaggtgtaatcccacggcttaaccgtggaactgcctttgatactgcataacttggatccgggagaggacagcggaattccaggtgtaggagtgaaatccgtagatatctggaagaacatcagtggcgaaggcggctgtctggaccggtattgacgctgaggcgcgaaagcgtgggtagcaaacagg

SEQ ID NO: 28 - DNA, 253 bp, Unknown
  Artificiall/Consensus sequence
tacgtagggtgcgagcgttaatcggaattactgggcgtaaagcgtgcgcaggcggttgggtaagacagatgtgaaatccccgggcttaacctgggaactgcatttgtgactgtccgactggagtatgtcagaggggggtggaattccaagtgtagcagtgaaatgcgtagatatttggaagaacaccgatggcgaaggcagccccctggggcaaaactgacgctcatgcacgaaagcgtggggagcaaacagg

SEQ ID NO: 29 - DNA, 252 bp, Unknown
  Artificiall/Consensus sequence
tacgtatggggcgagcgttgtccggaattattgggcgtaaagggtacgtaggcggttttttaagtcaggtgtgaaagcgtgaggcttaacctcattaagcacttgaaactggaagacttgagtgaaggagaggaaagtggaattcctagtgtagcggtgaaatgcgtagatattaggaggaataccggtggcgaaggcgactttctggacttttactgacgctcaggtacgaaagcgtggggagcaaacagg

SEQ ID NO: 30 - DNA, 253 bp, Unknown
  Artificiall/Consensus sequence
cacgtaaggggcgagcgttgttcggaattattgggcgtaaagggtatgtaggcggttaggtaagcctggtgtgaaatctacgagctcaactcgtaaactgcattgggtactgcttgacttgaatcacggaggggaaaccggaattccaagtgtaggggtggaatctgtagatatttggaagaacaccggtggcgaaggcgggtttctggccgatgattgacgctgatatacgaaggtgcggggagcaaacagg

SEQ ID NO: 31 - DNA, 253 bp, Unknown
  Artificiall/Consensus sequence
tacggaggatccgagcgttatccggatttattgggtttaaagggtgcgtaggtggctttttaagtcagcggtgaaagtttgtggctcaaccataaaattgccgttgaaactggggggcttgagtatatttgaggtaggcggaatgcgtggtgtagcggtgaaatgcatagatatcacgcagaactccaattgcgaaggcagcttactaaactataactgacactgaagcacgaaagcgtggggatcaaacagg

SEQ ID NO: 32 - DNA, 252 bp, Unknown
  Artificiall/Consensus sequence
tacgtagggtgcaagcgttgtccggatttattgggcgtaaagggctcgtaggcggtttgttgcgtctggtgtgaaagcttactgcttaacggtaggttgcgctggatacgggcaggcttgagtgcagtaggggagactggaattctcggtgtaacggtggaatgtgtagatatcgggaagaacacctatggcgaaggcaggtctctgggctgttactgacgctgaggagcgaaagcgtggggagcgaacagg

SEQ ID NO: 33 - DNA, 253 bp, Unknown
  Artificiall/Consensus sequence
tacatagggggcaagcgttatccggaattattgggcgtaaagcgtgcgtaggcggccacttaagtctgtcgtgaaagcccacagcttaactgtggagggtcgatggaaactgggaggcttgaatctaggagaggtaagtggaattccatgtgtagcggtaaaatgcttagatatatggaggaacaccagtggcgaaggcggcttactggtctagaattgacgctgatgcacgaaagcgtgggtagcaaacagg

SEQ ID NO: 34 - DNA, 253 bp, Unknown
  Artificiall/Consensus sequence
tacggaggatccgagcgttatccggatttattgggtttaaagggagcgtaggcggggtattaagtcagttgtgaaagtttgcggctcaaccgtaaaattgcagttgatactggtatccttgagtgcagcagaggtgggtggaattcgtggtgtagcggtgaaatgcttagatatcacgaagaactccgattgcgaaggcagctcactggagtgtaactgacgctgatgctcgaaagtgtgggtatcaaacagg

SEQ ID NO: 35 - DNA, 253 bp, Unknown
  Artificiall/Consensus sequence
cacgtaaggtgcgagcgttgttcggaattattgggcgtaaagggcatgcaggcgggtcgccaagcttggtaagaaataccggggctcaactccggagctatattgagaactggcgagctagagttgccgaagggtatccggaattccgcgtgaaggggtgaaatctgtagatatgcggaagaacaccgatggcgaaggcaggataccggcggacgactgacgctgaggtgcgaaggtgcggggagcaaacagg

SEQ ID NO: 36 - DNA, 253 bp, Unknown
  Artificiall/Consensus sequence
tacgtagggggcaagcgttatccggatttactgggtgtaaagggagcgtaggtggtaggtcaagtcagatgtgaaagcccagggctcaaccctgggactgcatttgaaactggcatactagagtgcaggagaggtaagtggaattcctagtgtagcggtgaaatgcgtagatattaggaggaacaccagtggcgaaggcggcttactggactgtaactgacactgaggctcgaaagcgtggggagcaaacagg

SEQ ID NO: 37 - DNA, 253 bp, Unknown
  Artificiall/Consensus sequence
tacggagggtgcaagcgttgtccggaatcattgggcgtaaagagttcgtaggcggcatgtcaagtccggtgttaaatcctgaggctcaacctcagaccggcactggatactggcaagcttgaatgcggtagaggtaaagggaattcctggtgtagcggtgaaatgcgtagatatcaggaagaacaccggtggcgtaagcgctttactgggccgttattgacgctgaggaacgaaagccgggggagcaaatggg

SEQ ID NO: 38 - DNA, 253 bp, Unknown
  Artificiall/Consensus sequence
tacgtagggggcaagcgttatccggatttactgggtgtaaagggagcgcagacggctctgcaagtctgaagtgaaagcccgcggcttaaccgcgggactgctttggaaactgcaaggcttgagtatcggaggggcaggcggaattcctagtgtagcggtgaaatgcgtagatattaggaagaacaccggtggcgaaggcggcctgctggacgaaaactgacgttgaggctcgaaggcgtggggagcaaacagg

SEQ ID NO: 39 - DNA, 253 bp, Unknown
  Artificiall/Consensus sequence
tacgtagggtgcgagcgttaatcggaattactgggcgtaaagcgtgcgcaggcggttgggtaagacaggtgtgaaatccccgagcttaacttgggaactgcacttgtgactgctcaactagagtatgtcagagggaggtggaattccaagtgtagcagtgaaatgcgtagatatttggaagaacaccgatggcgaaggcagcctcctgggataatactgacgctcatgcacgaaagcgtggggagcaaacagg

SEQ ID NO: 40 - DNA, 253 bp, Unknown
  Artificiall/Consensus sequence
tacgtagggagcaagcgttatccggatttattgggtgtaaagggtgcgtagacgggaagacaagttggttgtgaaagccctcggctcaactgaggaactgcaaccaaaactatcattcttgagtgcgggagaggaaagtggaattcctagtgtagcggtgaaatgcgtagatattaggaggaacaccagtggcgaaggcgactttctggaccgtaactgacgttgaggcacgaaagtgtggggagcaaacagg

SEQ ID NO: 41 - DNA, 252 bp, Unknown
  Artificiall/Consensus sequence
tacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacagg

SEQ ID NO: 42 - DNA, 253 bp, Unknown
  Artificiall/Consensus sequence
tacggaaggtccgggcgttatccggatttattgggtttaaagggagcgtaggctgttggttaagcgtgttgtgaaatgtagatgctcaacatctgaattgcagcgcgaactgtccgacttgagtgcgcggaaagcaggcggaattcgttgtgtagcggtgaaatgcttagatatgacgaagaactccgattgcgaaggcagcttgctgtagcgtaactgacgctgaagctcgaaagtgcgggtatcgaacagg

SEQ ID NO: 43 - DNA, 253 bp, Unknown
  Artificiall/Consensus sequence
tacggaaggtccgggcgttatccggatttattgggtttaaagggagcgtaggcgggctggaaagtcagttgtgaaagttcggggctcaacctcggaattgcagttgaaactgccagtcttgagttcacgcaggggcgctggaattcatggtgtagcggtgaaatgcttagatatcatgaagaactccgatcgcgaaggcatgtgcccggagtgcgactgacgctgaggctcgaaagtgcgggtatcaaacagg

SEQ ID NO: 44 - DNA, 252 bp, Unknown
  Artificiall/Consensus sequence
tacgtaggtggcaagcgttgtccggaattactgggtgtaaagggagcgtaggcgggcaggcaagtcaggcgtgaaatatatcggctcaaccggtaacggcgcttgaaactgcaggtcttgagtgaagtagaggttggcggaattcctagtgtagcggtgaaatgcgtagatattaggaggaacaccagtggcgaaggcggccaactgggcttttactgacgctgaggctcgaaagtgtggggagcaaacagg

SEQ ID NO: 45 - DNA, 252 bp, Unknown
  Artificiall/Consensus sequence
tacgtaggtggcgagcgttatccggaatcattgggcgtaaagagggagcaggcggccgcaagggtctgtggtgaaagaccgaagctaaacttcggtaagccatggaaaccgggcggctagagtgcggaagaggatcgtggaattccatgtgtagcggtgaaatgcgtagatatatggaggaacaccagtggcgaaggcgacggtctgggccgcaactgacgctcattcccgaaagcgtggggagcaaatagg

SEQ ID NO: 46 - DNA, 252 bp, Unknown
  Artificiall/Consensus sequence
tacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgtaactgacgctgaggctcgaaagccaggggagcgaacggg

SEQ ID NO: 47 - DNA, 253 bp, Unknown
  Artificiall/Consensus sequence
tacgtaggtggcaagcgttgtccggatttactgggtgtaaagggcgcgtaggcggagagacaagtcagatgtgaaatctatgggcttaacccataaactgcatttgaaactatctcccttgagtgatggagaggcaagcggaattcctagtgtagcggtgaaatgcgtagatattaggaggaacaccagtggcgaaggcggcttgctggacattaactgacgctgaggcgcgaaagcgtggggagcaaacagg

SEQ ID NO: 48 - DNA, 252 bp, Unknown
  Artificiall/Consensus sequence
tacgtaggtcccgagcgttgtccggatttattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 49 - DNA, 253 bp, Unknown
  Artificiall/Consensus sequence
tacgtagggggcaagcgttgtccggaataattgggcgtaaagggcgcgtaggcggctcggtaagtctggagtgaaagtcctgcttttaaggtgggaattgctttggatactgtcgggcttgagtgcaggagaggttagtggaattcccagtgtagcggtgaaatgcgtagagattgggaggaacaccagtggcgaaggcgactaactggactgtaactgacgctgaggcgcgaaagtgtggggagcaaacagg

SEQ ID NO: 50 - DNA, 254 bp, Unknown
  Artificiall/Consensus sequence
tacgtagggggcaagcgttgtccggaatgactgggcgtaaagggtgtgtaggcgggctcgcaagttggatgtgtaatacccagagcttaactcgggtgctgcatctgaaactacgagtcttgagtgtcggagaggtaagtggaattcctagtgtagcggtggaatgcgtagatattaggaggaacatcagtggcgaaggcgacttactggacgataactgacgctgaggcacgaaagcgtggggagcaaacagg

SEQ ID NO: 51 - DNA, 253 bp, Unknown
  Artificiall/Consensus sequence
tacgtagggggcaagcgttatccggatttactgggtgtaaagggagcgcagacggcgaagcaagtctgaagtgaaatgcatgggctcaacccatgaattgctttggaaactgtttggcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacagg

SEQ ID NO: 52 - DNA, 253 bp, Unknown
  Artificiall/Consensus sequence
tacggaagatgcgagcgttatccggatttattgggtttaaagggtgcgtaggcgggtgattaagtcagcggtgaaatgcgtcagcttaactggcgaactgccattgaaactggttaccttgagtgtagcggaagtatgcggaatgcgtggtgtagcggtgaaatgcatagatatcacgcagaactccgattgcgaaggcagcataccatactataactgacgctgaagcacgaaagcgtgggtatcgaacagg

SEQ ID NO: 53 - DNA, 252 bp, Unknown
  Artificiall/Consensus sequence
tacggaggatgcgagcgttatccggatttattgggtttaaagggtgcgtaggcggcgtgccaagtcagcggtaaaattgcggggctcaaccccgtaaagccgttgaaactggcgcgctcgagtgggcgagaagtatgcggaatgcgtggtgtagcggtgaaatgcatagatatcacgcagaaccccgattgcgaaggcagcataccggcgccccactgacgctgaggcacgaaagtgcggggatcaaacagg

SEQ ID NO: 54 - DNA, 253 bp, Unknown
  Artificiall/Consensus sequence
tacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacagg

SEQ ID NO: 55 - DNA, 253 bp, Unknown
  Artificiall/Consensus sequence
tacgaagggggcgagcgttgttcggaattactgggcgtaaagggtgtgtaggtggacgtgtaagatagcggtgaaatgccggagctcaacttcggaattgccattataactatgcgtctagaattatagagaggatagcggaatacccagtgtagaggtgaaattcgtagatattgggtagaacaccagtggcgaaggcggctatctggctatatattgacactgaggcacgaaagcatggggatcaaacagg

SEQ ID NO: 56 - DNA, 253 bp, Unknown
  Artificiall/Consensus sequence
tacgtagggggcaagcgttatccggatttactgggtgtaaagggagcgtagacggagtggcaagtctgaagtgaaaaccctgggcttaacctggggactgctttggaaactgttaatctagagtgttggagaggtaagtggaattcctggtgtagcggtgaaatgcgtagatatcaggaagaacaccggaggcgaaggcggcttactggacaataactgacgttgaggctcgaaagcgtggggatcaaacagg

SEQ ID NO: 57 - DNA, 252 bp, Unknown
  Artificiall/Consensus sequence
tacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacggg

SEQ ID NO: 58 - DNA, 254 bp, Unknown
  Artificiall/Consensus sequence
tacgtagggggcaagcgttatccggatttactgggtgtaaagggtgcgtaggtggtatggcaagtcagaagtgaaaacccggggctcaaccccgcggattgcttttgaaactgtcagactggagtaccggagaggtaagcggaattcctagtgtagcggtgaaatgcgtagatattaggaggaacaccagtggcgaaggcggcttactggacggtaactgacactgaggcacgaaagcgtggggagcaaacagg

SEQ ID NO: 59 - DNA, 252 bp, Unknown
  Artificiall/Consensus sequence
tacggaggatccaagcgttatccggatttattgggtttaaagggtgcgtaggcggttttataagttagaggttaaatatcggagcttaactccgttatgcctctaatactgtaggactagagaatagttgcggtaggcggaatgtatggtgtagcggtgaaatgcttagagatcatacagaacaccgattgcgaaggcagcttaccaaactatgactgacgttgaggcacgaaagcgtggggagcaaacagg

SEQ ID NO: 60 - DNA, 253 bp, Unknown
  Artificiall/Consensus sequence
tacgtaggtctcaagcgttatccggatttactgggcgtaaagtgtccgtagtctgatctgtaagtctgttttcaaatcctacgactcaatcgtagaaagggaatggatactgcagatctagaagtatctaggggttagtggaatttccggtggagcggtgaaatgcgttgatatcggaaggaacgccgaaagcgaaagcagctaactatagaatacttgacgatgagggacgacagtttggggagcaaacagg

SEQ ID NO: 61 - DNA, 253 bp, Unknown
  Artificiall/Consensus sequence
tacggagggtgcaagcgttgtccggaatcattgggcgtaaagagttcgtaggtggcctgtaaagtctggtgttaaatgcagaagctcaacttctgttcggcactggatacttgcaagctggaatgcggtagaggtaaagggaattcctggtgtagcggtgaaatgcgtagatatcaggaggaacatcggtggcgtaagcgctttactgggccgtaattgacactgaggaacgaaagccggggtagcaaatggg

SEQ ID NO: 62 - DNA, 253 bp, Unknown
  Artificiall/Consensus sequence
tacgtagggggcaagcgttatccggatttactgggtgtaaagggagcgtagacggaagtgcaagtcagaagtgaaagcccggggcttaaccccgggactgcttttgaaactgtgcatctagagtgcaggagaggtaagcggaattcctagtgtagcggtgaaatgcgtagatattaggaggaacaccggtggcgaaggcggcttactggactgtaactgacgttgaggctcgaaagcgtggggagcaaacagg

SEQ ID NO: 63 - DNA, 253 bp, Unknown
  Artificiall/Consensus sequence
tacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 64 - DNA, 253 bp, Unknown
  Artificiall/Consensus sequence
tacggaggatccaagcgttatccggatttattgggtttaaagggtgcgtaggcggcagattaagttagaggtgaaattccgaggctcaaccttggcactgcctctgatactggtttgctagcgagtagatgctgtaggcggaatgtgtggtgtagcggtgaaatgcatagagatcacacagaacaccgattgcgaaggcagcttacaaatctatatcggacgctgaggcacgaaagcgtggggagcaaacagg

SEQ ID NO: 65 - DNA, 253 bp, Unknown
  Artificiall/Consensus sequence
tacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacagg

SEQ ID NO: 66 - DNA, 253 bp, Unknown
  Artificiall/Consensus sequence
tacggaaggtccaggcgttatccggatttattgggtttaaagggagcgtaggccgtttggtaagcgtgttgtgaaatgtcggggctcaacctgggcattgcagcgcgaactgccagacttgagtgcgcaggaagtaggcggaattcgtcgtgtagcggtgaaatgcttagatatgacgaagaactccgattgcgaaggcagcctgctgtagcgcaactgacgctgaagctcgaaagcgtgggtatcgaacagg

SEQ ID NO: 67 - DNA, 253 bp, Unknown
  Artificiall/Consensus sequence
tacggaaggtccaggcgttatccggatttattgggtttaaagggagcgtaggcggacgattaagtcagctgtgaaagtttgcggctcaaccgtaaaattgcagttgaaactggttgtcttgagtgcacgcagggatgttggaattcatggtgtagcggtgaaatgcttagatatcatgaagaactccgatcgcgaaggcatatgtccggagtgcaactgacgctgaggctcgaaagtgcgggtatcgaacagg

SEQ ID NO: 68 - DNA, 252 bp, Unknown
  Artificiall/Consensus sequence
tacgtagggggcgagcgttatccggaattattgggcgtaaagagtgcgtaggtggctttttaagcgcggggtttaaggcaatggcttaaccattgttcgccctgcgaactggagagcttgagtgcaggagaggaaagcggaattcctagtgtagcggtgaaatgcgtagatattaggaggaacaccagtggcgaaggcggctttctggactgttactgacactgaggcacgaaagtgtggggagcaaacagg

SEQ ID NO: 69 - DNA, 253 bp, Unknown
  Artificiall/Consensus sequence
tacggaaggtccgggcgttatccggatttattgggtttaaagggagcgtaggccgcgccttaagcgtgttgtgaaatccgggtgctcaacatccggcttgcagcgcgaactggggcgcttgagtgcgctgaaagtaggcggaattcgtggtgtagcggtgaaatgcttagatatcacgaggaactccgattgcgaaggcagcctactgtagcgctactgacgctgatgctcgaaagcgtgggtatcgaacagg

SEQ ID NO: 70 - DNA, 253 bp, Unknown
  Artificiall/Consensus sequence
tacggggggtgcaagcgttgtccggaatcattgggcgtaaagagttcgtaggtggtatgttaagtctggtgttaaattctgaagctcaacttcagtagggcactggatactggcaaactagaatgcggtagaggtaaagggaattcctggtgtagcggtgaaatgcgtagatatcaggaggaacatcggtggcgtaagcgctttactgggccgtaattgacactgaggaacgaaagccggggtagcaaatggg

SEQ ID NO: 71 - DNA, 253 bp, Unknown
  Artificiall/Consensus sequence
tacggaggattcgagcgttatccggatttactgggtttaaagggtgcgcaggcgggctcttaagtcagcggtgaaatgtctgggcttaccctaggaattgccgttgatactgggagtcttggataagcataaggacggcggaatgcgtagtgtagcggtgaaatgcttagatattacgtagaagaccaattgcgaaggcagctgtctgggtctttatcgacgctcaagcacgaaagcgtggggagcaaacagg

SEQ ID NO: 72 - DNA, 252 bp, Unknown
  Artificiall/Consensus sequence
tacgtagggggcaagcgttatccggaattattgggcgtaaagagtgcgtaggtggttacctaagcgcaaggtttaaattagaggctcaacctctacatgccttgcgaactgggctacttgagtgcaggaggggaaagcggaattcctagtgtagcggtgaaatgcgtagatattaggaggaacaccggcggcgaaggcggctttctggactgtaactgacactgaggcacgaaagcgtgggtagcaaacagg

SEQ ID NO: 73 - DNA, 253 bp, Unknown
  Artificiall/Consensus sequence
tacgtagggtgcgagcgttgtccggaattactgggcgtaaagagctcgtaggcggtttgtcacgtcgtctgtgaaatcctagggcttaaccctggacgtgcaggcgatacgggctgacttgagtactacaggggagactggaatttctggtgtagcggtggaatgcacagatatcaggaagaacaccgatggcgaaggcaggtctctgggtagtaactgacgctgaggagcgaaagcatgggtagcgaacagg

SEQ ID NO: 74 - DNA, 253 bp, Unknown
  Artificiall/Consensus sequence
tacgtaggtggcaagcgttgtccggatttactgggtgtaaagggcgcgtaggcgggatggcaagtcagatgtgaaatccatgggctcaacccatgaactgcatttgaaactgtcgttcttgagtatcggagaggcaagcggaattcctagtgtagcggtgaaatgcgtagatattaggaggaacaccagtggcgaaggcggcttgctggacgacaactgacgctgaggcgcgaaagcgtggggagcaaacagg

SEQ ID NO: 75 - DNA, 253 bp, Unknown
  Artificiall/Consensus sequence
tacgtaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccggtggcgaaagcggctctctggcttgtaactgacgctgaggctcgaaagcgtggggagcaaacagg

SEQ ID NO: 76 - DNA, 253 bp, Unknown
  Artificiall/Consensus sequence
tacgtaggtggcgagcgttgtccggaatgactgggcgtaaagggagcgtaggcggcacaacaagttaggagtgaaataccgtggcttaaccacggaactgcttttaaaactgttgagctagagtgatggagaggaaagcggaattcctagtgtagcggtggaatgcgtagatattaggaggaacaccagaggcgaaggcggctttctggacattaactgacgctgaggctcgaaagcgtggggagcaaacagg

SEQ ID NO: 77 - DNA, 253 bp, Unknown
  Artificiall/Consensus sequence
tacggaggatgcgagcgttatccggatttattgggtttaaagggtgcgtaggcggtttgttaagtcagcggtgaaatctagaggctcaacctcgaaactgccgttgaaactggcgaacttgagtgtagatgaggtaggcggaattcgtggtgtagcggtgaaatgcatagatatcacgaggaactccgattgcgaaggcagcttactaaggtacaactgacgctgaagcacgaaagcgtgggtatcaaacagg

SEQ ID NO: 78 - DNA, 253 bp, Unknown
  Artificiall/Consensus sequence
tacggaggatgcaagcgttatccggatttattgggtttaaagggtgcgtaggcggaattccaagtcagcggtgaaatctccatgctcaacatggacactgccgttgaaactggcgttctagagtgtaaatgaggtaggcggaatgcgtggtgtagcggtgaaatgcatagatatcacgcagaactccgattgcgaaggcagcctgctgggatacaactgacgctgaggcacgaaagcgtgggtatcgaacagg

SEQ ID NO: 79 - DNA, 253 bp, Unknown
  Artificiall/Consensus sequence
tacggaaggtccgggcgttatccggatttattgggtttaaagggagcgcaggccgccgtgcaagcgtgccgtgaaaagcagcggcccaaccgctgccctgcggcgcgaactgcttggcttgagtgcgccggaagcgggcggaattcgtggtgtagcggtgaaatgcttagatatcacgaagaaccccgattgcgaaggcagcccgctgtggcgccactgacgctgaggctcgaaggtgcgggtatcgaacagg

SEQ ID NO: 80 - DNA, 253 bp, Unknown
  Artificiall/Consensus sequence
tacgtaggtggcaagcgttgtccggatttactgggcgtaaagggagcgtaggcggatgtttaagtgggatgtgaaatactcgggctcaacttgagtgctgcattccaaactggatatctagagtgcaggagaggaaaggagaattcctagtgtagcggtgaaatgcgtagagattaggaagaataccagtggcgaaggcgcctttctggactgtaactgacgctgaggctcgaaagcgtggggagcaaacagg

SEQ ID NO: 81 - DNA, 253 bp, Unknown
  Artificiall/Consensus sequence
tacgtagggagcgagcgttgtccggatttactgggtgtaaagggtgcgtaggcggccgagcaagtcagttgtgaaaactatgggcttaacccataacgtgcaattgaaactgtccggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacagg

SEQ ID NO: 82 - DNA, 254 bp, Unknown
  Artificiall/Consensus sequence
caccggcagctctagtggtagcagtttttattgggcctaaagcgtccgtagccggtttaataagtctctggtgaaatcctgcagcttaactgtgggaattgctggagatactattagacttgagatcgggagaggttagaggtactcccagggtagaggtgaaattctgtaatcctgggaggaccgcctgttgcgaaggcgtctgactggaacgattctgacggtgagggacgaaagctaggggcgcgaaccgg

SEQ ID NO: 83 - DNA, 253 bp, Unknown
  Artificiall/Consensus sequence
tacgtagggagcgagcgttgtccggaattactgggtgtaaagggagtgtaggcgggactgcaagtcagatgtgaaatttaggggcttaacccctaaactgcatttgaaactgtggatcttgagtgaagtagaggtaagcggaattcctagtgtagcggtgaaatgcgtagatattaggaggaacatcagtggcgaaggcggcttactgggcttttactgacgctgaggctcgaaagcgtggggagcaaacagg

SEQ ID NO: 84 - DNA, 253 bp, Unknown
  Artificiall/Consensus sequence
tacggaggatgcgagcgttatccggatttattgggtttaaagggagcgcagacgggatgttaagtcagctgtgaaagtttgcggctcaaccgtaaaattgcagttgatactggcgttcttgagtgcagttgaggtgtgcggaattcgtggtgtagcggtgaaatgcttagatatcacgaagaactccgattgcgaaggcagctcactaaactgtaactgacgttcatgctcgaaagtgtgggtatcaaacagg

SEQ ID NO: 85 - DNA, 253 bp, Unknown
  Artificiall/Consensus sequence
tacgtagggggcaagcgttgtccggaatgattgggcgtaaagggcgcgtaggcggcctggtaagtttgaagtgaaagtccttcttttaaggagggaactgctttgaaaactgtcgggcttgagtgcaggagaggtaagcggaattcccggtgtagcggtgaaatgcgtagagatcgggaggaacaccagtggcgaaggcggcttactggactgttactgacgctgaggcgcgaaagtgtggggagcaaacagg

SEQ ID NO: 86 - DNA, 252 bp, Unknown
  Artificiall/Consensus sequence
tacggaggatgcgagcgttatccggatttattgggtttaaagggtgcgcaggcggcgtgccaagtcagcggtaaaaatgcggtgctcaacgccgtatagccgttgaaactgacatgctagagtgagcgagaagtatgcggaatgcgtggtgtagcggtgaaatgcatagatatcacgcagaaccccgattgcgaaggcagcataccggcgctcaactgacgctcaggcacgaaagtgcggggatcaaacagg

SEQ ID NO: 87 - DNA, 253 bp, Unknown
  Artificiall/Consensus sequence
tacgtagggggcaagcgttatccggatttactgggtgtaaagggagcgcaggcggatggctaagtctgatgtgaaagcccggggctcaaccccgggactgcattggaaactggttatcttgagtgtcggagaggtaagtggaattcctagtgtagcggtgaaatgcgtagatattaggaggaacaccagtggcgaaggcggcttactggacgacaactgacgctgaggctcgaaagcgtggggagcaaacagg

SEQ ID NO: 88 - DNA, 253 bp, Unknown
  Artificiall/Consensus sequence
tacgtatggagcgagcgttgtccggaattattgggcgtaaagggtgcgcaggcggctttacaagttggatgtgaaatattgtggctcaaccacaaacgtgcatccaaaactgcaaagcttgagttaaggagaggtaagtggaattcctggtgtagcggtggaatgcgtagatatcaggaggaataccggtggcgaaggcgacttactggacttaaactgacgctcaggcacgaaagcgtggggagcaaacagg

SEQ ID NO: 89 - DNA, 254 bp, Unknown
  Artificiall/Consensus sequence
tacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcctagtgtagcggtgaaatgcgtagatattaggaggaacaccagtggcgaaggcggctttctggactgacactgacgctgaggctcgaaagcgtggggagcaaacagg

SEQ ID NO: 90 - DNA, 253 bp, Unknown
  Artificiall/Consensus sequence
tacggagggtgcaagcgttatccggatttattgggtttaaagggtccgtaggtgggttggtaagtcagtggtgaaatcctgcagcttaactgtagaattgccattgatactgctagtcttgagtgtatttgaagtagctggaataagtagtgtagcggtgaaatgcatagatattacttagaacaccaattgcgaaggcaggttactaagatacaactgacgctgatggacgaaagcgtggggagcgaacagg

SEQ ID NO: 91 - DNA, 252 bp, Unknown
  Artificiall/Consensus sequence
tacgtagggggctagcgttgtccggaatcactgggcgtaaagggttcgcaggcggaaatgcaagtcaggtgtaaaaggcagtagcttaactactgtaagcatttgaaactgcatatcttgagaagagtagaggtaagtggaatttttagtgtagcggtgaaatgcgtagatattaaaaagaataccggtggcgaaggcgacttactgggctcattctgacgctgaggaacgaaagcgtgggtagcaaacagg

SEQ ID NO: 92 - DNA, 252 bp, Unknown
  Artificiall/Consensus sequence
tacgtaggtggcaagcgttgtccggaattattgggcgtaaagggagcgcaggtgggaaagtaagtctgtcttaaaagtgcggggctcaacctcgtgaggggatggaaactacttttcttgagtgcaggagaggaaagcggaattcctagtgtagcggtgaaatgcgtagatattaggaggaacaccagtggcgaaggcggctttctggactgtaactgacactgaggctcgaaagccaggggagcgaacggg

SEQ ID NO: 93 - DNA, 253 bp, Unknown
  Artificiall/Consensus sequence
tacgtagggagcaagcgttatccggatttactgggtgtaaagggcgtgtaggcgggacagcaagtcagatgtgaaaactatgggctcaacccatagcctgcatttgaaactgttgttcttgagtgctggagaggcaaatggaactcctagtgtagcggtgaaatgcgtagatattaggaagaacaccagtggcgaaggcgatttgctggacagtaactgacgctgatgcgcgaaagtgtggggagcaaacagg

SEQ ID NO: 94 - DNA, 253 bp, Unknown
  Artificiall/Consensus sequence
tacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaggaacaccgatggcgaaggcaggtctctgggctgtaactgacgctgagaagcgaaagcatggggagcgaacagg

SEQ ID NO: 95 - DNA, 253 bp, Unknown
  Artificiall/Consensus sequence
tacgtaggtggcgagcgttatccggaattactgggtgtaaagggtgtgtaggcgggacgacaagtcagatgtgaaaattgcaggctcaacctggaaagtgcatttgaaactgccgttcttgagagtcggagaggtaaatggaattcccggtgtagcggtgaaatgcgtagatatcgggaggaacaccagtggcgaaggcgatttactggacgacaactgacgctgagacacgaaagcgtggggagcaaacagg

SEQ ID NO: 96 - DNA, 253 bp, Unknown
  Artificiall/Consensus sequence
tacgtagggggcaagcgttatccggatttactgggtgtaaagggagcgtaggtggttcggcaagtctgatgtgaaagcccggggctcaaccccgggactgcattggaaactgtcggacttgagtgctggagaggtaagtggaattcctagtgtagcggtgaaatgcgtagatattaggaggaacaccagtggcgaaggcggcttactggacagtaactgacactgaggctcgaaagcgtggggagcaaacagg

SEQ ID NO: 97 - DNA, 252 bp, Unknown
  Artificiall/Consensus sequence
tacgtagggagcgagcgttatccggatttattgggcgtaaagcgtgcgtaggcggtttattaagtttaagatgaaaggctggggctcaactccagtttgtcttaaaaactggtaagcttgagtatggtagaggtaaatggaatttctagtgtagcggtggaatgcgtagatattagaaggaacaccagtggcgaaagcgatttactaggccaaaactgacgctgaggcacgaaagcgtggggagcaaatagg

SEQ ID NO: 98 - DNA, 253 bp, Unknown
  Artificiall/Consensus sequence
tacgaagggggcgagcgttgttcggaattactgggcgtaaagggtgtgtaggcggttaagtaagatagtggtgaaatgccggggctcaacctcggaattgccattatgactatttagctagaatgatgcagaggatagcggaatacccagtgtagaggtgaaattcgtagatattgggtagaacaccagaggcgaaggcggctatctgggcattgattgacgctgaggcacgaaagcatggggatcaaacagg

SEQ ID NO: 99 - DNA, 253 bp, Unknown
  Artificiall/Consensus sequence
tacggaggatgcgagcgttatccggatttattgggtttaaagggtgcgcaggcgggattttaagtcagcggtgaaattttcaggctcaacctgaacactgccgttgaaactgggattcttgagtatggatgaagtaggcggaattcgttgtgtagcggtgacatgcttagatataacgaggaactccgattgcgtaggcagcttactaagccataactgacgctcaagcacgaaagcgtggggatcaaacagg

SEQ ID NO: 100 - DNA, 253 bp, Unknown
  Artificiall/Consensus sequence
tacgtaggtggcaagcgttgtccggaatgattgggcgtaaagggcgcgcaggcggctgtgtaagtctgtccagaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacggg

SEQ ID NO: 101 - DNA, 253 bp, Unknown
  Artificiall/Consensus sequence
tacggaaggtcctggtgttatccggatttattgggtttaaagggagcgtaggccgtagattaagtgtgttgtgaaatgtaggcgcccaacgtctgccttgcagcgcaaactggtttacttgagtacgcgcaacgcaggcggaattcgtcgtgtagcggtgaaatgcttagatatgacgaagaactcctattgcgaaggcagcttgcgggagcgttactgacgctgaagctcgaaagtgcgggtatcgaacagg

SEQ ID NO: 102 - DNA, 253 bp, Unknown
  Artificiall/Consensus sequence
tacgtaggtggcaagcgttgtccggatttactgggtgtaaagggcgtgcagccgggccggcaagtcagatgtgaaatccacgggcttaacccgtgaactgcatttgaaactgttggtcttgagtatcggagaggtaatcggaattccttgtgtagcggtgaaatgcgtagatataaggaagaacaccagtggcgaaggcggattactggacgacaactgacggtgaggcgcgaaagcgtggggagcaaacagg

SEQ ID NO: 103 - DNA, 253 bp, Unknown
  Artificiall/Consensus sequence
tacggaggattcaagcgttatccggatttattgggtttaaagggtgcgtaggcggttagataagttagaggtgaaataccggtgcttaacaccggaactgcctctaatactgtttagctagagaatagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 104 - DNA, 252 bp, Unknown
  Artificiall/Consensus sequence
tacgtagggggcgagcgttatccggaattattgggcgtaaagagtgcgtaggtggtaacttaagcgcggggtttaaggcaatggcttaaccattgttcgccctgcgaactgggatacttgagtgcaggagaggaaagcggaattcctagtgtagcggtgaaatgcgtagatattaggaggaacaccagtggcgaaggcggctttctggactgaaactgacactgaggcacgaaagtgtggggagcaaacagg

SEQ ID NO: 105 - DNA, 253 bp, Unknown
  Artificiall/Consensus sequence
tacgtagggagcgagcgttatccggatttattgggtgtaaagggtgcgtagacgggagtctaagttagttgtgaaatccctcggctcaactgaggaactgcaactaaaactggatttcttgagtgcaggagaggaaagcggaattcctagtgtagcggtgaaatgcgtagatattaggaggaacaccagtggcgaaggcggctttctggactgtaactgacgttgatgcacgaaagtgtggggagcaaacagg

SEQ ID NO: 106 - DNA, 252 bp, Unknown
  Artificiall/Consensus sequence
tacgtatggaccgagcgttgtccggaatcattgggcgtaaagggtacgtaggcggcctagtaagttagaagtgaaataatatagctcaactatataaagcttttaaaactgttaggcttgagagatgaaagggaaagtggaattcctagtgtagcggtgaaatgcgcagatattaggaagaataccggtggcgaaggcgactttctggtcatcatctgacgctgaggtacgaaagcgtgggtagcaaacagg

SEQ ID NO: 107 - DNA, 252 bp, Unknown
  Artificiall/Consensus sequence
tacgtaggtggcgagcgttatccggaatcattgggcgtaaagggtgcgtaggtggcacgataagtctgtagtaaaaggcagcggctcaaccgctgttggctatggaaactgtcgagctggagtgcagaagagggcgatggaattccatgtgtagcggtaaaatgcgtagatatatggaggaacaccagtggcgaaggcggccgcctggtctgcaactgacactgaagcacgaaagcgtggggagcaaatagg

SEQ ID NO: 108 - DNA, 253 bp, Unknown
  Artificiall/Consensus sequence
tacgtaggtggcaagcgttgtccggatttattgggcgtaaagcgagtgcaggcggctcgataagtctgatgtgaaagccttcggctcaaccggagaattgcatcagaaactgtcgagcttgagtacagaagaggagagtggaactccatgtgtagcggtgaaatgcgtagatatatggaagaacaccggtggcgaaggcggctctctggtctgttactgacgctgaggctcgaaagcatgggtagcgaacagg

SEQ ID NO: 109 - DNA, 254 bp, Unknown
  Artificiall/Consensus sequence
tacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacagg

SEQ ID NO: 110 - DNA, 253 bp, Unknown
  Artificiall/Consensus sequence
tacggaggatgcgagcgttatccggatttattgggtttaaagggtgcgtaggtggcccgatcagtcagcggtgaaagtttgtcgctcaacgataaaattgccgttgaaactgtcgggcttgagtatgtttgaggtaggcggaatgcgtggtgtagcggtgaaatgcatagatatcacgcagaactccgattgcgaaggcagcttactaaaccataactgacactgaagcacgaaagcgtgggtatcaaacagg

SEQ ID NO: 111 - DNA, 253 bp, Unknown
  Artificiall/Consensus sequence
tacggagggtgcgagcgttaatcggaattactgggcgtaaagcgcacgtaggctgtatgtcaagtcaagggtgaaatcccacggctcaaccgtggaactgcctttgaaactggcaaactggagtatgtgagagggcggcggaattcctggtgtaggagtgaaatccgtagatatcaggaggaacatcagtggcgaaggcggccgcctggcacaaaactgacgctgaggtgcgaaagcgtgggtagcaaacagg

SEQ ID NO: 112 - DNA, 253 bp, Unknown
  Artificiall/Consensus sequence
tacgtaggtggcaagcgttgtccggatttattgggcgtaaagcgagcgcaggcggaagaataagtctgatgtgaaagccctcggcttaaccgaggaattgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacagg

SEQ ID NO: 113 - DNA, 253 bp, Unknown
  Artificiall/Consensus sequence
tacgtatggggcgagcgttgtccggaattattgggcgtaaagggtacgcaggcggtttaccaagttggatgtgaaatcttgtagctcaactacaaacgtgcatccaaaactggctaacttgagttaaggagaggtaagtggaattcctggtgtagcggtggaatgcgtagatatcaggaggaataccggtggcgaaggcgacttactggacttatactgacgctgaggtacgaaagcgtggggagcaaacagg

SEQ ID NO: 114 - DNA, 253 bp, Unknown
  Artificiall/Consensus sequence
aacgtaggtggcaagcgttgtccggaattactgggtgtaaagggagcgcaggcgggtctgcaagttggaagtgaaacccatgggctcaacccatgaactgctttcaaaactgtggatcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacagg

SEQ ID NO: 115 - DNA, 253 bp, Unknown
  Artificiall/Consensus sequence
tacgtaggtggcaagcgttgtccggaattactgggtgtaaagggtgcgcaggcgggattgcaagttggatgtgaaataccggggcttaaccccggagctgcatccaaaactgtagttcttgagtggagtagaggtaagcggaattccgagtgtagcggtgaaatgcgtagatattcggaggaacaccagtggcgaaggcggcttactgggctctaactgacgctgaggcacgaaagcatgggtagcaaacagg

SEQ ID NO: 116 - DNA, 253 bp, Unknown
  Artificiall/Consensus sequence
tacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacagg

SEQ ID NO: 117 - DNA, 253 bp, Unknown
  Artificiall/Consensus sequence
tacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaattcctggtgtagcggtggaatgcgcagatatcaggaggaacaccgatggcgaaggcaggtctctgggctgtaactgacgctgagaagcgaaagcatggggagcgaacagg

SEQ ID NO: 118 - DNA, 253 bp, Unknown
  Artificiall/Consensus sequence
tacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 119 - DNA, 252 bp, Unknown
  Artificiall/Consensus sequence
tacgtagggggcgagcgttgttcggaattattgggcgtaaagggtacgtaggcggtttgttaagtttggcgttaaatcacggggctcaaccccgttcagcgttgaaaactggcaaacttgagtagtagaggggacagtggaattcctagtgtagcggtgaaatgcgtagagattaggaagaataccggtggcgaaggcgactgtctggatacatactgacgctcaggtacgaaagcgtggggagcaaacagg

SEQ ID NO: 120 - DNA, 253 bp, Unknown
  Artificiall/Consensus sequence
tacgtaggtggcgagcgttatccggaattactgggtgtaaagggtgtgtaggcggggtgtcaagtcagatgtgaaaactgtgggctcaacccacaaactgcatttgaaactgatactcttgagagtgggagaggtaaacggaattcctggtgtagtagtgaaatgcgtagatatcaggaggaacaccggtggcgaaggcggtttactggaccacaactgacgctgagacacgaaagcgtggggagcaaacagg

SEQ ID NO: 121 - DNA, 253 bp, Unknown
  Artificiall/Consensus sequence
tacgtagggggcgagcgttgtccggaatgactgggcgtaaagggcgcgtaggcggctgtgtaagtctggagtgaaagtcctgcttttaaggtgggaattgctttggagactgcatggcttgagtgcggaagaggcaagtggaattcccagtgtagcggtgaaatgcgtagagattgggaagaacaccagtggcgaaggcgacttgctgggccgtaactgacgctgaggcgcgaaagcgtggggagcgaacagg

SEQ ID NO: 122 - DNA, 253 bp, Unknown
  Artificiall/Consensus sequence
tacgtagggggcgagcgttgtccggaattattgggcgtaaagggcgcgtagacggctgagtaagttactggtgaaagcccagcttttaaggctggaattgccggtaatactgttcagcttgagtgcaggagagggaagcggaattcctagtgtagcggtgaaatgcgtagatattaggaggaacaccagtggcgaaggcggctttctggactgtaactgacgttgaggcgcgaaagcgtggggagcaaacagg

SEQ ID NO: 123 - DNA, 253 bp, Unknown
  Artificiall/Consensus sequence
aacgtaggtggcaagcgttgtccggaattactgggtgtaaagggagcgcaggcggggaggcaagttggaagtgaaaagcgtgggctcaacccacgacctgctttcaaaactgtctctcttgagtagtgcagaggtaagcggaattcccggtgtagcggtggaatgcgtagatatcgggaggaacaccagtggcgaaggcggcttactgggcaccaactgacgctgaggctcgaaagcatgggtagcaaacagg

SEQ ID NO: 124 - DNA, 253 bp, Unknown
  Artificiall/Consensus sequence
tacgtagggggcaagcgttatccggatttactgggtgtaaagggagcgtagacggtattgcaagtctgaagtgaaatcccggggctcaaccccggagctgctttggaaactgtaaaactagagtgctggagaggtaagcggaattcctagtgtagcggtgaaatgcgtagatattaggaggaacaccagtggcgaaggcggcttactggacagtcactgacgttgaggctcgaaagcgtggggagcaaacagg

SEQ ID NO: 125 - DNA, 253 bp, Unknown
  Artificiall/Consensus sequence
tacgtagggggcgagcgttgtccggaattactgggcgtaaagggtgcgtaggcggtctattaagttggatgtgaaatccccgggcttaacttggggtctgcatccaatactgggagactagagtgcaggagagggaagcggaattcctagtgtagcggtgaaatgcgtagatattaggaggaacaccagtggcgaaggcggctttctggactgtaactgacgctgaggcacgaaagcgtggggagcaaacagg

SEQ ID NO: 126 - DNA, 253 bp, Unknown
  Artificiall/Consensus sequence
tacgtaggtggcgagcgttgtccggatttactgggtgtaaagggcgtgtaggcgggcttgcaagtcagatgtgaaataccggggcttaaccccggagctgcatttgaaactgtaggtcttgagtatcggagaggaaagcggaattcctagtgtagcggtgaaatgcgtagatattaggaggaacaccagtggcgaaggcggctttctggacgaaaactgacgctgaggcgcgaaagcatggggagcaaacagg

SEQ ID NO: 127 - DNA, 253 bp, Unknown
  Artificiall/Consensus sequence
tacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacagg

SEQ ID NO: 128 - DNA, 253 bp, Unknown
  Artificiall/Consensus sequence
aacgtaggtggcaagcgttgtccggaattactgggtgtaaagggagcgcaggcgggtcggcaagttggaggtgaaagctgtgggctcaactcacaaactgccttcaaaactgccggtcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacagg

SEQ ID NO: 129 - DNA, 252 bp, Unknown
  Artificiall/Consensus sequence
tacgtagggagcgagcgttatccggatttattgggtgtaaagggtgcgtaggcggtttaacaggtctgtggtctaagtccgaagcttaacttcggttcgccacagaaaccgttttacttgagtatggtagaggcaagtggaatttctagtgtagcggttaaatgcgtagatattagaaggaacaccagtggcgaaggcgacttgctgggccatcactgacgctgaggcacgaaagcgtggggagcaaatagg

SEQ ID NO: 130 - DNA, 253 bp, Unknown
  Artificiall/Consensus sequence
tacgtagggggcaagcgttatccggaattactgggtgtaaagggtgcgtaggtggcgatgtaagtcagatgtgaaaactcagggctcaaccttgagactgcatctgaaactgtgttgctagagtgcaggagaggaaagcggaattccgagtgtagcggtgaaatgcgtagatattcggaggaacaccagtagcgaaggcggctttctggactgtaactgacactgaggcacgaaagcgtggggagcgaacagg

SEQ ID NO: 131 - DNA, 253 bp, Unknown
  Artificiall/Consensus sequence
tacgtagggagcaagcgttgtccggatttactgggtgtaaagggtgcgtaggcggaagagcaagtcagtagtgaaatctgggggcttaacccccaaactgctattgaaactgtttttcttgagtggagtagaggtaggcggaattcccggtgtagcggtgaaatgcgtagagatcgggaggaacaccagtggcgaaggcggcctactgggctctaactgacgctgaggcacgaaagtgtgggtagcaaacagg

SEQ ID NO: 132 - DNA, 253 bp, Unknown
  Artificiall/Consensus sequence
tacgtaggtggcgagcgttatccggatttactgggcgtaaaggatgcgtaggtggaattttaagtgggatgtgaaatacccgggctcaacctgggaactgcattccaaactggaattctagagtgcaggagaggaaagcggaattcctagtgtagcggtgaaatgcgtagagattaggaagaacaccagtggcgaaggcggctttctggactgtaactgacactgaggcatgaaagcgtggggagcaaacagg

SEQ ID NO: 133 - DNA, 253 bp, Unknown
  Artificiall/Consensus sequence
tacgtaggtggcaagcgttatccggatttattgggtgtaaagggtgtgtaggcgggactgcaagtcagacgtgaaaatcatgggctcaacccatgacttgcgtttgaaactgcggttcttgagagtgggagaggtaaacggaattcctggtgtagcggtgaaatgcgtagatatcaggaggaacaccggtggcgaaggcggtttactggaccacaactgacgctgagacacgaaagcgtggggagcaaacagg

SEQ ID NO: 134 - DNA, 253 bp, Unknown
  Artificiall/Consensus sequence
tacgtatggtgcaagcgttatccggatttactgggtgtaaagggtgcgtaggtggcaaggcaagtctgaagtgaaaatccggggctcaaccccggaactgctttggaaactgtttagctggagtacaggagaggtaagtggaattcctagtgtagcggtgaaatgcgtagatattaggaggaacaccagtggcgaaggcgacttactggactgctactgacactgaggcacgaaagcgtggggagcaaacagg

SEQ ID NO: 135 - DNA, 252 bp, Unknown
  Artificiall/Consensus sequence
tacgtagggggcgagcgttatccggaattattgggcgtaaagagtgcgtaggtggcaccttaagcgcagggtttaaggcaatggctcaaccattgttcgccttgcgaactggggtgcttgagtgcaggaggggaaagtggaattcctagtgtagcggtgaaatgcgtagatattaggaggaacaccagtggcgaaggcgactttctggactgttactgacactgaggcacgaaagcgtggggagcaaacagg

SEQ ID NO: 136 - DNA, 253 bp, Unknown
  Artificiall/Consensus sequence
tacgtaggtggcaagcgttgtccggaattactgggtgtaaagggagcgtaggcgggaaggcaagtcagatgtgaaatccacaggcttaacctgtggcgtgcatttgaaactgtttttcttgagtgaagtagaggcaggcggaattccgagtgtagcggtgaaatgcgtagatattcggaggaacaccagtggcgaaggcggcctgctgggcttttactgacgctgaggctcgaaagcatgggtagcaaacagg

SEQ ID NO: 137 - DNA, 253 bp, Unknown
  Artificiall/Consensus sequence
tacgtagggggcaagcgttgtccggaatgactgggcgtaaagggcgcgtaggcggctttttaagttagaagtggaagtcctgcttttaaggtgggaattgcttttaatactggaaggcttgagtgcagaagaggtaagtggaattcccagtgtagcggtgaaatgcgtagagattgggaagaacaccagtggcgaaggcgacttactgggctgtaactgacgctgaggcgcgaaagcgtggggagcaaacagg

SEQ ID NO: 138 - DNA, 253 bp, Unknown
  Artificiall/Consensus sequence
tacgggggatgcgagcgttatccggattcattgggtttaaagggtgcgtaggctgtgcgtcaagtcgggggtgaaattccggtgctcaacaccggggctgcccttgatactgtcgcgctggagtgcggatgccgccggaggaatgagtggtgtagcggtgaaatgcttagatatcactcagaacaccgattgcgaaggcatctggcgaatccgtaactgacgctgaggcacgaaagcgtggggatagaacagg

SEQ ID NO: 139 - DNA, 253 bp, Unknown
  Artificiall/Consensus sequence
tacctgcagcccaagtggtggtcgattttattgagtctaaaacgttcgtagccggtctggtaaatccttgggtaaatcgggaagcttaactttccgacttccgaggagactgccagacttgggaccgggagaggcaagaggtacttctggggtaggggtaaaatcctgtaatcctagaaggaccaccggtggcgaaggcgtcttgctagaacggatccgacggtgagggacgaagccctgggtcgcaaacggg

SEQ ID NO: 140 - DNA, 253 bp, Unknown
  Artificiall/Consensus sequence
tacgtagggagcaagcgttatccggatttactgggtgtaaagggtgcgtaggcggcttgttaagtcaaaagtgaaatttcggggctcaaccccggagctgcttttgaaactggcgagctagagtgtgggagaggaaagtggaactttgagtgtagcggtgaaatgcgtagagattcaaaggaacaccagtagcgaaggcggctttctggaccattactgacgctgaggcacgaaagcgtggggagcaaacagg

SEQ ID NO: 141 - DNA, 252 bp, Unknown
  Artificiall/Consensus sequence
tacgtatggggcaagcgttatccggaattattgggcgtaaagagtgcgtaggtggtggcttaagcgcagggtttaaggcaatggcttaactattgttcgccttgcgaactgggtcacttgagtacaggagagggaagcggaattcctagtgtagcggtgaaatgcatagatattaggaggaacaccggtggcgaaggcggctttctggactgcaactgacactgaggcacgaaagcgtgggtagcaaacagg

SEQ ID NO: 142 - DNA, 253 bp, Unknown
  Artificiall/Consensus sequence
tacgtagggagcaagcgttatccggaattactgggtgtaaagggagtgtaggcgggactgcaagtcagatgtgaaaattatgggctcaactcataacctgcatttgaaactgtagttcttgagtgaagtagaggtaagcggaattcctagtgtagcggtgaaatgcgtagatattaggaggaacatcagtggcgaaggcggcttactgggcttttactgacgctgaggctcgaaagcgtggggagcaaacagg

SEQ ID NO: 143 - DNA, 253 bp, Unknown
  Artificiall/Consensus sequence
tacgtaggtggcgagcgttgtccggaattactgggtgtaaagggcgcgtagacgggtagataagttagatgtgaaataccggggcttaactccggggctgcatttaaaactgtttatcttgagtgcaggagagggaagcggaattcctagtgtagcggtgaaatgcgtagatattaggaggaacaccagtggcgaaggcggctttctggactgtaactgacgttgaggcgcgaaagcgtgggtagcaaacagg

SEQ ID NO: 144 - DNA, 253 bp, Unknown
  Artificiall/Consensus sequence
tacgtaggtggcgagcgttgttcggattcattgggcgtaaagggtccgcaggtggtctgataagtctgacgtgaaataccggagctcaactccggaactgcgttggagactgttggacttgagtatcggagaggaaattggaattccaggtgtagcggtggaatgcgtagatatctggaagaacatcgaaagcgaaggcagatttctggacgataactgacactcagggacgaaagcatggggagcaaacagg

SEQ ID NO: 145 - DNA, 252 bp, Unknown
  Artificiall/Consensus sequence
tacgtaggtggcaagcgttgtccggaattattgggcgtaaagcgcgcgcaggcggatctgccagtctgtcttaaaagttcggggctcaaccccgtgatgggatggaaactacagatctagagtatcggaggggaaagtggaattcctagtgtagcggtgaaatgcgtagatattaggaggaacaccagtggcgaaggcgactttctggacgatcactgacgctgaggcgcgaaagccaggggagcgaacggg

SEQ ID NO: 146 - DNA, 253 bp, Unknown
  Artificiall/Consensus sequence
tacgtagggagcgagcgttgtccggatttactgggtgtaaagggcgcgtaggcgggcctgcaagtcagatgtgaaataccggggcttaaccccggggctgcatttgaaactgtgggtcttgagtgcgggagaggaaagcggaattcctagtgtagcggtgaaatgcgtagatattaggaggaacaccggtggcgaaggcggctttctggaccgtaactgacgctgaggcgcgaaagtgtggggagcaaacagg

SEQ ID NO: 147 - DNA, 253 bp, Unknown
  Artificiall/Consensus sequence
tacgtagggagcaagcgttgtccggatttactgggtgtaaagggtgcgtaggcggcaatgcaagtcagatgtgaaatgcacgggctcaacccgtgagctgcatttgaaactgtgttgcttgagtgaggtagaggcaggcggaattcccggtgtagcggtgaaatgcgtagagatcgggaggaacaccagtggcgaaggcggcctgctgggccttaactgacgctgatgcacgaaagcgtgggtagcaaacagg

SEQ ID NO: 148 - DNA, 253 bp, Unknown
  Artificiall/Consensus sequence
tacgtagggagcgagcgttatccggatttattgggtgtaaagggtgcgtagacggacttacaagttagttgtgaaatccctcggcttaactgaggaactgcaactaaaactgtaagccttgagtgcaggagaggtaagtggaattcctagtgtagcggtgaaatgcgtagatattaggaggaacaccagtggcgaaggcgacttactggactgtaactgacgttgaggcacgaaagtgtggggagcaaacagg

SEQ ID NO: 149 - DNA, 252 bp, Unknown
  Artificiall/Consensus sequence
tacgtaggtcccgagcgttgtccggaattattgggcgtaaagcgcgcgcaggcggatcagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 150 - DNA, 252 bp, Unknown
  Artificiall/Consensus sequence
tacggaggatgcgagcgttatccggatttattgggtttaaagggtgcgtaggcggtccgttaagtcagcggtaaaattgcggggctcaaccccgtcgagccgttgaaactggcagacttgagttggcgagaagtacgcggaatgcgcggtgtagcggtgaaatgcatagatatcgcgcagaactccgattgcgaaggcagcgtaccggcgccagactgacgctgaggcacgaaagcgtggggatcgaacagg

SEQ ID NO: 151 - DNA, 253 bp, Unknown
  Artificiall/Consensus sequence
tacgtagggtccgagcgttatccggatttactgggtgtaaagggcgagtagacggaactgcaagtcagatgtgaaatgctagagctcaactttagaactgcatctgaaactgtggaactagagtgcaggagaggtaagcggaattcctagtgtagcggtgaaatgcgtagatattaggaggaacaccagtggcgaaggcggcttactggactgtaactgacgttgaggcgcgaaagtgtggggagcaaacagg

SEQ ID NO: 152 - DNA, 253 bp, Unknown
  Artificiall/Consensus sequence
tacgtaggtggcaagcgttatccggatttactgggtgtaaagggtgtgtaggcgggactgcaagtcagatgtgaaaatcatgggctcaactcatgacctgcatttgaaactgtggttcttgagagtcggaggggtaatcggaattcccggtgtagcggtgaaatgcgtagatatcgggaggaacaccagtggcgaaggcggattactggacgaccactgacgctgagacacgaaagcgtggggagcaaacagg

SEQ ID NO: 153 - DNA, 253 bp, Unknown
  Artificiall/Consensus sequence
tacgtagggagcgagcgttgtccggaatgactgggtgtaaagggagcgtaggcgggatggcaagtcagatgtgaaacctgagggctcaaccttcagactgcatttgaaactgctgttcttgagtgaagtagaggtaagcggaattcctggtgtagcggtgaaatgcgtagagatcaggaggaacatcggtggcgaaggcggcttactgggcttttactgacgctgaggctcgaaagcgtggggagcaaacagg

SEQ ID NO: 154 - DNA, 253 bp, Unknown
  Artificiall/Consensus sequence
tacgtagggtgcgagcgttaatcggaattactgggcgtaaagggtgtgcaggcggctgagtaagacagatgtgaaatccccgggcttaacctgggaaccgcatatgtgactgcttggctagagtgcgtcagagggaggtggaattccacgtgtagcagtgaaatgcgtagatatgtggaagaacaccgatggcgaaggcagcctcctgggacgcaactgacgctcatacacgaaagcgtggggagcaaacagg

SEQ ID NO: 155 - DNA, 253 bp, Unknown
  Artificiall/Consensus sequence
tacgtaggtggcaagcgttgtccggatttattgggcgtaaagcgagcgcaggcggattgataagtctgatgtgaaagccttcggctcaaccgaagaactgcatcagaaactgtcaatcttgagtgcagaagaggagagtggaactccatgtgtagcggtggaatgcgtagatatatggaagaacaccagtggcgaaggcggctctctggtctgtaactgacgctgaggctcgaaagcatgggtagcgaacagg

SEQ ID NO: 156 - DNA, 253 bp, Unknown
  Artificiall/Consensus sequence
tacgtagggggcaagcgttatccggatttactgggtgtaaagggagcgtagacggcagcacaagtctggagtgaaatcccggggcttaaccccggaactgctttggaaactgtgcggctggagtgcaggaggggtaagcggaattcctagtgtagcggtgaaatgcgtagatattaggaggaacaccggtggcgaaggcggcttactggactgtaactgacgttgaggctcgaaagcgtggggagcaaacagg

SEQ ID NO: 157 - DNA, 253 bp, Unknown
  Artificiall/Consensus sequence
tacggaaggtcccggcgttatccggatttattgggtttaaagggagcgcagactgcttgtcaagcgtgcagtgaaacgccgtggcccaaccacggtcctgctgcgcgaactggcttgcttgagtgggccgtaggtacgcggaattcgtggtgtagcggtgaaatgcttagatatcacgaggaactccgattgcgaaggcagcgtaccatatcccgactgacgtttaggctcgaaggtgcgggtatcgaacagg

SEQ ID NO: 158 - DNA, 253 bp, Unknown
  Artificiall/Consensus sequence
tacgtagggagcaagcgttatccggatttattgggtgtaaagggtgcgtagacgggaatgcaagttggttgtgaaatccctcggctcaaccgaggaattgcaaccaaaactatatttcttgagtgctggagaggaaagtggaattcctagtgtagcggtgaaatgcgtagatattaggaggaacaccagtggcgaaggcgactttctggacagtaactgacgttgaggcacgaaagtgtggggagcaaacagg

SEQ ID NO: 159 - DNA, 253 bp, Unknown
  Artificiall/Consensus sequence
tacgtagggagcaagcgttgtccggaattactgggtgtaaagggtgcgtaggcgggactgcaagtcaggtgtgaaaacggtcggctcaaccgatcgcctgcacttgaaactgtggttcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacagg

SEQ ID NO: 160 - DNA, 253 bp, Unknown
  Artificiall/Consensus sequence
tacgtagggggcgagcgttgtccggaattattgggcgtaaagggcgtgtagacggttttataagttacaggtgaaagcccatttttcaaggatggaactgcctgtaagactgtaggacttgagtgcaggagagggaagcggaattccaagtgtagcggtgaaatgcgtagatatttggaggaacaccagtggcgaaggcggctttctggactgcaactgacgttgaggcgcgaaagcgtggggagcgaacagg

SEQ ID NO: 161 - DNA, 253 bp, Unknown
  Artificiall/Consensus sequence
tacggagggtgcaagcgttgtccggaatcattgggcgtaaagagttcgtaggtggcatgtaaagtctggtgttaaagactgaggcttaacctcagtacggcactggatacttgcaagctagaatgcggtagaggtaaagggaattcctggtgtagcggtgaaatgcttagatatcaggaggaacatcggtggcgtaagcgctttactgggccgtgattgacactgaggaacgaaagccagggtagcaaatggg

SEQ ID NO: 162 - DNA, 253 bp, Unknown
  Artificiall/Consensus sequence
tacgtagggggcaagcgttgtccggaatgactgggcgtaaagggagtgtaggcggcttggcaagttagatgtgaaagcccgcagctcaactgcggaactgcatctaaaactgtcaggcttgagtgcaggagaggtaagtggaattcctagtgtagcggtggaatgcgtagatattaggaggaacaccagaggcgaaggcgacttactggactgtaactgacgctgaggctcgaaagcgtggggagcaaacagg

SEQ ID NO: 163 - DNA, 253 bp, Unknown
  Artificiall/Consensus sequence
tacggggggtgcaagcgttgtccggaatcattgggcgtaaagagttcgtaggcggcatgtcaagtctggtgttaaatcctgaggctcaacttcagttcagcactggatactggcaagctagaatgcggtagaggtaaagggaattcctggtgtagcggtgaaatgcgtagatatcaggaagaacaccggtggcgtaagcgctttactgggccgttattgacgctgaggaacgaaagccgggggagcgaatggg

SEQ ID NO: 164 - DNA, 253 bp, Unknown
  Artificiall/Consensus sequence
tacgtagggggcaagcgttatccggatttactgggtgtaaagggagcgtagacggatgtgcaagtctgaagtgaaagcccggggctcaaccccgggactgctttggaaactgtgtatctagagtgccggagaggtaagcggaattcccagtgtagcggtgaaatgcgtagatattgggaggaacaccagtggcgaaggcggcttactggacggtaactgacgttgaggctcgaaagcgtggggagcaaacagg

SEQ ID NO: 165 - DNA, 252 bp, Unknown
  Artificiall/Consensus sequence
tacgtagggggcgagcgttatccggaatgattgggcgtaaagcgcgcgcaggcggccgctcaagcgggacctctaaccccggggctcaaccccgggccgggtcccgaactgggcggctcgagtgcggtaggggagagcggaattccaagtgtagcggtgaaatgcgcagatatttggaagaacaccgatggcgaaggcagctctctgggccgtcactgacgctgaggcgcgaaagccgggggagcgaacagg

SEQ ID NO: 166 - DNA, 252 bp, Unknown
  Artificiall/Consensus sequence
tacgaaggttgcaagcgttatccggaattattgggcgtaaagagtgagcaggcggcttattaagtttgaagtcaaatcgttgggctcaacccaatctcgcttcaaaaactgataggctagagtatgtgagaggtaagtagaactccatgtgtagcggtgaaatgcgtagatatatggaagaataccagtggcgaaggcggcttaccagcacaatactgacgctcagtcacgaaagcatagggagcaaatagg

SEQ ID NO: 167 - DNA, 253 bp, Unknown
  Artificiall/Consensus sequence
tacggaaggtccaggcgttatccggatttattgggtttaaagggagcgtaggctgccgtttaagcgtgttgtgaaatgtaccggctcaaccggtgatgtgcagcgcgaactggatggcttgagtacgaagagggaatgcggaactcgtggtgtagcggtgaaatgcttagatatcacgaggaactccgatcgcgaaggcagcattccgtttcgtgactgacgctgatgctcgaaagtgcgggtatcgaacagg

SEQ ID NO: 168 - DNA, 253 bp, Unknown
  Artificiall/Consensus sequence
tacgaagggtgcaagcgttaatcggaattactgggcgtaaagcgcgcgtaggtggtttggtaagatggatgtgaaatccccgggctcaacctgggaactgcatccataactgcctgactagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 169 - DNA, 253 bp, Unknown
  Artificiall/Consensus sequence
tacggaaggtccgggcgttatccggatttattgggtttaaagggagcgtaggccgcgttttaagcgtgttgtgaaatgtagacgcccaacgtctgcatcgcagcgcgaactgggacgcttgagtacgcgcaacgttggcggaattcgtcgtgtagcggtgaaatgcttagatatgacgaggaactccgattgcgaaggcagctgacgggagcggcactgacgcttaagctcgaaggtgcgggtatcaaacagg

SEQ ID NO: 170 - DNA, 252 bp, Unknown
  Artificiall/Consensus sequence
tacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacagg

SEQ ID NO: 171 - DNA, 253 bp, Unknown
  Artificiall/Consensus sequence
tacgtagggggcgagcgttgtccggaatgactgggcgtaaagggcgtgtaggcggccgactaagtctgatgtgaaatacccgcttttaaggtgggtcgtgcattggaaactggatggctagagtgcggaagaggtaagtggaattcccagtgtagcggtgaaatgcgtagagattgggaggaacaccagtggcgaaggcgacttactgggccgcaactgacgctgaggcgcgaaagcgtggggagcaaacagg

SEQ ID NO: 172 - DNA, 253 bp, Unknown
  Artificiall/Consensus sequence
tacgtaggtggcaagcgttgtccggatttactgggtgtaaagggcgtgtagccgggctgataagtcagatgtgaaatctggaggctcaacctccaaactgcatttgaaactgtcggtcttgagtatcggagaggtaaccggaattcctagtgtagcggtgaaatgcgtagatattaggaagaacaccagtggcgaaggcgggttactggacgacaactgacggtgaggcgcgaaagcgtggggagcaaacagg

SEQ ID NO: 173 - DNA, 253 bp, Unknown
  Artificiall/Consensus sequence
tacgtaggtggcgagcgttgtccggaattactgggcgtaaagggcgcgtaggcggatcgttaagttggacgtgaaataccccggctcaactggggggcgacgtccaaaactggcggactagagtgcaggagaggaaagtagaattcccagtgtagcggtgaaatgcgtagatattgggaggaataccggtggcgaaggcggctttctggactgtaactgacgctgaggcgcgaaagctgggggagcgaacagg

SEQ ID NO: 174 - DNA, 253 bp, Unknown
  Artificiall/Consensus sequence
tacgtaggtggcgagcgttatccggatttactgggtgtaaagggtgtgtaggcgggactgcaagtcagatgtgaaaactatgggctcaactcatagcttgcatttgaaactgtggttcttgagggtcggagaggtaactggaattcccggtgtagcggtgaaatgcgtagatatcgggaggaacaccagtggcgaaggcgagttactggacgatacctgacgctgagacacgaaagtgtggggagcaaacagg

SEQ ID NO: 175 - DNA, 253 bp, Unknown
  Artificiall/Consensus sequence
tacgtagggagcgagcgttgtccggaattactgggtgtaaagggagcgtaggcgggacagcaagttgaatgtgaaatctatgggctcaacccataaactgcgttcaaaactgttgttcttgagtgaagtagaggtaggcggaattcctagtgtagcggtgaaatgcgtagatattaggaggaacaccagtggcgaaggcggcctactgggctttaactgacgctgaggctcgaaagcgtgggtagcaaacagg

SEQ ID NO: 176 - DNA, 253 bp, Unknown
  Artificiall/Consensus sequence
tacgtagggcgcgagcgttgtccggatttattgggcgtaaagagctcgtaggtggttcgtcgcgtctgtcgtgaaagccagcagcttaactgttggtctgcggtgggtacgggcgggcttgagtgcggtaggggtgactggaattcctggtgtagcggtggaatgcgcagatatcaggaggaacaccgatggcgaaggcaggtcactgggccgttactgacactgaggagcgaaagcgtggggagcgaacagg

SEQ ID NO: 177 - DNA, 253 bp, Unknown
  Artificiall/Consensus sequence
tacgtagggggcaagcgttatccggatttactgggtgtaaagggagcgtaggtggtctggcaagtcagatgtgaaaacccggggcttaactccgggattgcatttgaaactgttagactagagtgcaggagaggtaagtggaattcctagtgtagcggtgaaatgcgtagatattaggaggaacaccagtggcgaaggcggcttactggactgtaactgacactgaggctcgaaagcgtggggagcaaacagg

SEQ ID NO: 178 - DNA, 253 bp, Unknown
  Artificiall/Consensus sequence
tacccgcgccccaagtggtggtcgatattattgagcctaaaacgtccgtagccggttttctaaatccttgggtaaatcgggcagcttaactgtccgaattccggggagactgggagacttgggaccgggagaggtcagaggtacttctggggtaggggtaaaatcctgtaatcctggaaggaccaccggtggcgaaggcgtctgactagaacggatccgacggtgagggacgaagccctggggcgcaaacggg

SEQ ID NO: 179 - DNA, 253 bp, Unknown
  Artificiall/Consensus sequence
tacgtagggggcgagcgttgtccggaatcactgggcgtaaagggcgcgtaggcggtcagataagtcagtggtgaaaactgggggctcaacctccagcctgccactgatactgtcagacttgagtatggaagaggagaatggaattcctagtgtagcggtgaaatgcgtagatattaggaggaacaccagtggcgaaggcgattctctgggccaagactgacgctgaggcgcgaaagcgtggggagcaaacagg

SEQ ID NO: 180 - DNA, 253 bp, Unknown
  Artificiall/Consensus sequence
tacgtagggagcaagcgttgtccggaattactgggtgtaaagggtgcgtaggcgggtatgcaagtcatatgtgaaataccggggctcaactccggggctgcataagaaactgtatatcttgagtacaggagaggtaagcggaattcctagtgtagcggtgaaatgcgtagatattaggaggaacaccagtggcgaaggcggcttactggactgaaactgacgctgaggcacgaaagcgtggggagcaaacagg

SEQ ID NO: 181 - DNA, 253 bp, Unknown
  Artificiall/Consensus sequence
tacatagggggcgagcgttatccggaattattgggcgtaaagcgtgcgtaggcggccgtttaagtctgtcgtgaaagcccacagcttaactgtggagggtcgatggaaactggatggcttgaatctagaagaggtaagtggaattccatgtgtagcggtaaaatgcttagatatatggaggaacaccagtggcgaaggcggcttactggtctagcattgacgctgaggcacgaaagcgtaggtagcaaacagg

SEQ ID NO: 182 - DNA, 253 bp, Unknown
  Artificiall/Consensus sequence
tacgtaggtggcaagcgttgtccggaattactgggtgtaaagggagcgcaggcgggaaatcaagttggatgtgaaatgtcggggcttaaccccggaactgcatccaaaactgatattcttgagtgaagtagaggtaggcggaattccgagtgtagcggtgaaatgcgtagatattcggaggaacaccagtggcgaaggcggcctactgggctttaactgacgctgaggctcgaaagtgtggggagcaaacagg

SEQ ID NO: 183 - DNA, 253 bp, Unknown
  Artificiall/Consensus sequence
tacgaagggtgcaagcgttgttcggaattactgggtgtaaagggcgtgtaggctggcgatcaagttagtggtgaaacccctgggcttaacctgggacctgccattgatactgatagcctggagtatcggagaggataacggaatatccagtgtagaggtgaaattcgtagatattggatagaacaccggtggcgaaggcggttatctggccgattactgacgctgaggcgcgagagcgtggggagcaaacagg

SEQ ID NO: 184 - DNA, 253 bp, Unknown
  Artificiall/Consensus sequence
tacgtaggggacaagcgttgtccggaatgactgggcgtaaagggcgcgtaggcggtctattaagtctgatgtgaaaggtaccggctcaaccggtgaagtgcattggaaactggtagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacagg

SEQ ID NO: 185 - DNA, 253 bp, Unknown
  Artificiall/Consensus sequence
tacgtaggtggcgagcgttgtccggaattactgggtgtaaagggtgcgtaggcggggatgcaagtcagatgtgaaatctatcggcttaactggtaaactgcatttgaaactgcatttcttgagtggtggagaggtaagcggaattcctagtgtagcggtgaaatgcgtagatattaggaggaacaccagtggcgaaggcggcttactggacactaactgacgctgaggcacgaaagcatggggagcaaacagg

SEQ ID NO: 186 - DNA, 253 bp, Unknown
  Artificiall/Consensus sequence
tacgtagggagcgagcgttgtccggaattactgggtgtaaagggagcgtaggcggggaggcaagttggatgtgaaaactatcggctcaactgatagactgcattcaaaactgtttctcttgagtgaagtagaggcaggcggaattcctagtgtagcggtgaaatgcgtagatattaggaggaacaccagtggcgaaggcggcctgctgggcttttactgacgctgaggctcgaaagtgtggggagcaaacagg

SEQ ID NO: 187 - DNA, 252 bp, Unknown
  Artificiall/Consensus sequence
tacgtagggagcgagcgttatccggaattattgggtgtaaagcgtgtgtaggcggtaaattaagtctaaggtataagcccggagcttaactccggttcgccttagaaactgattttcttgagtgtggtagaggcaagcggaatttctagtgtagcggtaaaatgcgtagatattagaaggaacaccagtggcgaaggcggcttgctgggccaaaactgacgctgagacacgaaagcgtggggagcaaatagg

SEQ ID NO: 188 - DNA, 252 bp, Unknown
  Artificiall/Consensus sequence
tacgtagggagcaagcgttgtccggaattactgggtgtaaagggagcgtaggcgggtgcgcaagttgactgtgaaatctatgggctcaacccatagctgcggtcaaaactgcgtatcttgagtgaagtagaggcaggcggaattcctagtgtagcggtgaaatgcgtaaatattaggaggaacaccagtggcgaaggcggcctgctgggctttaactgacgctgaggctcgaaagcgtgggtagcaaacagg

SEQ ID NO: 189 - DNA, 253 bp, Unknown
  Artificiall/Consensus sequence
tacgtaggtggcaagcgttatccggatttactgggtgtaaagggtgtgtaggcgggaaagtgggtcagatgtgaaataccaaggctaaaccatggagctgcatttgaaactgcttttcttgagagtgggagaggtaagcggaattcccggtgtagcggtgaaatgcgtagatatcgggaggaacaccagtggcgaaggcggcttactggaccattactgacgctgagacacgaaagcgtggggagcaaacagg

SEQ ID NO: 190 - DNA, 253 bp, Unknown
  Artificiall/Consensus sequence
tacgtagggagcgagcgttgtccggaattactgggtgtaaagggtgcgtaggcgggggaccaagtcaggtgtgaaaactatcggcttaaccggtagcctgcacttgaaactggccctcttgagtgaagtagaggcaggcggaattcccggtgtagcggtgaaatgcgtagagatcgggaggaacaccagtggcgaaggcggcctgctgggctttaactgacgctgaggcacgaaagcatgggtagcaaacagg

SEQ ID NO: 191 - DNA, 253 bp, Unknown
  Artificiall/Consensus sequence
tacagagggtgcaagcgttaatcggaattactgggcgtaaagcgcgcgtaggtggttatttaagtcagatgtgaaagccccgggcttaacctgggaactgcatctgatactggataactagagtaggtgagaggggagtagaattccaggtgtagcggtgaaatgcgtagagatctggaggaataccgatggcgaaggcagctccctggcatcatactgacactgaggtgcgaaagcgtgggtagcaaacagg

SEQ ID NO: 192 - DNA, 253 bp, Unknown
  Artificiall/Consensus sequence
tacgtagggagcaagcgttatccggatttactgggtgtaaagggcgtgtaggcgggactgcaagtcagatgtgaaaactatgggcttaacccatagcctgcatttgaaactgtagttcttgagtggtggagaggcaaatggaattcctagtgtagcggtgaaatgcgtagatattaggaagaacaccagtggcgaaggcgatttgctggacactaactgacgctgaggcgcgaaagcgtggggagcaaacagg

SEQ ID NO: 193 - DNA, 253 bp, Unknown
  Artificiall/Consensus sequence
tacgtatggtgcaagcgttatccggatttactgggtgtaaagggagtgtaggtggtctgacaagtcagaggtgaaagcccggggctcaaccccgggactgcctttgaaactgtcagactagagtgcaggagaggtaagtggaattcctagtgtagcggtgaaatgcgtagatattaggaggaacaccagtggcgaaggcggcttactggactgtaactgacactgaggctcgaaagcgtggggagcaaacagg

SEQ ID NO: 194 - DNA, 253 bp, Unknown
  Artificiall/Consensus sequence
tacgtatggagcaagcgttatccggatttactgggtgtaaagggtgcgtaggtggcagggcaagtcagatgtgaaagaccggggctcaaccccggggctgcatttgaaactgctttgctggagtgcaggagaggcaagcggaattcctagtgtagcggtgaaatgcgtagatattaggaggaacaccagtggcgaaggcggcttgctggactgctactgacactgaggcacgaaagcgtggggagcaaacagg

SEQ ID NO: 195 - DNA, 253 bp, Unknown
  Artificiall/Consensus sequence
tacgtagggggcaagcgttatccggattcactgggcgtaaagggagcgcaggcggcacggcaagtctggtgtgaaagcccggggcccaaccccgggactgcattggaaactgccgggctggagtgccggaggggtaagcggaattcctggtgtagcggtgaaatgcgcagatatcaggaagaacaccggtggcggaggcggcttactggacggcaactgacgctgaggctcgaaagcgtggggagcaaacagg

SEQ ID NO: 196 - DNA, 253 bp, Unknown
  Artificiall/Consensus sequence
tacgtagggggcaagcgttatccggatttactgggtgtaaagggagcgtagacggtgcgccaagtctggagtgaaatgccgcagcttaactgcggaactgctttggaaactggcgaactagagtgcgggaggggtaagcggaattcctagtgtagcggtgaaatgcgtagatattaggaggaacaccggtggcgaaggcggcttactggaccgtaactgacgttgaggctcgaaagcgtggggagcaaacagg

SEQ ID NO: 197 - DNA, 253 bp, Unknown
  Artificiall/Consensus sequence
tacgtagggtgcgagcgttaatcggaattactgggcgtaaagcgtgcgcaggcggttgtgcaagacagatgtgaaatccccgggcttaacctgggaactgcatttgtgactgcacggctagagtgcggcagaggggagtggaattccgcgtgtagcagtgaaatgcgtagatatgcggaggaacaccgatggcgaaggcagctccctgggcctgcactgacgctcatgcacgaaagcgtggggagcaaacagg

SEQ ID NO: 198 - DNA, 252 bp, Unknown
  Artificiall/Consensus sequence
tacggaggatgcgagcgttatccggatttattgggtttaaagggtgcgcaggcggacagtcaagtcagcggtaaaatcgcggggctcaaccccgctcagccgttgaaactgattatctagcgtggcgtcgaggtatgcggaatgcgttgtgtagcggtgaaatgcatagatatgacgcagaactccaattgcgaaggcagcataccgggcgcctacggacgctgaggcacgaaagcgtgggtatcgaacagg

SEQ ID NO: 199 - DNA, 253 bp, Unknown
  Artificiall/Consensus sequence
tacgtagggggcgagcgttgtccggaatgactgggcgtaaagggcgtgtaggcggctttttaagtctggagtgaaagcccctttttcaaggaggggagtgctttggagactggagagcttgagtgcggaagaggtaagtggaattcccagtgtagcggtgaaatgcgtagagattgggaggaacaccagtggcgaaggcgacttactgggccgtaactgacgctgaggcgcgaaagcgtggggagcgaacagg

SEQ ID NO: 200 - DNA, 252 bp, Unknown
  Artificiall/Consensus sequence
tacgtagggggcgagcgttatccggatttattgggcgtaaagcgtgtgtaggcggtttattaagtctaagatcaaagcccgaagcttaacttcggttcgtcttagaaactggtagacttgagtgtggtagaggcaagtggaatttctagtgtagcggttaaatgcgtagatattagaaggaacaccagtggcgaaggcggcttgctgggccattactgacgctgagacacgaaagcgtggggagcaaatagg

SEQ ID NO: 201 - DNA, 253 bp, Unknown
  Artificiall/Consensus sequence
tacggagggtgcaagcgttaatcggaattactgggcgtaaagcgcacgcaggcggtctgtcaagtcggatgtgaaatccccgggctcaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacagg

SEQ ID NO: 202 - DNA, 253 bp, Unknown
  Artificiall/Consensus sequence
tacgtaggtggcgagcgttgtccggaatgactgggcgtaaagggcgtgtaggtggactgatcagtcggatgtgaaagccccaggcttaacctgggaaccgcatccgatacggtcagtcttgagtgcgggagagggcagtggaattcccagtgtagcggtgaaatgcgtagagattgggaggaacaccagtggcgaaggcggctgcctggaccgtaactgacactgaggcgcgaaagcgtggggagcaaacagg

SEQ ID NO: 203 - DNA, 253 bp, Unknown
  Artificiall/Consensus sequence
tacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacatcggaggcgaaggcggcttactggacgacaactgacgttgaggctcgaaggcgtggggagcaaacagg

SEQ ID NO: 204 - DNA, 252 bp, Unknown
  Artificiall/Consensus sequence
tacgtagggggcaagcgttatccggaattattgggcgtaaagcgtgcgtaggtggtaatttaagcgcaaggtttaaactaacggctcaaccgttaattgccatgcgaactgggttacttgagtgctggaggggaaagcggaattcctagtgtagcggtgaaatgcgtagatattaggaggaacaccggcggcgaaggcggctttctggacagcaactgacactgaggcacgaaagtgtgggtagcaaacagg

SEQ ID NO: 205 - DNA, 253 bp, Unknown
  Artificiall/Consensus sequence
tacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 206 - DNA, 253 bp, Unknown
  Artificiall/Consensus sequence
tacgtagggggcgagcgttgtccggaatgattgggcgtaaagggcgtgtaggcggctttataagtctggagtgaaagtcctgttttcaagatgggaattgctttggatactgtagggcttgagtgcaggagaggttatcggaattcccggtgtagcggtgaaatgcgtagagatcgggaggaacaccagtggcgaaggcgggtaactggactgcaactgacgctgaggcgcgaaagtgtggggagcaaacagg

SEQ ID NO: 207 - DNA, 252 bp, Unknown
  Artificiall/Consensus sequence
tacgtagggggcaagcgttatccggaattattgggcgtaaagagtacgtaggcggtcttttaagcgcagggtataaggcaagggcttaacctttgttggccctgtgaactggaggacttgagtatcggagagggaagcggaattcctagtgtagcggtgaaatgcgtagatattaggaggaacaccagtggcgaaggcggctttctggacgaaaactgacgctgaggtacgaaagcgtggggagcaaacagg

SEQ ID NO: 208 - DNA, 253 bp, Unknown
  Artificiall/Consensus sequence
tacgtaggtggcaagcgttgtccggatttactgggtgtaaagggcgtgcagccgggccgacaagtcagatgtgaaatcccgaggcttaacctcggaactgcatttgaaactgttggtcttgagtatcggagaggtcatcggaattccttgtgtagcggtgaaatgcgtagatataaggaagaacaccagtggcgaaggcggatgactggacgacaactgacggtgaggcgcgaaagcgtggggagcgaacagg

SEQ ID NO: 209 - DNA, 253 bp, Unknown
  Artificiall/Consensus sequence
tacgtagggggctagcgttgtccggaatcactgggcgtaaagggttcgcaggcggaataacaagtcagatgtgaaaggcatgggctcaacccatgtaagcatttgaaactgtaattcttgagaagtggagaggtaagtggaattcctagtgtagcggtgaaatgcgtagatattaggaggaatacctgtggcgaaggcgacttactggacacaaatctgacgctgaggaacgaaagcgtgggtagcaaacagg

SEQ ID NO: 210 - DNA, 253 bp, Unknown
  Artificiall/Consensus sequence
tacggagggtgcaagcgttactcggaatcactgggcgtaaagagcgtgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacaatattgacgctgagacgcgaaagcgtggggagcaaacagg

SEQ ID NO: 211 - DNA, 253 bp, Unknown
  Artificiall/Consensus sequence
tacgaagggggcaagcgttgttcggaattactgggcgtaaagggtgtgtaggtggattggtaagatagtggtgaaataccggggctcaaccttggaattgccattataactatcagtcttgaatcatggagaggatagcggaatacccagtgtagaggtgaaattcgtagatattgggtagaacaccagtggcgaaggcggctatctggccatgtattgacactgaggcacgaaagcatggggatcaaacagg

SEQ ID NO: 212 - DNA, 253 bp, Unknown
  Artificiall/Consensus sequence
tacggaggatccgagcgttatccggatttattgggtttaaagggagtgtaggcgggatatcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacagg

SEQ ID NO: 213 - DNA, 253 bp, Unknown
  Artificiall/Consensus sequence
tacgtagggggcaagcgttatccggatttactgggtgtaaagggagcgtagacggcatagcaagtttgaagtgaaagcccgcggctcaactgcgggactgctttgaaaactgttaagctagagtgctggagaggtaagcggaattcctagtgtagcggtgaaatgcgtagatattaggaggaacaccagtggcgaaggcggcttactggacagtaactgacgttgaggctcgaaagcgtggggagcaaacagg

SEQ ID NO: 214 - DNA, 253 bp, Unknown
  Artificiall/Consensus sequence
tacgtatggggcaagcgttatccggatttactgggtgtaaagggagtgtaggcggcagtacaagtcaggagtgaaaacttggggctcaaccccaagactgcttttgaaactgtacagctagagtgtaggaagggcaagcggaattcctggtgtagcggtgaaatgcgtagatatcaggaagaacaccggtggcgaaggcggcttgctggactataactgacgctgagactcgaaagcgtggggagcgaacagg

SEQ ID NO: 215 - DNA, 253 bp, Unknown
  Artificiall/Consensus sequence
tacgtagggggcaagcgttatccggatttactgggtgtaaagggagcgtagacggcaaggcaagccagaagtgaaagggcagggctcaaccctgtacatgcttttggaactgtggtgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 216 - DNA, 252 bp, Unknown
  Artificiall/Consensus sequence
tacgtagggggcgagcgttatccggattcattgggcgtaaagcgcgcgcaggcggcctgctcggtcgggagtcaaatccgggggctcaacccccgcccgctcccgataccggcgggcttgagtctggtaggggaaggcggaattcccagtgtagcggtggaatgcgcagatattgggaagaacaccggtggcgaaggcggccttctgggccacgactgacgctgaggcgcgaaagctaggggagcgaacagg

SEQ ID NO: 217 - DNA, 253 bp, Unknown
  Artificiall/Consensus sequence
tacgtatggtgcaagcgttatccggatttactgggtgtaaagggagcgcaggcggtgcggcaagtcagatgtgaaaacccggggctcaacttcgggactgcatttgaaactgccggactagagtgtcggagaggtaagtggaattcctagtgtagcggtgaaatgcgtagatattaggaggaacaccagtggcgaaggcggcttactggacgatgactgacgctgaggctcgaaagcgtggggagcaaacagg

SEQ ID NO: 218 - DNA, 253 bp, Unknown
  Artificiall/Consensus sequence
tacgtagggggcaagcgttatccggattcactgggtgtaaagggagcgtagacggccgtgcaagtctggagtgaaaggcgggggcccaacccccggactgctctggaaactgcagggctggagtacaggagaggtaagtggaattcctagtgtagcggtgaaatgcgtagatattaggaggaacaccagtggcgaaggcggcttactggactgtgactgacgttgaggctcgaaagcgtggggagcaaacagg

SEQ ID NO: 219 - DNA, 252 bp, Unknown
  Artificiall/Consensus sequence
tacgtaggtggcaagcgttgtccggaattactgggtgtaaagggagcgtaggcgggaaggcaagtcaagtgtcaaatctatcggctcaactgatagtcgcgcttgaaactgtttttcttgagtggagtagaggcaggcggaattcctagtgtagcggtgaaatgcgtagatattaggaggaacaccagtggcgaaggcggcctgctgggcttttactgacgctgaggctcgaaagcgtgggtagcaaacagg

SEQ ID NO: 220 - DNA, 253 bp, Unknown
  Artificiall/Consensus sequence
tacggagactacgagcgttactcggattcactgggcgtaaagggagcgcaggcgggatagtgtgttaggtgtgaaatgccggggcttaacttcggagctgcgcctaaaactattattctagagtgctggagaggtaagcggaatttccggtgtagcggtaaaatgcgcagatatcggaaggaacaccgaaggcgaaggcagcttactggacagaaactgacgctcatgctcgaaagcgtggggagcgaaaggg

SEQ ID NO: 221 - DNA, 252 bp, Unknown
  Artificiall/Consensus sequence
tacgtagggagcaagcgttatccggatttattgggcgtaaagggtgcgtaggcggcttgttaagtatgagattaaagcccgaggcttaacctcggttcgtttcataaactggcaggcttgagtgtggcagaggtaaacggaatttctagtgtagcggttaaatgcgtagatattagaaggaacaccagtggcgaaggcggtttactgggccataactgacgctgaggcacgaaagcgtggggagcaaatagg

SEQ ID NO: 222 - DNA, 253 bp, Unknown
  Artificiall/Consensus sequence
tacgtaggtggcaagcgttatccggatttactgggtgtaaagggtgagtaggcggggaagcaagtcagatgtgaaatacaaaggcttaacctttgaactgcatttgaaactgtttttcttgagagtcggagaggtaatcggaattcccagtgtagcggtgaaatgcgtagagattgggaggaacaccagtggcgaaggcggattactggacgacaactgacgctgatacacgaaagcgtggggagcaaacagg

SEQ ID NO: 223 - DNA, 253 bp, Unknown
  Artificiall/Consensus sequence
tacgtaggtggcgagcgttatccggaattattgggtgtaaagggtgcgtaggcggggagtaaagtcagatgtgaaaggcgtgtgctcaacatacggattgcatttgaaacttactttcttgagtgaagtagaggcaagcggaattcccagtgtagcggtgaaatgcgtagatattgggaggaacaccagtggcgaaggcggcttgctgggcttttactgacgctgaggcacgaaagtgtggggagcaaacagg

SEQ ID NO: 224 - DNA, 253 bp, Unknown
  Artificiall/Consensus sequence
tacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacagg

SEQ ID NO: 225 - DNA, 253 bp, Unknown
  Artificiall/Consensus sequence
tacgtagggggcgagcgttgtccggaattactgggcgtaaagggtgcgtaggcggccctgcaggtcagatgtgaaatacccgtgcttaacatgggggctgcatttgaaaccgtagggcttgagtgtggaagaggtaagtggaattcccggtgtagcggtgaaatgcgtagagatcgggaggaacaccagtggcgaaggcgacttactgggccacaactgacgctgaggcacgaaagcgtggggagcaaacagg

SEQ ID NO: 226 - DNA, 253 bp, Unknown
  Artificiall/Consensus sequence
tacgtaggtggcaagcgttgtccggatttactgggtgtaaagggcgtgtaggcgggactttaggtcagatgtgaaataccgaggcttaacttcggagctgcatttgaaaccaaagttcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacagg

SEQ ID NO: 227 - DNA, 253 bp, Unknown
  Artificiall/Consensus sequence
tacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 228 - DNA, 253 bp, Unknown
  Artificiall/Consensus sequence
tacgtaggtggcgagcgttgtccggaattactgggtgtaaagggcgcgtagacggactggcaagtcagatgtgaaataccggggcttaaccccggggctgcatttgaaactgttggccttgagtgcaggagagggaagcggaattcctagtgtagcggtgaaatgcgtagatattaggaggaacaccagtggcgaaggcggctttctggactgtaactgacgttgaggcgcgaaagcgtgggtagcaaacagg

SEQ ID NO: 229 - DNA, 253 bp, Unknown
  Artificiall/Consensus sequence
tacgtagggggcaagcgttatccggatttactgggtgtaaagggagcgtagacggcgaggcaagtctgatgtgaaagcctggggcttaaccccggaactgcattggaaactgctttgctggagtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 230 - DNA, 253 bp, Unknown
  Artificiall/Consensus sequence
tacgtatggggcaagcgttatccggatttactgggtgtaaagggagcgtaggcggcagtacaagtcgggagtgaaaactcggggctcaaccccgagactgctctcgaaactgtacagctagagtgcaggatgggcaggcggaattcctggtgtagcggtgaaatgcgtagatatcaggaggaacaccggtggcgaaggcggcctgctggactgtaactgacgctcaggctcgaaagcgtggggagcgaacagg

SEQ ID NO: 231 - DNA, 253 bp, Unknown
  Artificiall/Consensus sequence
tacggaggatccgagcgttatccggatttattgggtttaaagggtgcgtaggtggctttttaagtcagcggtgaaagtttgtggctcaaccataaaattgccgttgaaactggagggcttgagtatatttgaggtaggcggaatgcgtggtgtagcggtgaaatgcatagatatcacgcagaactccaattgcgaaggcagcttactaaaccataactgacactgaagcacgaaagcgtggggatcaaacagg

SEQ ID NO: 232 - DNA, 252 bp, Unknown
  Artificiall/Consensus sequence
tacgtagggagcgagcgttatccggatttattgggtgtaaagcgtgtgtaggcggttacttaagtctgtggtctaagcctggagctcaactccagttcgccatggaaactgagttacttgagtatggtagaggcaagtggaatttctagtgtagcggtggaatgcgtagatattagaaggaacaccagtggcgaaggcggcttgctgggccattactgacgctgagacacgaaagcgtggggagcgaatagg

SEQ ID NO: 233 - DNA, 253 bp, Unknown
  Artificiall/Consensus sequence
tacgtaggtggcaagcgttgtccggaattactgggtgtaaagggtgcgtaggcggcttctaaagtcagatgtgaaataccgcagctcaactgcggggctgcatttgaaacttgggagcttgagtgaagtagaggtaagcggaattcctagtgtagcggtggaatgcgtagatattaggaggaacaccagtggcgaaggcggcttactgggctttaactgacgctgaggcacgaaagcgtggggagcaaacagg

SEQ ID NO: 234 - DNA, 253 bp, Unknown
  Artificiall/Consensus sequence
tacgtagggggcaagcgttatccggatttactgggtgtaaagggagcgtagacggccgtgcaagtctgatgtgaaaggctggggctcaaccccgggactgcattggaaactgtatggctggagtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 235 - DNA, 253 bp, Unknown
  Artificiall/Consensus sequence
tacgtagggagcgagcgttgtccggaattactgggcgtaaagggtgcgtaggcggctgtgtaagtcagatgtgaaataccggggcttaacctcggggctgcatctgatactgcatagcttgagtgcaggagaggaaagcggaattcctagtgtagcggtgaaatgcgtagatattaggaggaacaccagtggcgaaggcggctttctggactgtaactgacgctgaggcacgaaagcgtggggagcaaacagg

SEQ ID NO: 236 - DNA, 253 bp, Unknown
  Artificiall/Consensus sequence
tacgtaggtggcgagcgttgttcggatttattgggcgtaaagggtccgcaggaggccgattaaatttggggtgaaataccggagctcaactccggaaatgccttgaagactgattggctagagtatcggagaggtaagcggaattccaggtgtagcggtggaatgcttagatatctggaagaacaccgaaagcgaaggcagcttactggacggtaactgactctcatggacgaaagcgtggggagcaaacagg

SEQ ID NO: 237 - DNA, 253 bp, Unknown
  Artificiall/Consensus sequence
tacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacagg

SEQ ID NO: 238 - DNA, 253 bp, Unknown
  Artificiall/Consensus sequence
tacgtagggggcaagcgttatccggatttactgggtgtaaagggagcgtagacgggagtgcaagtctggagtgaaaggcaggggctcaacccctggactgctttggaaactgtagtcctagagtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 239 - DNA, 253 bp, Unknown
  Artificiall/Consensus sequence
aacatagggggcaagcgttgtccggaatcactgggcgtaaagggcgcgtaggtggtctgttaagtcagatgtgaaatgtaagggctcaacccttaacgtgcatctgatactggcagacttgagtgcggaagaggcaagtggaattcctagtgtagcggtgaaatgcgtagatattaggaggaacaccagtggcgaaggcgacttgctgggccgtaactgacgctgaggcgcgaaagcgtggggagcaaacagg

SEQ ID NO: 240 - DNA, 253 bp, Unknown
  Artificiall/Consensus sequence
tacgtagggagcgagcgttatccggatttattgggtgtaaagggtgcgtagacgggttagcaagttagttgtgaaatccctcggctcaactgaggaactgcaactaaaactgttaatcttgagtgcaggagaggaaagcggaattcctagtgtagcggtgaaatgcgtagatattaggaggaacaccagtggcgaaggcggctttctggactgtaactgacgttgaggcacgaaagtgtggggagcaaacagg

SEQ ID NO: 241 - DNA, 252 bp, Unknown
  Artificiall/Consensus sequence
tacgtatgtcacgagcgttatccggatttattgggcgtaaagcgcgtctaggtggttatataagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagccaggggagcgaacggg

SEQ ID NO: 242 - DNA, 253 bp, Unknown
  Artificiall/Consensus sequence
tacgtagggagcgagcgttgtccggaattactgggcgtaaagggcgtgtaggcgggaatttaagtaaggtgtgaaaactccgggcttaacctggagactgcactttaaactggatttcttgagggcaggagaggaaagtggaattcctagtgtagcggtgaaatgcgtagatattaggaggaacaccagtggcgaaggcgactttctggactgtacctgacgctgaggcgcgaaagcgtggggagcgaacagg

SEQ ID NO: 243 - DNA, 253 bp, Unknown
  Artificiall/Consensus sequence
tacggaggatccgagcgttatccggatttattgggtttaaagggtgcgtaggcggtttgataagttagaggtgaaatgtcggggctcaaccccgaaactgcctctaatactgttggactagagaatagttgcggtaggcggaatgtatggtgtagcggtgaaatgcttagagatcatacagaacaccgattgcgaaggcagcttaccaaactatatctgacgttgaggcacgaaagcgtgggtagcaaacagg

SEQ ID NO: 244 - DNA, 253 bp, Unknown
  Artificiall/Consensus sequence
tacgtagggggcaagcgttatccggatttactgggtgtaaagggagcgtagacggcagcgcaagtctggagtgaaatcccatggcttaaccatggaactgctttggaaactgtgcagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 245 - DNA, 252 bp, Unknown
  Artificiall/Consensus sequence
tacgtagggggcgagcgttatccggattcattgggcgtaaagcgcgcgtaggcgggcttctaagcggaacctctaacccgagggctcaacccccggccgggttccgaactggaagcctcgagtctggtagaggaagatggaattcccggtgtagcggtggaatgcgcagatatcgggaagaacaccgatggcgaaggcagtcttctgggccgcgactgacgctgaggcgcgaaagctgggggagcgaacagg

SEQ ID NO: 246 - DNA, 253 bp, Unknown
  Artificiall/Consensus sequence
aacgtaggtggcaagcgttgtccggaattactgggtgtaaagggagtgcaggcgggacggcaagttggaagtgaaacccatgggcttaacccatgaactgctttcaaaactgccgttcttgagtggtgcagaggtaggcggaattcccggtgtagcggtggaatgcgtagatatcgggaggaacaccagtggcgaaggcggcctactgggcactaactgacgctgaggctcgaaagcatgggtagcaaacagg

SEQ ID NO: 247 - DNA, 253 bp, Unknown
  Artificiall/Consensus sequence
tacgtaggtggcaagcgttatccggatttactgggcgtaaagggagcgtaggcggatatttaagtgggatgtgaaatacccgagcttaacttgggagctgcattccaaactggatatctagagtgcaggagaggagaatggaattcctagtgtagcggtgaaatgcgtagagattaggaagaacaccagtggcgaaggcgattctctggactgtaactgacgctgaggctcgaaagcgtggggagcaaacagg

SEQ ID NO: 248 - DNA, 253 bp, Unknown
  Artificiall/Consensus sequence
tacggagggtgcgagcgttaatcggaataactgggcgtaaagcgggcgcagacggttacttaagcaggatgtgaaatccccgggctcaacctgggaattgcgttctgaactgggtggctagagtgtgtcagaggggggtagaattccacgtgtagcagtgaaatgcgtagagatgtggaggaataccgatggcgaaggcagccccctgggatggcactgacgttcatgcccgaaagcgtgggtagcaaacagg

SEQ ID NO: 249 - DNA, 252 bp, Unknown
  Artificiall/Consensus sequence
tacgtagggggcaagcgttatccggaattattgggcgtaaagggtacgtaggtggttacctaagcacagggtataaggcaatagcttaactattgttcgccttgtgaactgggctacttgagtgcaggagaggaaagcggaattcctagtgtagcggtgaaatgcgtagatattaggaggaacaccagtggcgaaggcggctttctggactgtaactgacactgaggtacgaaagcgtggggagcaaacagg

SEQ ID NO: 250 - DNA, 252 bp, Unknown
  Artificiall/Consensus sequence
tacgtaaggaccgagcgttgtccggaatcattgggcgtaaagggtacgtaggcgggtcattaagttagaagtcaaaggctatagctcaactatagtaagcttctaaaactggagaccttgagtaatggaagggaaagtggaattcctagtgtagcggtggaatgcgcagatattaggaggaataccggtggcgaaggcgactttctggccattaactgacgctgaggtacgaaagcgtgggtagcaaacagg

SEQ ID NO: 251 - DNA, 252 bp, Unknown
  Artificiall/Consensus sequence
tacgtagggggcaagcgttatccggaattattgggcgtaaagagtacgtaggtggtttcctaagcacagggtttaaggctaaggctcaaccatagttcgccctgtgaactgggagacttgagtgcaggagaggaaagcggaattcctagtgtagcggtgaaatgcgtagatattaggaggaacaccagtggcgaaggcggctttctggactgtaactgacactgaggtacgaaagcgtggggagcaaacagg

SEQ ID NO: 252 - DNA, 253 bp, Unknown
  Artificiall/Consensus sequence
tacggggggtgcaagcgttactcggaatcactgggcgtaaaggacgcgtaggcggattatcaagtcttttgtgaaatctagtggcttaaccactaaactgcttaggaaactgatagtctagagtaggggagaggtagatggaattcttggtgtaggggtaaaatccgtagagatcaagaagaatacccattgcgaaagcgatctgctggaacctaactgacgctgaggcgtgaaagcgtgggtagcaaacagg

SEQ ID NO: 253 - DNA, 252 bp, Unknown
  Artificiall/Consensus sequence
tacggaggatgcgagcgttatccggatttattgggtttaaagggtgcgcaggcggaggtgcaagtcagcggtcaaattgcggggctcaaccccgtactgccgttgaaactgcatcccttgagtgcgcgagaagtatgcggaatgcgtggtgtagcggtgaaatgcatagatatcacgcagaactccgattgcgaaggcagcataccggcgcgcaactgacgctcatgcacgaaagcgtgggtatcgaacagg

SEQ ID NO: 254 - DNA, 253 bp, Unknown
  Artificiall/Consensus sequence
tacgtaggtggcgagcgttatccggaattattgggtgtaaagggtgcgtaggcgggatgtaaagtcagatgtgaaatgccgcggctcaaccgcggagctgcatttgaaacttatgttcttgagtgaagtagaggtaagcggaattcctagtgtagcggtgaaatgcgtagatattaggaggaacaccggtggcgaaggcggcttactgggcttagactgacgctgaggcacgaaagtgtggggagcaaacagg

SEQ ID NO: 255 - DNA, 253 bp, Unknown
  Artificiall/Consensus sequence
tacgtagggggcgagcgttatccggattcattgggcgtaaagcgcgcgcaggcggcccgccaagcggcctcgtcgaagccgggggctcaacccccggaagcgacccgaactggcgggctcgagtggggcaggggaggatggaattcccggtgtagcggtgaaatgcgcagatatcgggaggaacaccgacggcgaaggcagccctctgggccttcactgacgctgaggcgcgaaagctgggggagcgaacagg

SEQ ID NO: 256 - DNA, 253 bp, Unknown
  Artificiall/Consensus sequence
tacggaaggtccgggcgttatccggatttattgggtttaaagggtgcgtaggcggttagataagttagaggtgaaatcccggggcttaactccgaaattgcctctaatactgtttgactagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 257 - DNA, 253 bp, Unknown
  Artificiall/Consensus sequence
tacagaggtctcaagcgttgttcggaatcactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 258 - DNA, 253 bp, Unknown
  Artificiall/Consensus sequence
tacggagggtgcaagcgttaatcggaattactgggcgtaaagcgcacgcaggcggtttgttaagtcagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 259 - DNA, 253 bp, Unknown
  Artificiall/Consensus sequence
tacgtagggagcaagcgttgtccggaattactgggcgtaaagggtgcgtaggcggttgcttaagtcagatgtgaaatactcgggctcaactcgggggctgcatctgatactgggtaactagagtgcaggagaggaaagtggaattcctagtgtagcggtggaatgcgtagatattaggaggaacaccagtggcgaaggcgactttctggactgtaactgacgctgaggcacgaaagtatgggtagcaaacagg

SEQ ID NO: 260 - DNA, 253 bp, Unknown
  Artificiall/Consensus sequence
tacgtagggggcgagcgttatccggattcattgggcgtaaagcgcgcgtaggcgtcccttcaagcggcaccgtcgaagccgggggctcaacccccggaagcgggccgaactggggggatcgagtgcggtaggggaaggcggaattcccggtgtagcggtgaaatgcgcagatatcgggaagaacaccgacggcgaaggcagccttctgggccgccactgacgctgaggcgcgaaagctgggggagcgaacagg

SEQ ID NO: 261 - DNA, 253 bp, Unknown
  Artificiall/Consensus sequence
tacgtagggagcgagcgttgtccggaattactgggcgtaaagggtgcgtaggcggtattttaagtcgcatgtgaaatactcgggcttaacccgggggctgcatgcgaaactggggtactagagtgcaggagaggtaagcggaattcctagtgtagcggtgaaatgcgtagatattaggaggaacaccagtggcgaaggcggcttactggactgtaactgacgctgaggcacgaaagcgtggggagcaaacagg

SEQ ID NO: 262 - DNA, 252 bp, Unknown
  Artificiall/Consensus sequence
tacgtaggtggcgagcgttatccggatttattgggcgtaaagcgtccgcagccggtttattaagtatagaataaaacttcggggctcaaccccgtctcgttctataaactgatagactagagtgtggtagaggcaagtggaatttctagtgtagcggtagaatgcgtagatattagaaggaacaccagtggcgaaggcgacttgctgggccatcactgacggtcagggacgaaagcgtggggagcgaatagg

SEQ ID NO: 263 - DNA, 252 bp, Unknown
  Artificiall/Consensus sequence
cacgtagggggcgagcgttatccggattcattgggcgtaaagcgcgcgtaggcggccgctcaagcgggacctctaatcccggggctcaaccccgggccgggtcccgaactgggcggctcgagtcaggtagaggcaggcggaattcccggtgtagcggtgaaatgcgcagatatcgggaagaacaccgatggcgaaggcagcctgctgggccttgactgacgctgaggcgcgaaagccgggggagcgaacagg

SEQ ID NO: 264 - DNA, 253 bp, Unknown
  Artificiall/Consensus sequence
tacgtagggggcgagcgttgtccggaattactgggcgtaaagggtgcgtaggcggcggattaagttggatgtgaaatacccgggcttaacttgggggctgcatccaatactggtctgctagagtgcaggagagggaagcggaattcctagtgtagcggtgaaatgcatagatattaggaggaacaccagtggcgaaggcggctttctggactgtaactgacgctgaggcacgaaagcgtggggagcaaacagg

SEQ ID NO: 265 - DNA, 253 bp, Unknown
  Artificiall/Consensus sequence
tacggaggatccaagcgttatccggatttattgggtttaaagggtgcgtaggcggtttgataagttagaggtgaaataccggggctcaactccggaactgcctctaatactgttgaactagagagtagttgcggtaggcggaatgtatggtgtagcggtgaaatgcttagagatcatacagaacaccgattgcgaaggcagcttactaaaccataactgacactgaagcacgaaagcgtggggatcaaacagg

SEQ ID NO: 266 - DNA, 252 bp, Unknown
  Artificiall/Consensus sequence
tacgtagggagcgagcgttatccggaattattgggcgtaaagggtgcgtagatggcatagtaagtcttttgtaaaaatgctgggctcaacccagtagggcaaaagatactgcaaagctagagtatgacagaggcaagtggaactacatgtgtagcggtaaaatgcgtaaatatatgtaagaacaccagtggcgaaggcggcttgctgggtcgatactgacattgaggcacgaaagcgtggggagcaaacagg

SEQ ID NO: 267 - DNA, 253 bp, Unknown
  Artificiall/Consensus sequence
tacgtagggggcaagcgttatccggaattactgggtgtaaagggtgagtaggcggcatgacaagtaagatgtgaaagcccgtggcttaaccacgggattgcattttaaactgttgagctagagtacaggagaggaaagcggaattcccagtgtagcggtgaaatgcgtagatattgggaagaacaccagtggcgaaggcggctttctggactgaaactgacgctgaggcacgaaagcgtggggagcaaacagg

SEQ ID NO: 268 - DNA, 253 bp, Unknown
  Artificiall/Consensus sequence
tacgtagggggcaagcgttgtccggaatgactgggcgtaaagggagtgtaggtggcataataagttatatgtgaaagcccgcagcttaactgcggaactgcatataaaactgttaggctggagtgcaggagaggtaagcggaattcctagtgtagcggtggaatgcgtagatattaggaagaacaccagaggcgaaggcggcttactggactgtaactgacactgaggctcgaaagcgtggggagcaaacagg

SEQ ID NO: 269 - DNA, 252 bp, Unknown
  Artificiall/Consensus sequence
tacgtagggggcgagcgttatccggatttattgggcgtaaagcgtgtgtaggcggtttattaagtccgagatgaaaggctgaggcttaacctcagtttgtttcggaaactggtagactagagtgcagtagaggcaattggaattcatagtgtagcggtaaaatgcgtagatattatgaggaacatcagtggcgaaggcgaattgctgggctgttactgacgctgagacacgaaagcgtggggagcaaatagg

SEQ ID NO: 270 - DNA, 252 bp, Unknown
  Artificiall/Consensus sequence
tacgtagggagcgagcgttgtccggaattactgggtgtaaagggagcgtaggcggggacgcaagttgggtgtgaaatctaccggctcaaccggtaattgcactcaaaactgcgactcttgagttaagtagaggcaggcggaattcctagtgtagcggtgaaatgcgtagatattaggaggaacaccagtggcgaaggcggcctgctgggcttttactgacgctgaggctcgaaagtgcggggagcaaacagg

SEQ ID NO: 271 - DNA, 252 bp, Unknown
  Artificiall/Consensus sequence
tacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggcttgtaactgacgctgagaagcgaaagcatggggagcgaacagg

SEQ ID NO: 272 - DNA, 253 bp, Unknown
  Artificiall/Consensus sequence
aacgtaggtggcaagcgttgtccggaattactgggtgtaaagggagcgcaggcggaagcgcaagttggatgtgaaacccatgggctcaacccatggcctgcatccaaaactgtgtttcttgagtagtgcagaggtaggcggaattcccggtgtagcggtggaatgcgtagatatcgggaggaacaccagtggcgaaggcggcctactgggcaccaactgacgctgaggctcgaaagcatgggtagcaaacagg

SEQ ID NO: 273 - DNA, 253 bp, Unknown
  Artificiall/Consensus sequence
tacgtagggggcaagcgttgtccggaatgactgggcgtaaagggcgtgtaggcggcctgataagtatgaagtgaaagtcctgctttcaaggtgggaattgctttgtagactgtcgggcttgagtgcggaagaggtaagtggaattcccagtgtagcggtgaaatgcgtagagattgggaggaacaccagtggcgaaggcgacttactgggccgtaactgacgctgaggcgcgaaagcgtggggagcgaacagg

SEQ ID NO: 274 - DNA, 252 bp, Unknown
  Artificiall/Consensus sequence
tacggaggatgcgagcgttatccggatttattgggtttaaagggtgcgtaggcggtctgttaagttagtggttaaatttccgggcttcacccggtcatgccattaatactggtggactcgagtacagacgaggtaggcggaataagttaagtagcggtgaaatgcatagatataacttagaactccgatagcgaaggcagcttaccagactgtaactgacgctgatgcacgagagcgtgggtagcaaacagg

SEQ ID NO: 275 - DNA, 253 bp, Unknown
  Artificiall/Consensus sequence
tacggagggtgcgagcgttaatcggaattactgggcgtaaagcgctcgtaggcggtatgtcaagtcaagggtgaaatccccgcgctcaacgtgggaactgcctttgaaactggcaaactggagtgtgtgagaggatagtggaattccaggtgtaggagtgaaatccgtagatatctggaggaacatcagtggcgaaggcgactatctggcacataactgacgctgaggagcgaaagcgtgggtagcaaacagg

SEQ ID NO: 276 - DNA, 253 bp, Unknown
  Artificiall/Consensus sequence
tacggagggtgcgagcgttaatcggaataactgggcgtaaagggcacgcaggcggttatttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacagg

SEQ ID NO: 277 - DNA, 253 bp, Unknown
  Artificiall/Consensus sequence
tacggagggtgcaagcgttaatcggaattactgggcgtaaagcgcacgcaggcggtctgtcaagtcggatgtgaaatccccgggcttaacccgggaattgcatctgatactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacagg

SEQ ID NO: 278 - DNA, 253 bp, Unknown
  Artificiall/Consensus sequence
tacgtaggtcccgagcgttgtccggatttattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagccaggggagcgaacggg

SEQ ID NO: 279 - DNA, 253 bp, Unknown
  Artificiall/Consensus sequence
tacgtagggagcaagcgttgtccggaatgactgggcgtaaagggtgcgtaggcggtttcgtaagttagaagtgtaatcccggggcttaaccccggagctacttctaagactgcgggacttgagtgtgggagaggtaagtggaattcctagtgtagcggtggaatgcgtagatattaggaggaacaccagtggcgaaggcggcttactggaccataactgacgctgaggcacgaaagcgtggggagcaaacagg

SEQ ID NO: 280 - DNA, 253 bp, Unknown
  Artificiall/Consensus sequence
tacggaaggtccgggcgttatccggatttattgggtttaaagggagcgtaggccgtgggttaagtgtgttgtgaaatccggttgctcaacatccggtttgcagcgcatactgtcccacttgagtgcgcacaacgcaggcggaattcgtcgtgtagcggtgaaatgcttagatatgacgaggaaccccgattgcgaaggcagcttgcgggagcgcaactgacgcttaagctcgaaggtgcgggtatcaaacagg

SEQ ID NO: 281 - DNA, 253 bp, Unknown
  Artificiall/Consensus sequence
tacgtagggagcgagcgttgtccggatttactgggtgtaaagggtgcgtaggcggctctgcaagtcagtcgtgaaaaccatgggctcaacccgtggactgcgattgaaactgtggaacttgagtgaagtagaggcaggcggaattcccggtgtagcggtgaaatgcatagagatcgggaggaacaccagtggcgaaggcggcctgctgggctttaactgacgctgaggcacgaaagtatgggtagcaaacagg

SEQ ID NO: 282 - DNA, 253 bp, Unknown
  Artificiall/Consensus sequence
tacgtaggtggcaagcgttatccggaatgactgggcgtaaagggtgcgtaggtggtttggcaagttggcggcgtaattccgaggctcaacctcggcgctaccgccaaaactgtcggacttgagtgcaggaggggtaagtggaattcctagtgtagcggtggaatgcgtagatattaggaggaacatcggtggcgaaggcgacttactggactgtaactgacactgaggcacgaaagcgtggggagcaaacagg

SEQ ID NO: 283 - DNA, 252 bp, Unknown
  Artificiall/Consensus sequence
tacgtaggtggcaagcgttgtccggaattactgggtgtaaagggagcgtaggcgggtgtgcaagttgaatgtcaaatctatgggctcaacccatagtcgcgttcaaaactgcatatcttgagtgaagtagaggtaggcggaattcctagtgtagcggtgaaatgcgtaaatattaggaggaacaccagtggcgaaggcggcctactgggctttaactgacgctgaggctcgaaagcgtgggtagcaaacagg

SEQ ID NO: 284 - DNA, 253 bp, Unknown
  Artificiall/Consensus sequence
tacgtagggggcaagcgttatccggatttactgggtgtaaagggagcgtaggtggtatggcaagtcagaggtgaaaacccagggcttaaccttgggattgcctttgaaactgtcagactagagtgcaggaggggtaagtggaattcctagtgtagcggtgaaatgcgtagatattaggaggaacaccagtggcgaaggcggcttactggactgtaactgacactgaggctcgaaagcgtggggagcaaacagg

SEQ ID NO: 285 - DNA, 252 bp, Unknown
  Artificiall/Consensus sequence
tacgtaggtggcaagcgttgtccggaattattgggcgtaaagcgcgcgcaggcggctacttaagtccatcttaaaagtgcggggcttaaccccgtgatgggatggaaactgagaagctggagtgtcggagaggaaagtggaattcctagtgtagcggtgaaatgcgtagagattaggaagaacaccggtggcgaaggcgactttctggacgacaactgacgcttaggcgcgaaagcgtggggagcaaacagg

SEQ ID NO: 286 - DNA, 254 bp, Unknown
  Artificiall/Consensus sequence
tacgtagggtgcgagcgttgtccggatttactgggcgtaaagggctcgtaggtggtgtgttgcgtcgtctgtgtaatccaggggcttaacttttggttggcaggcgatacgggcattgcttgagtgctgtaggggagactggaattcctggtgtagcggtgaaatgcgcagatatcaggaggaacaccgatggcgaaggcaggtctctgggcagttactgacgctgaggagcgagagcatgggtagcgaacagg

SEQ ID NO: 287 - DNA, 253 bp, Unknown
  Artificiall/Consensus sequence
tacgtaggtggcaagcgttgtccggatttactgggtgtaaagggcgcgtaggcgggtttgcaagtcagatgtgaaataccgaggcttaacttcggaactgcatctgaaactgtggatcttgagtactggagaggaaagtggaattcctagtgtagcggtgaaatgcgtagatattaggaggaacaccggtggcgaaggcggctttctggacagtaactgacgctgaggcgcgaaagcgtggggagcaaacagg

SEQ ID NO: 288 - DNA, 253 bp, Unknown
  Artificiall/Consensus sequence
tacagaggtctcaagcgttgttcggaatcactgggcgtaaagcgtgcgcaggcggttctgtaagacagatgtgaaatccccgggctcaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacagg

SEQ ID NO: 289 - DNA, 253 bp, Unknown
  Artificiall/Consensus sequence
tacgtaggtggcaagcgttatccggaatgactgggcgtaaagggtgcgtaggtggcttagcaagttggtagcgtaattccggggctcaactccggcgctactaccaaaactgttgagcttgagtgcaggaggggtaagtggaattcctagtgtagcggtggaatgcgtagatattaggaggaacatcggtggcgaaggcgacttactggactgtaactgacactgaggcacgaaagcgtggggagcaaacagg

SEQ ID NO: 290 - DNA, 253 bp, Unknown
  Artificiall/Consensus sequence
tacgtagggggcgagcgttgtccggaatgactgggcgtaaagggcgcgtaggcggcttgataagttagaagtgaaagtcctgctttcaaggtgggaattgcttttaatactgttgagcttgagtgcagaagaggtaagcggaattccaagtgtagcggtgaaatgcgtagagatttggaagaacaccagtggcgaaggcggcttactgggctgtaactgacgctgaggcgcgaaagcgtggggagcgaacagg

SEQ ID NO: 291 - DNA, 253 bp, Unknown
  Artificiall/Consensus sequence
tacgtagggagcaagcgttgtccggaattactgggcgtaaagggtgcgtaggtggtcatgtaagtcagatgtgaaagaccggggcttaaccccggggttgcatttgaaactgtgtgacttgagtacaggagagggaagtggaattcctagtgtagcggtgaaatgcgtagatattaggaggaacaccagtggcgaaggcgactttctggactgtaactgacactgaggcacgaaagcgtggggagcaaacagg

SEQ ID NO: 292 - DNA, 253 bp, Unknown
  Artificiall/Consensus sequence
tacgtagggagcaagcgttgtccggatttactgggtgtaaagggtgcgtaggcgggatatcaagtcagacgtgaaatccatcggcttaactgatgaactgcgtttgaaactggtattcttgagtgagtcagaggcaggcggaattcccggtgtagcggtgaaatgcgtagagatcgggaggaacaccagtggcgaaggcggcctgctggggcttaactgacgctgaggcacgaaagcgtggggagcaaacagg

SEQ ID NO: 293 - DNA, 252 bp, Unknown
  Artificiall/Consensus sequence
tacgtagggggcaagcgttatccggatttattgggcgtaaagcgtgtgtaggcggtttgttaagtttaagattaaagcctggggctcaactccagttcgtcttaaaaactggcagactagagtacggtagaggcaaacggaatttctagtgtagcggtgaaatgcgtagatattagaaggaacaccagtggcgaaagcggtttgctgggccgttactgacgctgaggcacgaaagcgtggggagcaaatagg

SEQ ID NO: 294 - DNA, 253 bp, Unknown
  Artificiall/Consensus sequence
tacgtagggggcaagcgttatccggatttactgggtgtaaagggagcgtagacggcatagtaagtctgatgtgaaaggcgggggctcaacccctggactgcattggaaactattaagctggagtgtcggagaggtaagtggaattcctagtgtagcggtgaaatgcgtagatattaggaggaacaccagtggcgaaggcggcttactggacgatcactgacgttgaggctcgaaagcgtggggagcaaacagg

SEQ ID NO: 295 - DNA, 252 bp, Unknown
  Artificiall/Consensus sequence
tacggaggatgcgagcgttatccggatttattgggtttaaagggtgcgtaggcggaagctcaagtcagcggtaaaatagtggtgctcaacgccatcgagccgttgaaactgagtttcttgagtgagcgagaagtatgcggaatgcgtggtgtagcggtgaaatgcatagatatcacgcagaactccgattgcgaaggcagcataccggcgctcaactgacgctgaagcacgaaagcgtgggtatcgaacagg

SEQ ID NO: 296 - DNA, 252 bp, Unknown
  Artificiall/Consensus sequence
tacggaggatgcgagcgttatccggatttattgggtttaaagggtgcgtaggcgggttatcaagtcagcggtaaaatcgtggagctcaactccatccagccgttgaaactgatgatcttgagtgggcgagaagtatgcggaatgcgtggtgtagcggtgaaatgcatagatatcacgcagaactccgattgcgaaggcagcataccggcgcccgactgacgctgaagcacgaaagcgtgggtatcgaacagg

SEQ ID NO: 297 - DNA, 253 bp, Unknown
  Artificiall/Consensus sequence
tacgtaggtggcaagcgttgtccggatttattgggcgtaaagcgagcgcaggcggttttttaagtctgatgtgaaagccttcggctcaaccgaagaagtgcatcggaaactggaaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacagg

SEQ ID NO: 298 - DNA, 253 bp, Unknown
  Artificiall/Consensus sequence
tacgtagggagcgagcgttgtccggatttactgggtgtaaagggtgcgtaggcggcagagcaagtcaggcgtgaaaactatgggcttaacccatagcctgcgtttgaaactgttcagcttgagtgaagtagaggcagatggaattcccggtgtagcggtggaatgcgtagagatcgggaggaacaccagtggcgaaggcggtctgctgggctttaactgacgctgaggcacgaaagtgtggggagcaaacagg

SEQ ID NO: 299 - DNA, 253 bp, Unknown
  Artificiall/Consensus sequence
tacgtagggggcaagcgttatccggatttactgggtgtaaagggagcgtagacggaatagcaagtctgaagtgaaatcatagggctcaaccctgtgcttgctttggaaactgttgatctggagtaccggaggggcaggcggaattcctggtgtagcggtgaaatgcgtagatatcaggaagaacaccggtggcgaaggcggcctgctggacggcaactgacgttgaggctcgaaagcgtggggagcaaacagg

SEQ ID NO: 300 - DNA, 254 bp, Unknown
  Artificiall/Consensus sequence
tacgtagggagcaagcgttgtccggaattactgggtgtaaagggtgcgtaggcgggcttgcaagtcagccgtgaaatcccggggcttaaccccgcggactgcggtagaaactgtgagtcttgagtgaagtagaggtaggcggaattcccggtgtagcggtgaaatgcgtagagatcgggaggaacaccagtggcgaaggcggcctactgggctttaactgacgctgaggcacgaaagtgtgggtagcaaacagg

SEQ ID NO: 301 - DNA, 253 bp, Unknown
  Artificiall/Consensus sequence
tacagaggtctcaagcgttgttcggaatcactgggcgtaaagcgtgcgcaggcggttgggtaagacaggtgtgaaatccccgagcttaacttgggaactgcacttgtgactgctcaactagagtatgtcagagggaggtggaattccaagtgtagcagtgaaatgcgtagatatttggaagaacaccgatggcgaaggcagcctcctgggataatactgacgctcatgcacgaaagcgtggggagcaaacagg

SEQ ID NO: 302 - DNA, 253 bp, Unknown
  Artificiall/Consensus sequence
tacgtatgtcccgagcgttatccggatttattgggcgtaaagcgagcgcagacggttgattaagtctgatgtgaaagcccggagctcaactccggaaaggcattggaaactggtcaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacagg

SEQ ID NO: 303 - DNA, 253 bp, Unknown
  Artificiall/Consensus sequence
tacgtagggggcaagcgttatccggatttactgggtgtaaagggagcgcaggcggcagtgcaagtctgatgtgaaagcccggggcttaaccccgggactgcattggaaactgtaatgcttgagtgtcggaggggtaagtggaattcctagtgtagcggtgaaatgcgtagatattaggaggaacaccagtggcgaaggcggcttactggacgacaactgacgctgaggctcgaaagcgtggggagcaaacagg

SEQ ID NO: 304 - DNA, 253 bp, Unknown
  Artificiall/Consensus sequence
tacgtaggtggcgagcgttatccggatttactgggtgtaaagggtgtgtaggcgggactgcaagtcggatgtgaaaatcacaggcttaacctgtgacctgcattcgaaactgtggttcttgagggtcggagaggtaactggaattcctggtgtagcggtgaaatgcgtagatatcaggaggaacaccggtggcgaaggcgggttactggacgattactgacgctgagacacgaaagcgtggggagcaaacagg

SEQ ID NO: 305 - DNA, 253 bp, Unknown
  Artificiall/Consensus sequence
tacggagggtgcaagcgttaatcggaataactgggcgtaaagggcatgcaggcggttcatcaagtaggatgtgaaatccccgggctcaacctgggaacagcatactaaactggtggactagagtattgcagggggagacggaattccaggtgtagcggtggaatgcgtagatatctggaagaacaccaaaggcgaaggcagtctcctgggcaaatactgacgctcatatgcgaaagcgtgggtagcaaacagg

SEQ ID NO: 306 - DNA, 253 bp, Unknown
  Artificiall/Consensus sequence
tacgtagggagcgagcgttatccggatttactgggtgtaaagggcgtgtaggcgggctggcaagtcaggcgtgaaaaccatgggctcaacccatggcctgcgtttgaaactgttggtcttgagtgctggagaggcaagcggaattccgtgtgtagcggtgaaatgcgtagatatacggaggaacaccagtggcgaaggcggcttgctggacagtaactgacgctgaggcgcgaaagcgtggggagcaaacagg

SEQ ID NO: 307 - DNA, 253 bp, Unknown
  Artificiall/Consensus sequence
tacgtaggtggcaagcgttgtccggatttactgggtgtaaagggcgtgcagccgggcgcttaagtcagatgtgaaatccgcgggcttaacccgcgaactgcatttgaaactgagcgtcttgagtatcggagaggtcatcggaattccttgtgtagcggtgaaatgcgtagatataaggaagaacaccagtggcgaaggcggatgactggacgacaactgacggtgaggcgcgaaagcgtggggagcaaacagg

SEQ ID NO: 308 - DNA, 252 bp, Unknown
  Artificiall/Consensus sequence
tacgtaggtggcaagcgttgtccggaattactgggtgtaaagggagcgtaggcggggatacaagttgaatgttaaaactatgggctcaacctatagttgcgttcaaaactgtatttcttgagtgaagtagaggtaagcggaattcctagtgtagcggtgaaatgcgtaaatattaggaggaacaccagtggcgaaggcggcttactgggctttaactgacgctgaggctcgaaagcgtgggtagcaaacagg

SEQ ID NO: 309 - DNA, 253 bp, Unknown
  Artificiall/Consensus sequence
aacgtaggtggcaagcgttgtccggaattactgggtgtaaagggagcgcaggcggactagcaagttggaagtgaaatctatgggctcaacccataaattgctttcaaaactgccggtcttgagtagtgcagaggtaggcggaattcccggtgtagcggtggaatgcgtagatatcgggaggaacaccagtggcgaaggcggcctactgggcaccaactgacgctgaggctcgaaagtatgggtagcaaacagg

SEQ ID NO: 310 - DNA, 253 bp, Unknown
  Artificiall/Consensus sequence
tacgtagggagcgagcgttgtccggatttactgggtgtaaagggtgcgtaggcggcttgacaagtcagaagtgaaatccatgggcttaacccatgaactgcttttgaaactgccaggcttgagtgaagtagaggtaggcggaattcccggtgtagcggtgaaatgcgtagagatcgggaggaacaccagtggcgaaggcggcctactgggctttaactgacgctgaagcacgaaagcgtgggtagcaaacagg

SEQ ID NO: 311 - DNA, 252 bp, Unknown
  Artificiall/Consensus sequence
tacggaggatgcgagcgttatccggatttattgggtttaaagggtgcgtaggcggaatgccaagtcagcggtaaaatcgcggggctcaacctcgctccgccgttgaaactggcgttcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacagg

SEQ ID NO: 312 - DNA, 253 bp, Unknown
  Artificiall/Consensus sequence
tacgtagggggcaagcgttgtccggaatcactgggcgtaaagggcgcgtaggcggtttaataagtcagtggtgaaaacttggggctcaaccctgagcgtgccactgatactgttagacttgagtatggaagaggagaatggaattcctagtgtagcggtgaaatgcgtagatattaggaggaacaccagtggcgaaggcgattctctgggccaaaactgacgctgaggcgcgaaagcgtggggagcaaacagg

SEQ ID NO: 313 - DNA, 253 bp, Unknown
  Artificiall/Consensus sequence
tacatagggggcaagcgttatccggaattattgggtgtaaagggtgcgtagacggaagaacaagttggttgtgaaatccctcggctcaactgaggaactgcaaccaaaactattctccttgagtgtcggagaggaaagtggaattcctagtgtagcggtgaaatgcgtagatattaggaggaacaccagtggcgaaggcgactttctggacgataactgacgttgaggcacgaaagtgtggggagcaaacagg

SEQ ID NO: 314 - DNA, 253 bp, Unknown
  Artificiall/Consensus sequence
tacgtaggtggcaagcgttatccggaattattgggtgtaaagggtgcgtaggcgggatgtaaagtcagatgtgaaattcaggagctcaacttctgaactgcatttgaaacttacgttcttgagtgaagtagaggcaagcggaattcccagtgtagcggtgaaatgcgtagatattgggaggaacaccagtggcgaaggcggcttgctgggcttaaactgacgctgaagcacgaaagtgtggggagcaaacagg

SEQ ID NO: 315 - DNA, 253 bp, Unknown
  Artificiall/Consensus sequence
tacgtagggggcgagcgttgtccggattcattgggcgtaaagggcgcgtaggcggcccggaaggccgggggtgaaagcgcggggcccaaccccgcaagcgcccccgggacccccgggctcgggtcccgcagggggtggcggaactcccggtgtagcggtggaatgcgcagatatcgggaggaacaccggtggcgaaggcggccacctgggcggcgaccgacgctgaggcgcgagagccgggggagcgaacagg

SEQ ID NO: 316 - DNA, 253 bp, Unknown
  Artificiall/Consensus sequence
tacgtaggtggcaagcgttatccggatttactgggtgtaaagggcgagtaggcgggcatacaagtcagatgtgaaatgtgggggcttaactcccaagctgcatttgaaactgtaagtcttgagtgatggagaggcaggcggaattcccggtgtagcggtggaatgcgtagatatcgggaggaacaccagtggcgaaggcggcctgctggacattaactgacgctgaggagcgaaagcgtggggagcaaacagg

SEQ ID NO: 317 - DNA, 252 bp, Unknown
  Artificiall/Consensus sequence
tacggaggatccgagcgttatccggatttattgggcgtaaagcgcgtctaggcggtttggtaagtctgatgtgaaaatgcggggctcaactccgtattgcgttggaaactgccaaactagagtactggagaggtgggcggaactacaagtgtagaggtgaaattcgtagatatttgtaggaatgccgatggggaagccagcccactggacagatactgacgctaaagcgcgaaagcgtgggtagcaaacagg

SEQ ID NO: 318 - DNA, 253 bp, Unknown
  Artificiall/Consensus sequence
tacgtaggtggcaagcgttgtccggaattactgggtgtaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacagg

SEQ ID NO: 319 - DNA, 254 bp, Unknown
  Artificiall/Consensus sequence
tacgtagggtgcgagcgttgtccggaattactgggcgtaaagagctcgtaggtggtttgtcgcgtcgtttgtgtaagtccacagcttaactgtgggactgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacagg

SEQ ID NO: 320 - DNA, 253 bp, Unknown
  Artificiall/Consensus sequence
tacggagggtgcaagcgttaatcggaattactgggcgtaaagcgcacgcaggcggttgattgagtcagatgtgaaatccccgggcttaacccgggaattgcatctgatactggtcagctagagtcttgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 321 - DNA, 253 bp, Unknown
  Artificiall/Consensus sequence
tacgtagggtgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatattacacagaacaccgatagcgaaggcatattactaacaatttattgacgctgatggacgaaagcgtggggagcgaacagg

SEQ ID NO: 322 - DNA, 253 bp, Unknown
  Artificiall/Consensus sequence
tacgtagggggcgagcgttgtccggaatgactgggcgtaaagggcgtgtaggcggttgattaagtctggtgtgaaatacccgcttttaaggtgggtcgtgcattggaaactgattgacttgagtgcggaagaggtaagtggaattcccagtgtagcggtgaaatgcgtagagattgggaggaacaccagtggcgaaggcgacttactgggccgcaactgacgctgaggcgcgaaagcgtggggagcaaacagg

SEQ ID NO: 323 - DNA, 253 bp, Unknown
  Artificiall/Consensus sequence
tacgtaggtggcgagcgttatccggaattactgggcgtaaagggtgtgtaggcgggactgcaagtcagatgtgaaaattacgggctcaactcgtaaagtgcatttgaaactgtggttcttgagagccggaggggtaaatggaattcccagtgtagcggtgaaatgcgtagatattgggaggaacaccagtggcgaaggcgatttactggacggcaactgacgctgagacacgaaagtgtggggagcaaacagg

SEQ ID NO: 324 - DNA, 252 bp, Unknown
  Artificiall/Consensus sequence
tacggaggatgcgagcgttatccggatttattgggtttaaagggtgcgtaggcggcatcataagttagtggtcaaatggtgaggcttcacctcatcacgccattaatactgtggagctagagaacagacgaggcaggcggaataagttaagtagcggtgaaatgcatagatataacttagaaccccgatagcgaaggcagcttgccagactgtaactgacgctgatgcacgagagcgtgggtagcgaacagg

SEQ ID NO: 325 - DNA, 253 bp, Unknown
  Artificiall/Consensus sequence
tacgtagggagcgagcgttgtccggaattactgggcgtaaagggcgcgtaggcggggttttaagtagggtgtgaaaactataggcttaacctgtagactgcatcctaaactgggactcttgagggcaggagaggaaagtggaattcctagtgtagcggtgaaatgcgtagatattaggaggaacaccagtggcgaaggcgactttctggactgtacctgacgctgaggcgcgaaagcgtggggagcgaacagg

SEQ ID NO: 326 - DNA, 253 bp, Unknown
  Artificiall/Consensus sequence
tacagaggtctcaagcgttgttcggaatcactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacagg

SEQ ID NO: 327 - DNA, 253 bp, Unknown
  Artificiall/Consensus sequence
tacgtaggtggcaagcgttatccggatttactgggtgtaaagggcgtgtaggcgggatggtaagtcaggcgtgaaattccagggctcaaccctggaactgcgcttgaaactatcgttcttgagtgatggagaggcaggcggaattccctgtgtagcggtgaaatgcgtagatatagggaggaacaccagtggcgaaggcggcctgctggacattaactgacgctgaggcgcgaaagcgtggggagcaaacagg

SEQ ID NO: 328 - DNA, 253 bp, Unknown
  Artificiall/Consensus sequence
tacgtagggggcgagcgttgtccggaattattgggcgtaaagggcgcgtagacggctagataagttataggtgaaagcccgtttttcaaggacggaactgcctgtaagactgtatagctagagtgcaggagagggaagcggaattccaagtgtagcggtgaaatgcgtagatatttggaggaacaccagtggcgaaggcggctttctggactgtaactgacgttgaggcgcgaaagcgtggggagcgaacagg

SEQ ID NO: 329 - DNA, 253 bp, Unknown
  Artificiall/Consensus sequence
tacgtagggagcgagcgttgtccggaattactgggcgtaaagggtgcgtaggcggttatttaagtcagatgtgaaatacttgagcttaactcaggggctgcatctgatactgggtgactagagtgcaggagaggaaagtggaattcctagtgtagcggtggaatgcgtagatattaggaggaacaccagtggcgaaggcgactttctggactgtaactgacgctgaggcacgaaagtatgggtagcaaacagg

SEQ ID NO: 330 - DNA, 252 bp, Unknown
  Artificiall/Consensus sequence
tacgtatggaccgagcgttatccggaatcattgggcgtaaagggtacgtaggcggttaaataagttagaagtgaaatcccatagctcaactatagtaagcttctaaaactgtataacttgagaaatgaaagggaaagtggaattcctagtgtagcggtgaaatgcgcagatattaggaggaataccggtggcgaaggcgactttctggtcatattctgacgctgaggtacgaaagcgtgggtagcaaacagg

SEQ ID NO: 331 - DNA, 252 bp, Unknown
  Artificiall/Consensus sequence
tacgtagggagcgagcgttatccggatttattgggtgtaaagggtgcgtaggcggtctattaagtctgtggtctaagcccgaagcttaacttcggttcgccacagaaactgattgacttgagtatggtagaggcaagtggaatttctagtgtagcggttaaatgcgtagatattagaaggaacaccagtggcgaaggcgacttgctgggccatcactgacgctgaggcacgaaagcgtggggagcaaatagg

SEQ ID NO: 332 - DNA, 252 bp, Unknown
  Artificiall/Consensus sequence
tacgtaggtggcaagcgttatccggaattattgggcgtaaagggtgcgtaggcggcggattaagtccggagtaaaattgtggggctcaaccccatcgagctttggaaactggtcggctggagtgcaggagaggcagatggaattccatgtgtagcggtaaaatgcgtagatatatggaggaacaccagtggcgaaggcggtctgctggcctgcaactgacgctgaagcacgaaagcgtggggagcaaatagg

SEQ ID NO: 333 - DNA, 253 bp, Unknown
  Artificiall/Consensus sequence
tacgtaggtggcgagcgttatccggaattattgggtgtaaagggtgcgtaggcgggtcgtaaagtcagatgtgaaatgcggaggctcaacctccgaactgcatttgaaacttacgatcttgagtggagtagaggcaagcggaattcccggtgtagcggtgaaatgcatagatatcgggaggaacaccagtggcgaaggcggcttgctgggcttttactgacgctgaggcacgaaagtgtggggagcaaacagg

SEQ ID NO: 334 - DNA, 253 bp, Unknown
  Artificiall/Consensus sequence
tacgtagggggcaagcgttgttcggaattactgggcgtaaagcgcacgcaggctgaccgttaagtctgtcgtcaaaggcgggggctcaacctccgttctacgatagatactgtcggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacggg

SEQ ID NO: 335 - DNA, 252 bp, Unknown
  Artificiall/Consensus sequence
tacgtaggtggcaagcgttgtccggaattactgggtgtaaagggagcgtaggcgggatgctaagcaaattgtgaaaccaatcggctcaaccggttgttgcgatttgaactggtgtccttgagtggagtagaggcaggcggaattcccagtgtagcggtgaaatgcgtagatattgggaggaacaccagtggcgaaggcggcctgctgggctctaactgacgctgaagctcgaaagtgtgggtagcaaacagg

SEQ ID NO: 336 - DNA, 253 bp, Unknown
  Artificiall/Consensus sequence
tacgtagggggcaagcgttatccggaattactgggtgtaaagggtgcgtaggtggtacggcaagtcagaagtgaaagcccggggctcaaccccgggactgcttttgaaactgccggactggagtgcaggagaggtaagcggaattcctagtgtagcggtgaaatgcgtagatattaggaggaacaccagtggcgaaggcggcttactggactgtgactgacactgaggcacgaaagcgtggggagcaaacagg

SEQ ID NO: 337 - DNA, 253 bp, Unknown
  Artificiall/Consensus sequence
tacgtagggggcaagcgttatccggatttactgggtgtaaagggagcgcaggcgggaaagcaagtcagctgtgaaatccatgggcttaacccatgaactgcagttgaaactgtttttcttgagtgaagtagaggttggcggaattccgagtgtagcggtgaaatgcgtagatattcggaggaacaccggtggcgaaggcggccaactgggcttttactgacgctgaggctcgaaagtgtggggagcaaacagg

SEQ ID NO: 338 - DNA, 253 bp, Unknown
  Artificiall/Consensus sequence
tacgtaggtggcaagcgttatccggatttactgggtgtaaagggcgtgtaggcgggcgagcaagtcagatgtgaaattccagggctcaaccctggaactgcatttgaaactgttggtcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacagg

SEQ ID NO: 339 - DNA, 253 bp, Unknown
  Artificiall/Consensus sequence
tacgtagggagcgagcgttgtccggaattactgggtgtaaagggagtgtaggcgggatggtaagttaggtgtgaaatgcggaggctcaacctccgagctgcacttaaaactgctgttcttgagtgaagtagaggttggcggaattcccagtgtagcggtgaaatgcgtagatattgggaggaacatcagtggcgaaggcggccaactgggcttttactgacgctgaggctcgaaagcgtggggagcaaacagg

SEQ ID NO: 340 - DNA, 252 bp, Unknown
  Artificiall/Consensus sequence
tacgtagggggcaagcgttatccggaattattgggcgtaaagagtatgtaggtggtttcttaagcgcagggtataaggcaatggcttaaccattgttcgccccgtgaactgagagacttgagtgctggagaggaaagcggaattcctagtgtagcggtgaaatgcgtagatattaggaggaacaccagtggcgaaggcggctttctggacagtaactgacactgagatacgaaagcgtggggagcaaacagg

SEQ ID NO: 341 - DNA, 252 bp, Unknown
  Artificiall/Consensus sequence
tacgtagggggcgagcgttatccggaattattgggcgtaaagagtgcgtaggcggttttgtaagcgtggggtgaaaggcaatggctcaaccattgtaagccccgcgaactgtgagacttgagtgtgggagaggaaagcggaattcctagtgtagcggtgaaatgcgtagatattaggaggaacaccagtggcgaaggcggctttctggaccataactgacgctgaggcacgaaagcgtggggagcaaacagg

SEQ ID NO: 342 - DNA, 252 bp, Unknown
  Artificiall/Consensus sequence
tacgtaggtggcaagcgttgtccggatttactgggtgtaaagggagcgcaggtggaaacgcaagtaggatgtctaatctacgggctcaacccgtaaccgcattctaaactgtgtttcttgagtggagtagaggcaggcggaattcccggtgtagcggtggaatgcgtagatatcgggaggaacaccagtggcgaaggcggcctgctgggctctaactgacactgaggctcgaaagcgtgggtagcaaacagg

SEQ ID NO: 343 - DNA, 253 bp, Unknown
  Artificiall/Consensus sequence
tacgtaggtggcaagcgttgtccggatttactgggtgtaaagggcgtgtaggcggggaagtaagtcagatgtgaaataccggagcttaactccggggctgcatttgaaactgcatctcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacagg

SEQ ID NO: 344 - DNA, 253 bp, Unknown
  Artificiall/Consensus sequence
tacgtaggtggcgagcgttatccggatttactgggtgtaaagggcgcgtaggcgggaaagcaagtcagatgtgaaaactatgggcttaacccatagcctgcatttgaaactgtttttcttgagtgctggagaggcaatcggaattccatgtgtagcggtgaaatgcgtagatatatggaagaacaccagtggcgaaggcggattgctggacagtaactgacgctgaggcgcgagagcgtggggagcaaacagg

SEQ ID NO: 345 - DNA, 252 bp, Unknown
  Artificiall/Consensus sequence
tacgtaaggaccgagcgttgtccggaatcattgggcgtaaagggtacgtaggcggttagaaaagttagaagtgaaaggctatagctcaactatagtaagcttttaaaactgtttaacttgagagatggaagggaaagtggaattcctagtgtagcggtgaaatgcgcagatattaggaggaataccggtggcgaaggcgactttctggccattatctgacgctgaggtacgaaagcgtgggtagcaaacagg

SEQ ID NO: 346 - DNA, 252 bp, Unknown
  Artificiall/Consensus sequence
tacgtaggtggcaagcgttgtccggaattactgggtgtaaagggagcgtaggcgggagtgcaagtcggctgtctaaactatgggctcaacccataatcgcggccgaaactgtacttcttgagtgaagtagaggtaagcggaattcctagtgtagcggtgaaatgcgtaaatattaggaggaacaccagtggcgaaggcggcttactgggctttaactgacgctgaggctcgaaagcgtgggtagcaaacagg

SEQ ID NO: 347 - DNA, 253 bp, Unknown
  Artificiall/Consensus sequence
tacgtagggggcaagcgttatccggatttactgggtgtaaagggagcgtaggcggcagggcaagtcagatgtgaaagcccggggctcaaccccgggactgcatttgaaactacccagctagagtgtgggagaggtaagtggaattcctagtgtagcggtgaaatgcgtagatattaggaggaacaccagtggcgaaggcggcttactggaccataactgacgctgatgctcgaaagcgtggggagcaaacagg

SEQ ID NO: 348 - DNA, 253 bp, Unknown
  Artificiall/Consensus sequence
tacgtagggagcgagcgttgtccggaatgactgggcgtaaagggcgcgtaggcggcctggcaagtttggagtgaaagccccattttcaaggtggggactgctttgaagactgcgaggcttgagtgagggagaggatagcggaattcccggtgtagcggtgaaatgcgtagagatcgggaggaacaccagtggcgaaggcggctatctggacctagactgacgctgaggcgcgaaagcgtggggagcaaacagg

SEQ ID NO: 349 - DNA, 253 bp, Unknown
  Artificiall/Consensus sequence
tacgtagggggcaagcgttgtccggaattattgggcgtaaagggtgcgtaggcggccgatcaagtcaggtgtgaaagacccgtgcttaacatgggggttgcacttgaaactggttggcttgagtatgggagaggcaagcggaattcccggtgtagcggtgaaatgcgtagagatcgggaggaacaccagtggcgaaggcggcttgctggaccaaaactgacgctgaggcacgaaagcgtgggtagcaaacagg

SEQ ID NO: 350 - DNA, 253 bp, Unknown
  Artificiall/Consensus sequence
aacgtaggtcacaagcgttgtccggaattactgggtgtaaagggagcgcaggcggaccggcaagttggaagtgaaatccatgggctcaacccgtgaattgctttcaaaactgctggccttgagtagtgcagaggtaggtggaattcccggtgtagcggtggaatgcgtagatatcgggaggaacaccagtggcgaaggcggcctactgggcaccaactgacgctgaggctcgaaagtgtgggtagcaaacagg

SEQ ID NO: 351 - DNA, 253 bp, Unknown
  Artificiall/Consensus sequence
tacgtaggtggcaagcgttgtccggatttactgggtgtaaagggcgtgtagacgggtttgcaagtcagatgtgaaataccgcagcttaactgcggggctgcatttgaaactgcaaatcttgagtgcgggagaggaaagcggaattcctagtgtagcggtgaaatgcgtagatattaggaggaacaccagtggcgaaggcggctttctggaccgtaactgacgttgaggcgcgaaagcgtgggtagcaaacagg

SEQ ID NO: 352 - DNA, 253 bp, Unknown
  Artificiall/Consensus sequence
tacgtaggtggcgagcgttgtccggatttactgggtgtaaagggcgtgtagccggggagacaagtcagatgtgaaatctatgggctcaactcataaattgcatttgaaactgtttttcttgagtgctggagaggcagacggaattcctagtgtagcggtgaaatgcgtagatattaggaggaacaccagtggcgaaggcggtctgctggacagtaactgacggtgaggcgcgaaagcgtggggagcaaacagg

SEQ ID NO: 353 - DNA, 254 bp, Unknown
  Artificiall/Consensus sequence
tacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacagg

SEQ ID NO: 354 - DNA, 252 bp, Unknown
  Artificiall/Consensus sequence
tacggaggatgcgagcgttatccggatttattgggtttaaagggtgcgcaggcgggctgttaagccggcggtaaaaattcagggctcaaccctgtcgagccgtcggaactggcagtcttgagtgggcgagaagtatgcggaatgcgtggtgtagcggtgaaatgcatagatatcacgcagaacgccgattgcgaaggcagcataccggcgcccaactgacgctgaggcacgaaagcgtggggatcgaacagg

SEQ ID NO: 355 - DNA, 253 bp, Unknown
  Artificiall/Consensus sequence
tacgtaggaggcaagcgttatccggaatgactgggcgtaaagggtgcgtaggtggtttgacaagttggtagcgtaactccggggctcaacctcggcactactaccaaaactgttggacttgagtgcaggaggggcaaatggaattcctagtgtagcggtggaatgcgtagatattaggaggaacaccagtggcgaaggcgatttgctggactgtaactgacactgaggcacgaaagcgtggggagcaaacagg

SEQ ID NO: 356 - DNA, 253 bp, Unknown
  Artificiall/Consensus sequence
tacgtagggagcgagcgttgtccggaattactgggtgtaaagggtgcgtaggcgggatggcaagtcagacgtgaaataccggggcttaactccggagctgcgtttgaaactgtcgttcttgagtgaagtagaggcaggcggaattcccagtgtagcggtgaaatgcgtagatattgggaggaacaccagtggcgaaggcggcctgctgggctttaactgacgctgaggcacgaaagtatggggagcaaacagg

SEQ ID NO: 357 - DNA, 253 bp, Unknown
  Artificiall/Consensus sequence
tacggaggatccgagcgttatccggatttactgggtgtaaagggagcgtagacggcgtatcaagtctgatgtgaaaggcaggggcttaacccctggactgcattggaaactggtatgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 358 - DNA, 253 bp, Unknown
  Artificiall/Consensus sequence
tacgtaggtcccgagcgttgtccggatttattgggcgtaaagcgagcgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacagg

SEQ ID NO: 359 - DNA, 253 bp, Unknown
  Artificiall/Consensus sequence
tacgtagggggcaagcgttatccggatttactgggtgtaaagggcgtgtaggcggagatgcaagttaggagtgaaatctatgggctcaacccataaactgcttctaaaactgtatcccttgagtatcggagaggcaagcggaattcctagtgtagcggtgaaatgcgtagatattaggaggaacaccagtggcgaaggcggcttgctggacgacaactgacgctgaggcgcgaaagcgtggggagcaaacagg

SEQ ID NO: 360 - DNA, 252 bp, Unknown
  Artificiall/Consensus sequence
tacgtaggtggcgagcgttatccggatttattgggcgtaaagggtgcgcagacggtttattaagtctaaaatcaaatcttggggctcaaccccattccgttttagaaactggtagacttgagtatggtagaggcaaatggaattcctagtgtagcggtggaatgcgtagatattaggaggaacaccagtggcgaaggcgatttgctgggccattactgacgttcaggcacgaaagcgtggggagcaaatagg

SEQ ID NO: 361 - DNA, 254 bp, Unknown
  Artificiall/Consensus sequence
tacatatggggcgagcgttatccggatttattgggtgtaaagggttcgtaggcgggaaagtaagtcagtatgtgaaatccctcggctcaaccgaggaactgcgattgaaactatttttcttgagtactggaggggaaagtggaattcttagtgtagcggtgaaatgcgtagatattaggaagaacaccagtggcgaaggcgactttctggacagtaactgacgctgaggaacgaaagtgtggggagcaaacagg

SEQ ID NO: 362 - DNA, 253 bp, Unknown
  Artificiall/Consensus sequence
tacgtagggagcgagcgttgtccggaattactgggtgtaaagggagcgtaggcgggagatcaagtcagatgtgaaaactacgggctcaacccgtaacctgcatttgaaactggttttcttgagtgaagtagaggcaggcggaattccgagtgtagcggtgaaatgcgtagatattcggaggaacaccagtggcgaaggcggcctgctgggcttttactgacgctgaggctcgaaagcatggggagcaaacagg

SEQ ID NO: 363 - DNA, 252 bp, Unknown
  Artificiall/Consensus sequence
tacgtagggggcgagcgttatccggatttattgggcgtaaagcgtgtgtaggcggtttgttaagtctaagatcaaagcccgaggctcaacctcggttcgtcttagaaactggcagacttgagtgcagtagaggcaagtggaatttctagtgtagcggttaaatgcgtagatattagaaggaacaccagtggcgaaggcggcttgctgggctgttactgacgctgagacacgaaagcgtggggagcaaatagg

SEQ ID NO: 364 - DNA, 253 bp, Unknown
  Artificiall/Consensus sequence
  misc_feature (3)..(3): n is a, c, g, or t
  misc_feature (252)..(253): n is a, c, g, or t
tangtagggggcaagcgttatccggatttactgggtgtaaagggagcgtagacggcatggcaagtctgaagtgaaatgcgggggctcaacccctgaactgctttggaaactgtcaggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacann

SEQ ID NO: 365 - DNA, 253 bp, Unknown
  Artificiall/Consensus sequence
tacggaggatccgagcgttatccggatttattgggtttaaagggagcgtaggcggacgcttaagtcagttgtgaaagtttgcggctcaaccgtaaaattgcagttgatactggtatccttgagtgcagcataggtgggcggaattcgtggtgtagcggtgaaatgcttagatatcacgaagaactccgattgcgaaggcagcctgctggactgtaactgacgctgatgctcgaaagtgtgggtatcaaacagg

SEQ ID NO: 366 - DNA, 252 bp, Unknown
  Artificiall/Consensus sequence
tacgtaggtggcaagcgttatccggaattactgggcgtaaagagtgagcaggcggttagataagtctatggttaaatgcaacagctcaactgttgttcgctatagaaactatttaactagagtgcgggagaggtaagtggaactccatatgtagcggtggaatgcttagatatatggaagaacaccagaggcgaaggcggcttaccagtccgtaactgacgctcagtcacgaaagcgtggggagcaaatagg

SEQ ID NO: 367 - DNA, 253 bp, Unknown
  Artificiall/Consensus sequence
tacgtagggggcaagcgttatccggatttactgggtgtaaagggagcgtagacggaatagcaagtcagatgtgaaaggcatgggcttaacctgtggactgcatttgaaactgccattctggagtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 368 - DNA, 252 bp, Unknown
  Artificiall/Consensus sequence
tacgtaggtggcaagcgttgtccggaattactgggtgtaaagggagcgtaggcgggaatacaagttggatgtctaatctaccggcttaaccggtattcgcattcaaaactgtatttcttgagtgaagtagaggcaggcggaattcctagtgtagcggtgaaatgcgtagatattaggaggaacaccagtggcgaaggcggcctgctgggctttaactgacgctgaggctcgaaagcgtgggtagcaaacagg

SEQ ID NO: 369 - DNA, 253 bp, Unknown
  Artificiall/Consensus sequence
tacgtatgtcgcgagcgttatccggaattattgggcataaagggcatctaggcggcctgacaagtcaggggtgaaaacctgcggctcaaccgcaggcctgcctttgaaactgtaaggctggagtaccggagaggtggacggaactgcacgagtagaggtgaaattcgtagatatgtgcaggaatgccgatgatgaagatagtccactggacggaaactgacgctgaagtgcgaaagctaggggagcaaacagg

SEQ ID NO: 370 - DNA, 253 bp, Unknown
  Artificiall/Consensus sequence
tacgtatggtgcaagcgttatccggaatgactgggtgtaaagggagcgtagacggttgtacaagtctgatgtgaaagcccacggctcaactgtgggagtgcattggaaactgtagaactagagtatcggagaggcaagtggaattcctagtgtagcggtgaaatgcgtagatattaggaggaacaccagtggcgaaggcggcttgctggacgaaaactgacgttgaggctcgaaagcgtggggagcaaacagg

SEQ ID NO: 371 - DNA, 253 bp, Unknown
  Artificiall/Consensus sequence
tacgtaggtggcaagcgttgtccggatttactgggtgtaaagggagcgtaggcgggaatgcaagtcggatgtgaaacctatgggcttaacccatagcctgcattcgaaactgtatttcttgagtgaagtagaggttggcggaattcccggtgtagcggtgaaatgcgtagatatcgggaggaacaccagtggcgaaggcggccaactgggcttttactgacgctgaggctcgaaagcatggggagcaaacagg

SEQ ID NO: 372 - DNA, 253 bp, Unknown
  Artificiall/Consensus sequence
aacgtaggtggcaagcgttgtccggaattactgggtgtaaagggagcgcaggcggagcggcaagttggaagtgaaatacatgggctcaacccatgaactgctttcaaaactgtcggtcttgagtggtgcagaggtaggcggaattcccggtgtagcggtggaatgcgtagatatcgggaggaacaccagtggcgaaggcggcctgctgggcactaactgacgctgaggctcgaaagtatggggagcaaacagg

SEQ ID NO: 373 - DNA, 252 bp, Unknown
  Artificiall/Consensus sequence
tacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagcggaattcctagtgtagcggtgaaatgcgtagatattaggaggaacaccagtggcgaaagcggctttctggacgaaaactgacgctgaggcgcgaaagccaggggagcgaacggg

SEQ ID NO: 374 - DNA, 254 bp, Unknown
  Artificiall/Consensus sequence
  misc_feature (3)..(3): n is a, c, g, or t
  misc_feature (253)..(254): n is a, c, g, or t
tangtagggggcgagcgttatccggattcattgggcgtaaagcgcgcgtaggcggcccggcaggccggggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacann

SEQ ID NO: 375 - DNA, 252 bp, Unknown
  Artificiall/Consensus sequence
tacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtggcgaaggcggtcaactggacgataactgacgctgaggcgcgaaagcgtggggagcaaacagg

SEQ ID NO: 376 - DNA, 252 bp, Unknown
  Artificiall/Consensus sequence
tacgtaggtggcaagcgttatccggaattattgggcgtaaagagtgagcaggcggttatttaagtctgaagtcaaaggctatggctcaaccatagttcgctttggaaactggatgactagagtgcgagagaggtaagcggaattccatgtgtagcggtgaaatgcgtagatatatggaggaacaccagtggcgaaggcggcttactagctcgtaactgacgctcagtcacgaaagcgtgggtagcaaatagg

SEQ ID NO: 377 - DNA, 253 bp, Unknown
  Artificiall/Consensus sequence
tacgtagggagcgagcgttgtccggatttactgggtgtaaagggcgcgtaggcggggaagcaagtcaggtgtgaaatctatgggctcaacccataaactgcacttgaaactgtttttcttgagtgatggagaggcaagcggaattcctagtgtagcggtgaaatgcgtagatattaggaggaacaccagtggcgaaggcggcttgctggacattaactgacgctgaggcgcgaaagcgtggggagcaaacagg

SEQ ID NO: 378 - DNA, 253 bp, Unknown
  Artificiall/Consensus sequence
tacgtaggtggcaagcgttgtccggatttactgggtgtaaagggcgagtaggcgggacggaaagtcagtagtgaaataccgaggcttaacttcggggctgctattgaaacttctgttcttgagtgatggagaggcaggcggaattcccggtgtagcggtgaaatgcgtagagatcgggaggaacaccagtggcgaaggcggcctgctggacattaactgacgctgaggcgcgaaagcgtggggagcaaacagg

SEQ ID NO: 379 - DNA, 252 bp, Unknown
  Artificiall/Consensus sequence
tacgtaggtggcaagcgttgtccggaattactgggtgtaaagggagcgtaggcgggtgaacaagttgaatgttaaacctatcggcttaaccggtagttgcgttcaaaactgtacatcttgagtgaagtagaggcaggcggaattcctagtgtagcggtgaaatgcgtagatattaggaggaacaccagtggcgaaggcggcctgctgggcttttactgacgctgaggctcgaaagtgtggggagcaaacagg

SEQ ID NO: 380 - DNA, 253 bp, Unknown
  Artificiall/Consensus sequence
tacgtagggagcgagcgttgtccggaattactgggtgtaaagggagcgtaggcggggttgcaagttgaatgtgaaacctaccggcttaactggtagactgcgttcaaaactgcaattcttgagtgaagtagaggcaggcggaattcctagtgtagcggtgaaatgcgtagatattaggaggaacaccagtggcgaaggcggcctgctgggcttaaactgacgctgaggctcgaaagcgtggggagcaaacagg

SEQ ID NO: 381 - DNA, 253 bp, Unknown
  Artificiall/Consensus sequence
tacgtagggggcaagcgttatccggatttactgggtgtaaagggagcgtaggtggtactgcaagtcagaagtgaaagccccgtgcttaacgtggggactgcttttgaaactgtgggactagagtgcaggagaggtaagtggaattcctagtgtagcggtgaaatgcgtagatattaggaggaacaccggtggcgaaggcggcttactggactgtaactgacactgaggctcgaaagcgtggggagcaaacagg

SEQ ID NO: 382 - DNA, 253 bp, Unknown
  Artificiall/Consensus sequence
tacggagggtgcaagcgttactcggaatcactgggcgtaaagagtgcgcaggcggggtggtaagtcagatgtgaaatcctgtagcttaactacagaactgcatttgaaactatcactctagagtatgggagaggtaggtggaattcttggtgtaggggtaaaatccgtagagatcaagaggaatactcattgcgaaggcgacctactggaacattactgacgctcatgcacgaaagcgtggggagcaaacagg

SEQ ID NO: 383 - DNA, 253 bp, Unknown
  Artificiall/Consensus sequence
tacgtagggagcgagcgttgtccggaattactgggtgtaaagggagcgtaggcgggattgcaagtcagatgtgaaatttatgggctcaacccataacgtgcatttgaaactgcagttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacagg

SEQ ID NO: 384 - DNA, 253 bp, Unknown
  Artificiall/Consensus sequence
tacgtagggggcaagcgttatccggatttactgggtgtaaagggagcgtagacggcagcgcaagtctggagtgaaatgccggggcccaaccccggaactgctctggaaactgtgaagctggagtgcaggagaggtaagcggaattcctggtgtagcggtgaaatgcgtagatatcaggaggaacaccggcggcgaaggcggcttactggactgtaactgacgttgaggctcgaaggcgtggggagcaaacagg

SEQ ID NO: 385 - DNA, 252 bp, Unknown
  Artificiall/Consensus sequence
tacgtagggagcgagcgttgtccggaattactgggtgtaaagggagcgtaggcgggaagacaagttggatgttaaatatatcggctcaaccggtatccgcattcaaaactgtttttcttgagtaaagtagaggcaggcggaattcctagtgtagcggtgaaatgcgtagatattaggaggaacaccagtggcgaaggcggcctgctgggcttttactgacgctgaggctcgaaagcgtgggtagcaaacagg

SEQ ID NO: 386 - DNA, 253 bp, Unknown
  Artificiall/Consensus sequence
tacgtagggagcaagcgttgtccggatttactgggtgtaaagggtgcgtaggcggctttgcaagtcagaagtgaaatccatgggcttaacccatgaactgcttttgaaactgcagagcttgagtggagtagaggtaggcggaattcccggtgtagcggtgaaatgcgtagagatcgggaggaacaccagtggcgaaggcggcctgctgggctctaactgacgctgaggcacgaaagcgtgggtagcaaacagg

SEQ ID NO: 387 - DNA, 253 bp, Unknown
  Artificiall/Consensus sequence
tacgtaggtggcgagcgttgtccggaattactgggtgtaaagggcgagtaggcggacacacaagtcagaagtgaaatctctgggcttaacccagaaactgcttttgaaactgtatgccttgagtgccggagaggaaagcggaattcctagtgtagcggtgaaatgcgtagatattaggaggaacaccagtggcgaaggcggctttctggacggtaactgacgctgaggcgcgaaagcgtggggagcaaacagg

SEQ ID NO: 388 - DNA, 253 bp, Unknown
  Artificiall/Consensus sequence
tacgtaggtggcaagcgttgtccggaattactgggtgtaaagggagcgcaggcgggaagccaagtcagctgtgaaaactacaggcttaacttgtagactgcagttgaaactggttttcttgagtgaagtagaggttggcggaattccgagtgtagcggtgaaatgcgtagatattcggaggaacaccggtggcgaaggcggccaactgggctttaactgacgctgaggctcgaaagcgtggggagcaaacagg

SEQ ID NO: 389 - DNA, 253 bp, Unknown
  Artificiall/Consensus sequence
tacgtagggagcaagcgttgtccggatttactgggtgtaaagggtgcgtaggcggctatgcaagtcagaagtgaaatctgtgggcttaacccacaaactgcttttgaaactgtgtggcttgagtgaagtagaggtaggcggaattcccggtgtagcggtggaatgcgtagagatcgggaggaacaccagtggcgaaggcggcctactgggctttaactgacgctgaagcacgaaagcatgggtagcaaacagg

SEQ ID NO: 390 - DNA, 253 bp, Unknown
  Artificiall/Consensus sequence
tacggaggatccaagcgttatccggatttattgggtttaaagggtgcgtaggcggattgataagttagaggtgaaatgtccgagcttaactcgggaactgcctctaatactgttgatctagagagtagatgcggtaggcggaatgtatggtgtagcggtgaaatgcttagagatcatacagaacaccgattgcgaaggcagcttaccaatctatatctgacgttgaggcacgaaagcgtggggagcaaacagg

SEQ ID NO: 391 - DNA, 253 bp, Unknown
  Artificiall/Consensus sequence
tacgtaggtggcaagcgttatccggaattactgggcgtaaagggtgtgtaggcgggaagacaagtcagatgtgaaaattatgggcttaacccataacctgcatttgaaactgtttttcttgaggatgggagaggtaaatggaattcccggtgtagcggtgaaatgcgtagatatcgggaggaacaccagtggcgaaggcggtttactggaccattactgacgctgagacacgaaagcgtggggagcaaacagg

SEQ ID NO: 392 - DNA, 252 bp, Unknown
  Artificiall/Consensus sequence
tacggagggtgcaagcgttaatcggaattactgggcgtaaagcgcgtctaggcggcttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacagg

SEQ ID NO: 393 - DNA, 252 bp, Unknown
  Artificiall/Consensus sequence
tacggaggatccgagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacagg

SEQ ID NO: 394 - DNA, 253 bp, Unknown
  Artificiall/Consensus sequence
tacgtaggtggcgagcgttgtccggaattactgggcgtaaagggcgcgtaggcggatgcttaagtcagatgtgaaagccccgggcttaacttggggattgcatttgatactgggtatcttgaggacaggagaggaaagcggaattcctagtgtagcggtgaaatgcgtagatattaggaggaacaccagtggcgaaggcggctttctggactgtaactgacgctgaggcgcgaaagcgtggggagcgaacggg

SEQ ID NO: 395 - DNA, 253 bp, Unknown
  Artificiall/Consensus sequence
tacgtagggggcaagcgttatccggatttactgggtgtaaagggagcgtagacggcaatgcaagccagatgtgaaaacccgcagctcaactgggggagtgcatttggaactgtgtagctggagtgcaggagaggtaagcggaattcctggtgtagcggtgaaatgcgtagatatcaggaggaacaccagtggcgaaggcggcttactggactgtaactgacgttgaggctcgaaagcgtggggagcaaacagg

SEQ ID NO: 396 - DNA, 253 bp, Unknown
  Artificiall/Consensus sequence
tacgtagggggcgagcgttatccggaattactgggtgtaaagggagcgtagacggcgaggtaagcctgaagtggaagcccgcggcccaaccgcggaactgctttgggaactgttttgctggagtatgggaggggtaagcggaattcctggtgtagcggtgaaatgcgtagatatcaggaggaacaccggtggcgaaggcggcttactggaccataactgacgttgaggctcgaaagcgtggggagcgaacagg

SEQ ID NO: 397 - DNA, 253 bp, Unknown
  Artificiall/Consensus sequence
tacgtagggggcgagcgttgtccggaatgactgggcgtaaagggagtgtaggcggctgcttaagttatatgtgaaatcccgcggcttaactgcggaactgcatataaaactgggcagctggagtgcaggagaggtaagtggaattcctagtgtagcggtggaatgcgtagatattaggaggaacaccagaggcgaaggcggcttactggactgtaactgacgctgaggctcgaaagcgtggggagcaaacagg

SEQ ID NO: 398 - DNA, 252 bp, Unknown
  Artificiall/Consensus sequence
tacggaggatgcgagcgttatccggatttattgggtttaaagggtgcgtaggcggcattataagttagtggtaaaatattggggcttcacctcactacgccattaatactgtagagctagagaacagacgaggtaggcggaataagttaagtagcggtgaaatgcatagatataacttagaacaccgatagcgaaggcagcttaccagactgagtctgacgctgatgcacgagagcatgggtagcgaacagg

SEQ ID NO: 399 - DNA, 253 bp, Unknown
  Artificiall/Consensus sequence
tacgtaggtggcaagcgttgtccggatttactgggtgtaaagggcgcgtaggcgggcaagcaagtcagatgtgaaataccggggcttaaccccggggctgcatttgaaactgcatgtcttgagtgtcggagaggaaagcggaattcctagtgtagcggtgaaatgcgtagatattaggaggaacaccggtggcgaaggcggctttctggacgataactgacgctgaggcgcgaaagtgtggggagcaaacagg

SEQ ID NO: 400 - DNA, 253 bp, Unknown
  Artificiall/Consensus sequence
tacgtagggggcaagcgttatccggatttactgggtgtaaagggagcgtaggcggccagtcaagtcagaagtgaaagcccggggcttaaccccgggactgcttttgaaactgtctggctagattgcaggagaggtaagtggaattcctagtgtagcggtgaaatgcgtagatattaggaggaacaccagtggcgaaggcggcttactggactgtaaatgacgctgaggctcgaaagcgtggggagcaaacagg

SEQ ID NO: 401 - DNA, 252 bp, Unknown
  Artificiall/Consensus sequence
tacgtaggtggcaagcgttgtccggaattactgggtgtaaagggagcgtaggcgggatggtaagttgaatgtgaaatctatgggcttaacccatagctgcgttcaaaactacgattcttgagtgaagtagaggcaggcggaattcctagtgtagcggtgaaatgcgtaaatattaggaggaacaccagtggcgaaggcggcctgctgggctttaactgacgctgaagctcgaaagcgtgggtagcaaacagg

SEQ ID NO: 402 - DNA, 253 bp, Unknown
  Artificiall/Consensus sequence
tacgtagggggcaagcgttgtccggaatcactgggcgtaaagggcgcgtaggcggccaattaagtcagttgtgaaatacctctgcttaacggaggggggtcagttgaaactgattggctggagtgcaggagaggaaagtggaattcccggtgtagcggtggaatgcgtagagatcgggaggaacaccagtggcgaaggcgactttctggactgtaactgacgctgaggcgcgaaagcgtggggagcaaacagg

SEQ ID NO: 403 - DNA, 252 bp, Unknown
  Artificiall/Consensus sequence
tacgtagggggcgagcgttatccggatttattgggcgtaaagcgttcgtaggcggcttgttaagtctaagatttaagcccgaggctcaacctcggttcgtcttagaaactggcaaacttgagtgtggtagaggcaagtggaatttctagtgtagcggttaaatgcgtagatattagaaggaacaccagtggcgaaggcggcttgctgggccatcactgacgctgaggaacgaaagcgtggggagcaaatagg

SEQ ID NO: 404 - DNA, 253 bp, Unknown
  Artificiall/Consensus sequence
aacgtaggtggcaagcgttatccggaattactgggtgtaaagggagcgcaggtgggacagcaagtcgaatgtgaaaactacgggctcaacccgtagattgcgttcgatactgccgttcttgagtggagtagaggcaggcggaattcccggtgtagcggtggaatgcgtagatatcgggaggaacaccagtggcgaaggcggcctgctgggctctaactgacactgaggctcgaaagcgtggggagcaaacagg

SEQ ID NO: 405 - DNA, 252 bp, Unknown
  Artificiall/Consensus sequence
tacgtaggtggcaagcgttgtccggaattactgggtgtaaagggagcgtaggcgggaagacaagttggatgtttaatctaccggctcaaccggtagccgcattcaaaactgtttttcttgagtgaagtagaggtaggcggaattcctagtgtagcggtggaatgcgtagatattaggaggaacaccagtggcgaaggcggcctactgggctttaactgacgctgaggctcgaaagcgtgggtagcaaacagg

SEQ ID NO: 406 - DNA, 253 bp, Unknown
  Artificiall/Consensus sequence
tacgtagggagcgagcgttatccggatttactgggtgtaaagggtgcgtaggcggtttgttaagtcagaagtgaaatttaggggctcaacctctaagctgcttctgaaactgatgaactagagtgtgggagaggaaagtggaattccgagtgtagcggtgaaatgcgtagagattcggaggaacaccagtagcgaaggcggctttctggactgtaactgacactgaggctcgaaagccaggggagcgaacggg

SEQ ID NO: 407 - DNA, 253 bp, Unknown
  Artificiall/Consensus sequence
tacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggctgtaactgacgctgagaagcgaaagcatggggagcgaacagg

SEQ ID NO: 408 - DNA, 252 bp, Unknown
  Artificiall/Consensus sequence
tacggaggatccgagcgttatccggatttattgggtttaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcacgaaagcgtggggagcaaacagg

SEQ ID NO: 409 - DNA, 253 bp, Unknown
  Artificiall/Consensus sequence
tacgtagggagcgagcgttgtccggaattactgggcgtaaagggcgcgtaggcggctatgcaagtcttatgtgaaagtcccgggcttaacttggggagtgcataggaaactgtgtggcttgagtgtggtagaggatcgtggaattcctagtgtagcggtgaaatgcgtagatattaggaggaacaccagtggcgaaggcgacgatctgggccataactgacgctgaggcgcgaaagcgtggggagcaaacagg

SEQ ID NO: 410 - DNA, 253 bp, Unknown
  Artificiall/Consensus sequence
tacgtaggatgcaagcgttatccggaatgactgggcgtaaagggtgcgtaggcggcatgtcaagttggcagcgtaatgccggggcttaactccggaactactgccaaaactgacaggctggagtgcggcaggggtatgtggaattcctagtgtagcggtggaatgcgtagatattaggaggaacaccggtggcgaaagcgacatactgggccgtaactgacgctgaggcacgaaagcgtggggagcaaacagg

SEQ ID NO: 411 - DNA, 253 bp, Unknown
  Artificiall/Consensus sequence
tacgtaggtggcgagcgttatccggatttactgggtgtaaagggtgtgtaggcgggaatgcaagtcagatgtgaaaattacgggctcaacccgtaacctgcatttgaaactgcaattcttgagtatgggagaggtaagcggaattcctggtgtagcggtaaaatgcgtagatatcaggaggaacaccggtggcgaaggcggcttactggaccacaactgacgctgagacacgaaagcgtggggagcaaacagg

SEQ ID NO: 412 - DNA, 253 bp, Unknown
  Artificiall/Consensus sequence
tacgtatggagcaagcgttatccggatttactgggtgtaaagggagcgtaggcggcctggcaagtctggtgtgaaaacccggggcccaaccccgggagtgcattggaaactgccaggctggagtgccggaggggcaggcggaattcctagtgtagcggtgaaatgcgtagatattaggaggaacaccggtggcgaaggcggcctgctggacggcaactgacgctgaggctcgaaagcgtggggagcaaacagg

SEQ ID NO: 413 - DNA, 253 bp, Unknown
  Artificiall/Consensus sequence
gacgtagggggcgagcgttgtccggaattactgggcgtaaagagcacgtaggcggaaaattaagtccattgtgaaagaccggggcttaacctcggaattgcagtggaaactgactttcttgagggcaggagaggaaagcggaattcctggtgtagcggtgaaatgcgtagaaatcaggaggaacaccggtggcgaaggcggctttctggactgaccctgacgctgaggtgcgaaagcgtgggtagcaaacagg

SEQ ID NO: 414 - DNA, 253 bp, Unknown
  Artificiall/Consensus sequence
tacggagggagctagcgttgttcggaattactgggcgtaaagcgcacgtaggcggctttgtaagttagaggtgaaagcctggggctcaactccagaactgcctttaagactgcatcgctagaatccgggagaggtgagtggaattccgagtgtagaggtgaaattcgtagatattcggaagaacaccagtggcgaaggcggctcactggaccggaattgacgctgaggtgcgaaagcgtggggagcaaacagg

SEQ ID NO: 415 - DNA, 253 bp, Unknown
  Artificiall/Consensus sequence
tacgtagggggcgagcgttgtccggaattactgggcgtaaagggcgcgtaggcggcttgttaagttagatgtgaaatccccgggcttaacctgggtgttgcatttaaaactggcgggcttgagtgcaggagaggaaagcggaattcctagtgtagcggtgaaatgcgtagatattaggaggaacatcagtggcgaaggcggctttctggactgtaactgacgctgaggcgcgagagcgtggggagcaaacagg

SEQ ID NO: 416 - DNA, 253 bp, Unknown
  Artificiall/Consensus sequence
tacgtagggggcaagcgttatccggatttactgggtgtaaagggagcgtagacggttatgcaagtctgaagtgaaagcccaaggctcaaccatgggactgctttggaaactgtaaaactggagtgcaggagaggtaagcggaattcctagtgtagcggtgaaatgcgtagatattaggaggaacaccagtggcgaaggcggcttactggactgtaactgacgttgaggctcgaaggcgtggggagcaaacagg

SEQ ID NO: 417 - DNA, 252 bp, Unknown
  Artificiall/Consensus sequence
tacggagggtgcgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccagtggcgaaggcggctctctggtctgtaactgacgctgaggctcgaaagcgtggggagcaaacagg

SEQ ID NO: 418 - DNA, 252 bp, Unknown
  Artificiall/Consensus sequence
tacgtaggtggcaagcgttatccggaattattgggcgtaaagagtgagcaggcggttgcgtaagtctgaagtcaaatcctgtggcttaaccacagttcgctttggaaactgcgcggctagagtgcgagagaggtaagtggaattccatgtgtagcggtgaaatgcgtagatatatggaggaacaccagtggcgaaggcggcttactagctcgatactgacgctcagtcacgaaagcgtgggtagcaaatagg

SEQ ID NO: 419 - DNA, 253 bp, Unknown
  Artificiall/Consensus sequence
aacgtaggtcacaagcgttgtccggaattactgggtgtaaagggtgcgtaggcggtttgataagttagaggtgaaataccggtgcttaacaccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 420 - DNA, 253 bp, Unknown
  Artificiall/Consensus sequence
tacgtaggtggcaagcgttgtccggaattactgggtgtaaagggagcgtaggcggggtattaagtcagttgtgaaagtttgcggctcaaccgtaaaattgcagttgatactggtatccttgagtgcagcagaggtgggcggaattcgtggtgtagcggtgaaatgcttagatatcacgaagaactccgattgcgaaggcagctcactggagtgtaactgacgctgatgctcgaaagtgtgggtatcaaacagg

SEQ ID NO: 421 - DNA, 253 bp, Unknown
  Artificiall/Consensus sequence
tacgtagggagcaagcgttatccggatttactgggtgtaaagggcgagtaggcggattggcaagttgggagtgaaatgtcggggcttaaccccggaactgcttccaaaactgttgatcttgagtgatggagaggcaggcggaattcccagtgtagcggtgaaatgcgtagatattgggaggaacaccagtggcgaaggcggcctgctggacattaactgacgctgaggagcgaaagcgtggggagcaaacagg

SEQ ID NO: 422 - DNA, 252 bp, Unknown
  Artificiall/Consensus sequence
tacgtaggtggcaagcgttgtccggaattactgggtgtaaagggagcgtaggcggggcggcaagcaaaatgtgaaactgatcggctcaaccggtcattgcgttttgaactgtcgctcttgagtggagtagaggcaggcggaattcctagtgtagcggtgaaatgcgtagatattaggaggaacaccagtggcgaaggcggcctgctgggcttttactgacgctgaggctcgaaagtgtgggtagcaaacagg

SEQ ID NO: 423 - DNA, 253 bp, Unknown
  Artificiall/Consensus sequence
tacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacagg

SEQ ID NO: 424 - DNA, 253 bp, Unknown
  Artificiall/Consensus sequence
tacgtagggggcaagcgttatccggatttactgggtgtaaagggagcgtagacggtgaagcaagtctgaagtgaaaggttggggctcaaccccgaaactgctttggaaactgtttaactggagtacaggagaggtaagtggaattcctagtgtagcggtgaaatgcgtagatattaggaggaacaccagtggcgaaggcggcctactgggcaccaactgacgctgaggctcgaaagtgtgggtagcaaacagg

SEQ ID NO: 425 - DNA, 253 bp, Unknown
  Artificiall/Consensus sequence
tacgtagggggcaagcgttatccggatttactgggtgtaaagggagcgtaggtggcatggtaagtcagatgtgaaagcccagggctcaaccctgggactgcatttgaaactatcaggctagagtgcaggagaggtaagtggaattcctagtgtagcggtgaaatgcgtagatattaggaagaacaccagtggcgaaggcggcttactggactgtaactgacactgaggctcgaaagcgtggggagcaaacagg

SEQ ID NO: 426 - DNA, 253 bp, Unknown
  Artificiall/Consensus sequence
tacggaggatgcgagcgttatccggatttattgggtttaaagggtgcgtaggcggactgttaagtcagctgtgaaagtttgcggctcaaccgtaaaattgcagttgatactgtcagtcttgagtacagtagaggtgggcggaacttgtggtgtagcggtgaaatgcttagatatcacgaagaactccgattgcgaaggcagctcactggagtgttactgacgctgatgcacgaaagtgtgggtatcaaacagg

SEQ ID NO: 427 - DNA, 253 bp, Unknown
  Artificiall/Consensus sequence
tacgtagggggcaagcgttatccggatttactgggtgtaaagggagcgtagacggcgctgcaagtccggagtgaaagcccatggcttaaccatggtactgctctggaaactgtggagcttgagtgcgggaggggcaggcggaattcctagtgtagcggtgaaatgcgtagatattaggaggaacaccggcggcgaaggcggcctgctggaccgtaactgacgttgaggctcgaaagcgtggggagcaaacagg

SEQ ID NO: 428 - DNA, 253 bp, Unknown
  Artificiall/Consensus sequence
tacgtagggagcaagcgttatccggaattattgggtgtaaagggtgcgtagacgggatgtcaagttagttgtgaaatacctcggctcaactgaggaactgcaactaaaactaacattcttgagtgcaggagaggaaagtggaattcctagtgtagcggtgaaatgcgtagatattaggaagaacatcggtggcgaaggcgactttctggactgtaactgacgttgaggcacgaaagtgtggggagcaaacagg

SEQ ID NO: 429 - DNA, 252 bp, Unknown
  Artificiall/Consensus sequence
tacgtagggggcgagcgttatccggaattattgggcgtaaagggtacgtaggcggtttgatcagcgtgaggtgaaaggcactggcttaaccaatgtaagccttgcgaactgtcagacttgagtgcaggagaggaaagcggaattcctagtgtagcggtgaaatgcgtagatattaggaggaacaccagtggcgaaggcggctttctggactgtaactgacgctgaggtacgaaagcgtggggagcaaacagg

SEQ ID NO: 430 - DNA, 253 bp, Unknown
  Artificiall/Consensus sequence
tacggaggattcaagcgttatccggatttattgggtgtaaagggtgcgtagacgggaaattaagttagttgtgaaatcccacggctcaactgtggaactgcaactaaaactgattttcttgagtactggagaggaaagtggaattcctagtgtagcggtgaaatgcgtagatattaggaggaacaccagtggcgaaggcgactttctggacagaaactgacgttgaggcacgaaagtgtggggagcaaacagg

SEQ ID NO: 431 - DNA, 252 bp, Unknown
  Artificiall/Consensus sequence
tacgtaggtggcaagcgttgtccggaattactgggtgtaaagggagcgtaggcggggtgccaagttgaatgtgaaatcggccggcttaactggtcgctgcgttcaaaactggcgctcttgagtggagcagaggcaggcggaattcctagtgtagcggtgaaatgcgtagatattaggaggaacaccagtggcgaaggcggcctgctgggctttaactgacgctgaggctcgaaagcgtgggtagcaaacagg

SEQ ID NO: 432 - DNA, 253 bp, Unknown
  Artificiall/Consensus sequence
tacgtagggagcaagcgttatccggatttattgggtgtaaagggtgcgtagacgggaatttaagttagctgtgaaagccctcggcttaactgaggaactgcaactaaaactggatttcttgagtgttggagaggaaagcggaattcctagtgtagcggtgaaatgcgtagatattaggaggaacaccagtggcgaaggcggctttctggacaataactgacgttgaggcacgaaagtgtggggagcaaacagg

SEQ ID NO: 433 - DNA, 253 bp, Unknown
  Artificiall/Consensus sequence
tacggaggatccgagcgttatccggatttattgggtgtaaagggtgcgtagacgggaagtcaagttagttgtgaaatccctcggcttaactgaggaactgcaactaaaactgattttcttgagtactggagaggaaagtggaattcctagtgtagcggtgaaatgcgtagatattaggaggaacaccggtggcgaaggcgactttctggacagaaactgacgttgaggcacgaaagtgtggggagcaaacagg

SEQ ID NO: 434 - DNA, 253 bp, Unknown
  Artificiall/Consensus sequence
aacgtaggtcacaagcgttgtccggaattactgggtgtaaagggagcgcaggcggaccggcaagttggaagtgaaaaccataggctcaacctatggattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacagg

SEQ ID NO: 435 - DNA, 253 bp, Unknown
  Artificiall/Consensus sequence
tacgtagggagcgagcgttgtccggaattactgggcgtaaagggtgcgtaggcggtcctgtaagttggatgtgaaatacccgggctcaacctggggggtgcatgcaaaactgtgggactagagtacgggagaggaaagcggaattcctagtgtagcggtgaaatgcgtagatattaggaggaacaccagtggcgaaggcggctttctggaccgaaactgacgctgaggcacgaaagcgtggggagcaaacagg

SEQ ID NO: 436 - DNA, 253 bp, Unknown
  Artificiall/Consensus sequence
tacgtagggggcgagcgttgtccggaattactgggcgtaaagggtgcgtaggcggcctgaaaagtcggatgtgaaagacccgtgcttaacatgggggttgcatccgaaactttcgggcttgagtgcggaagaggcaagtggaattcccagtgtagcggtgaaatgcgtagatattgggaggaacaccagtggcgaaggcgacttgctgggccgcaactgacgctgaggcacgaaagcgtggggagcaaacagg

SEQ ID NO: 437 - DNA, 253 bp, Unknown
  Artificiall/Consensus sequence
tacgtagggagcgagcgttgtccggatttactgggtgtaaagggtgcgtaggcggaagagcaagtcagtagtgaaatccatgggcttaacccgtgaactgctattgaaactgtttttcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacagg

SEQ ID NO: 438 - DNA, 253 bp, Unknown
  Artificiall/Consensus sequence
tacgtagggggcaagcgttgtccggaatcactgggcgtaaagggcacgcaggcggtaagataagtcagatgtgaaagttttcagcttaactgagaaagtgcatttgaaactatcctacttgagtctcggagaggtaagcggaattcctagtgtagcggtgaaatgcgtagagattaggaggaacaccggtggcgaaggcggcttactggacgagtactgacgctcatgtgcgaaagcgtggggagcaaacagg

SEQ ID NO: 439 - DNA, 252 bp, Unknown
  Artificiall/Consensus sequence
tacgtagggggcaagcgttgtccggaattattgggcgtaaagagtacgtaggcggtctggtaagcgcaaggtgaaaggcataggctcaaccaatgtcagccttgcgaactgtcagacttgagtgcaggaggggaaagtggaattcctagtgtagcggtgaaatgcgtagatattaggaggaacaccagtggcgaaggcgactttctggactgtaactgacgctgaggtacgaaagcgtggggagcaaacagg

SEQ ID NO: 440 - DNA, 252 bp, Unknown
  Artificiall/Consensus sequence
tacgtagggggcaagcgttgtccggaatcactgggcgtaaagggttcgcaggcggaaatgcaagtcagttgtgaaaggcagaggctcaacctctgtaagcaattgaaactgtatttcttgagatgtggagaggcaagtggaattcctagtgtagcggtgaaatgcgtagatattaggaagaataccggtggcgaaggcgacttgctggacacaaactgacgctgaggaacgaaagcgtgggtagcaaacagg

SEQ ID NO: 441 - DNA, 253 bp, Unknown
  Artificiall/Consensus sequence
tacgtaggtggcgagcgttgtccggatttactgggtgtaaagggcgtgtaggcgggtagacaagtcagatgtgaaatgtaggggctcaacccctgagctgcatttgaaactgtatatcttgagtgatggagaggcaggcggaattcccggtgtagcggtgaaatgcgtagatatcgggaggaacaccagtggcgaaggcggcctgctggacattaactgacgctgatgcgcgaaagcgtggggagcaaacagg

SEQ ID NO: 442 - DNA, 252 bp, Unknown
  Artificiall/Consensus sequence
aacgtagggtgcaagcgttgtccggaattactgggtgtaaagggagcgtaggcggggagacaagttgaatgtctaaactatcggcttaactgatagtcgcgttcaaaactatcactcttgagtgcagtagaggtaggcggaattcctagtgtagcggtgaaatgcgtagatattaggaggaacaccagtggcgaaggcggtctactgggctgtaactgacgctgaggctcgaaagcgtgggtagcaaacagg

SEQ ID NO: 443 - DNA, 253 bp, Unknown
  Artificiall/Consensus sequence
aacgtaggtcacaagcgttgtccggaattactgggtgtaaagggtgcgcaggcgggaacttaagtcagcggtgaaatctcgacgcttaacgtcgaaactgccgttgaaactgggtttcttgagtatagatgaagtaggcggaattcgttgtgtagcggtgacatgcttagatataacgaggaactccgattgcgtaggcagcttactaagctataactgacgctcaagcacgaaagcgtggggatcaaacagg

SEQ ID NO: 444 - DNA, 253 bp, Unknown
  Artificiall/Consensus sequence
tacgtagggagcaagcgttatccggaataactgggcgtaaagggtgcgtaggcggtaatgcaagttagatgtgaaatacccgggcttaacccgggaactgcatctaaaactgtataacttgagtgcaggagaggaaagtggaattcctagtgtagcggtggaatgcgtagatattaggaggaacaccagaggcgaaggcggctttctggactgtaactgacgctgaggcacgaaagcatggggagcaaacagg

SEQ ID NO: 445 - DNA, 253 bp, Unknown
  Artificiall/Consensus sequence
tacgtagggggcgagcgttgtccggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 446 - DNA, 253 bp, Unknown
  Artificiall/Consensus sequence
tacgtaggtggcaagcgttgtccggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagatatcaagaagaatacctattgcgaaggcgatctgctggaacttaactgacgctaatgcgtgaaagcgtggggagcaaacagg

SEQ ID NO: 447 - DNA, 252 bp, Unknown
  Artificiall/Consensus sequence
tacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaggcggccaactgggctttaactgacgctgaggctcgaaagtgtggggagcaaacagg

SEQ ID NO: 448 - DNA, 253 bp, Unknown
  Artificiall/Consensus sequence
tacgtagggggcaagcgttatccggatttactgggtgtaaagggagcgtagacggcagcgcaagtccgaagtgaaagcccggggcccaaccccgggactgctttggaaactgtgaagctggagtgcgggaggggcaggcggaattcctggtgtagcggtgaaatgcgtagatatcaggaggaacaccggcggcgaaggcggcctgctggaccgtaactgacgttgaggctcgaaagcgtggggagcaaacagg

SEQ ID NO: 449 - DNA, 253 bp, Unknown
  Artificiall/Consensus sequence
tacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggcttactggacggtaactgacgttgaggctcgaaagcgtggggagcaaacagg

SEQ ID NO: 450 - DNA, 253 bp, Unknown
  Artificiall/Consensus sequence
tacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgctgaggcacgaaggccaggggagcgaaaggg

SEQ ID NO: 451 - DNA, 253 bp, Unknown
  Artificiall/Consensus sequence
tacgtagggggcaagcgttatccggaattactgggtgtaaagggagagtaggcggcaaggtaagcgatatgtgaaagccttaagcttaacttaaggatggcataacgaactatctagctagagtacaggagaggaaagcggaattcctagtgtagcggtgaaatgcgtagatattaggaagaacaccagtggcgaaggcggctttctggactgaaactgacgctgaggctcgaaagcgtggggagcgaacagg

SEQ ID NO: 452 - DNA, 253 bp, Unknown
  Artificiall/Consensus sequence
tacgtagggggcgagcgttgtccggaattattgggcgtaaagggtgcgtaggcggcgtatcaagtcagatgtgaaaagcccgtgcttaacatgggaggtgcatttgaaactggtatgcttgagtatgggagaggcaagcggaattcccggtgtagcggtgaaatgcgtagagatcgggaggaacaccagtggcgaaggcggcttgctggaccaaaactgacgctgaggcacgaaagcgtggggagcaaacagg

SEQ ID NO: 453 - DNA, 252 bp, Unknown
  Artificiall/Consensus sequence
tacggaaggtccaggcgttatccggatttattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 454 - DNA, 252 bp, Unknown
  Artificiall/Consensus sequence
tacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgatgctcgaaagtgtgggtatcaaacagg

SEQ ID NO: 455 - DNA, 253 bp, Unknown
  Artificiall/Consensus sequence
tacgtagggtgcaagcgttaatcggaattactgggcgtaaagcgtgcgcaggcggttttgtaagacagtggtgaaatccccgggctcaacctgggaactgccattgtgactgcaaggctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 456 - DNA, 253 bp, Unknown
  Artificiall/Consensus sequence
tacggaaggtccaggcgttatccggatttattgggtttaaagggagcgcaggcggcggcgtaagtcagttgtgaaatcgtgcggcttaaccgtgcaattgcagttgatactgcgtcgcttgagtgcacacagggatgttggaattcatggtgtagcggtgaaatgcttagatatcatgaagaactccgatcgcgaaggcatatgtccggagtgcaactgacgctgaggctcgaaagtgtgggtatcaaacagg

SEQ ID NO: 457 - DNA, 253 bp, Unknown
  Artificiall/Consensus sequence
tacgtaggtggcaagcgttgtccggaatgactgggcgtaaagggtgcgtaggtggtctgtcaagttagccgtgaaattccggggctcaactccggcgctacggctaagactgacggacttgagtgcaggaggggcaagtggaattcctagtgtagcggtggaatgcgtagatattaggaggaacaccagaggcgaaggcgacttgctggactgtaactgacactgaggcacgaaagcgtggggagcaaacagg

SEQ ID NO: 458 - DNA, 253 bp, Unknown
  Artificiall/Consensus sequence
tacgtaggtggcaagcgttatccggaattactgggtgtaaagggagcgcaggcgggatagcaagtcagcggtgaaatgcatgggcttaactcatgagctgccgttgaaactgttattcttgagtggagtagaggcaggcggaattccgagtgtagcggtgaaatgcgtagatattcggaggaacaccagtggcgaaggcggcctgctgggctctaactgacgctgaggctcgaaagtgtggggagcaaacagg

SEQ ID NO: 459 - DNA, 253 bp, Unknown
  Artificiall/Consensus sequence
aacgtagggggcaagcgttgtccggaatcactgggcgtaaagggcgtgtaggtggtatgtgaagtcaaaagtgaaattccagggcttaactctggacttgcttctgaaaccagcatacttgaggacaggagagggaagcggaattcccagtgtagcggtgaaatgcgtagatattgggaggaacaccagtggcgaaagcggcttcctggcctgtaactgacactgaggcgcgaaagcgtggggagcaaacagg

SEQ ID NO: 460 - DNA, 252 bp, Unknown
  Artificiall/Consensus sequence
tacggaggatgcgagcgttatccggatttattgggtttaaagggtgcgtaggcggcttgttaagtcagcggtcaaatcgaggggctcaacccctttccgccgttgaaactggcgagcttgagtgagcgagaagtaagcggaatgcgtggtgtagcggtgaaatgcatagatatcacgcagaaccccgattgcgaaggcagcttaccggcgctcaactgacgctgaggcacgaaagtgcgggtatcgaacagg

SEQ ID NO: 461 - DNA, 260 bp, Unknown
  Artificiall/Consensus sequence
gacagaggatgcaagcgttatccggaatgattgggcgtaaagcgtctgtaggtggcttttcaagtccgccgtcaaatcccagggctcaaccctggacaggcggtggaaactaccaagctggagtacggtaggggcagtccaattaatatactagaggtggagcggtgaaatgcgtagagatcgggaagaacaccaacggcgaaagcactctgctgggccgacactgacactgagagacgaaagctaggggagcaaatggg

SEQ ID NO: 462 - DNA, 253 bp, Unknown
  Artificiall/Consensus sequence
tacgtaggaggcaagcgttatccggaatgactgggcgtaaagggtgcgtaggtggtttggcaagttagtagcgtaactccggggctcaactccggaactactactaaaactgtcggacttgagtgcaggaggggcaattggaattcctagtgtagcggtggaatgcgtagatattaggaagaacaccagtggcgaaggcgaattgctggactgtaactgacactgaggcacgaaagcgtggggagcaaacagg

SEQ ID NO: 463 - DNA, 252 bp, Unknown
  Artificiall/Consensus sequence
tacgtagggagcaagcgttgtccggaattactgggtgtaaagggagcgtaggcgggatggaaagtagaatgttaaatctaccggctcaactggtagctgcgttctaaacttccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacagg

SEQ ID NO: 464 - DNA, 253 bp, Unknown
  Artificiall/Consensus sequence
tacgtagggggcaagcgttatccggatttactgggtgtaaagggagcgtagacggcgtatcaagtctgatgtgaaaggcgggggctcaactcccggactgcattggaaactggtatgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 465 - DNA, 253 bp, Unknown
  Artificiall/Consensus sequence
tacgtagggagcgagcgttgtccggaattactgggcgtaaagggcgcgtaggcggggacttaagttaggtgtgaaaacttcgggcttaacctgaagactgcacttaaaactgggtttcttgagggcaggagaggaaagtggaattcctagtgtagcggtgaaatgcgtagatattaggaggaacaccagtggcgaaggcgactttctggactgtacctgacgctgaggcgcgaaagcatggggagcgaacagg

SEQ ID NO: 466 - DNA, 252 bp, Unknown
  Artificiall/Consensus sequence
tacgtagggagcgagcgttgtccggaattactgggtgtaaagggagcgtaggcgggattataagtagaatgttaaacctatcggctcaactgatagttgcgttctaaactgtagttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacagg

SEQ ID NO: 467 - DNA, 253 bp, Unknown
  Artificiall/Consensus sequence
tacgtagggagcgagcgttatccggatttattgggtgtaaagggtgcgtagacgggaaggtaagttagttgtgaaatccctcggcttaactgaggaactgcaactaaaactgtctttcttgagtactggagaggaaagtggaattcctagtgtagcggtgaaatgcgtagatattaggaggaacaccagtggcgaaggcggcttgctggactgtaactgacactgaggctcgaaagcgtggggagcaaacagg

SEQ ID NO: 468 - DNA, 253 bp, Unknown
  Artificiall/Consensus sequence
tacgtaggtggcaagcgttgtccggatttactgggtgtaaagggcgcgtaggcgggatagcaagtcagtcgtgaaatgccgaggcttaacctcggagctgcgattgaaactgttattcttgagtatcggagaggaaagcggaattcctagtgtagcggtgaaatgcgtagatattaggaggaacaccagtggcgaaggcggctttctggacgacaactgacgctgaggcgcgaaagtgtggggagcaaacagg

SEQ ID NO: 469 - DNA, 252 bp, Unknown
  Artificiall/Consensus sequence
tacgtagggagcaagcgttgtccggaattactgggtgtaaagggagcgtaggcgggaatgcaagttgaatgtcaaatctaccggcttaactggtagccgcgttcaaaactgcgtttcttgagtgaagtagaggcaggcggaattcctagtgtagcggtgaaatgcgtagatattaggaggaacaccagtggcgaaggcggcctgctgggcttttactgacgctgaggctcgaaagtgtgggtagcaaacagg

SEQ ID NO: 470 - DNA, 253 bp, Unknown
  Artificiall/Consensus sequence
tacgtagggggcaagcgttatccggatttactgggtgtaaagggagcgtaggtggtttggcaagtcagaagtgaaaacccaaggcttaaccatgggattgcttttgaaactgctgggctggagtgctggagaggtaagtggaattcctagtgtagcggtgaaatgcgtagatattaggaggaacaccggtggcgaaggcggcttactggacagtaactgacactgaggctcgaaagcgtggggagcaaacagg

SEQ ID NO: 471 - DNA, 253 bp, Unknown
  Artificiall/Consensus sequence
aacgtaggtagcgagcgttgtccggaattactgggtgtaaagggagcgcaggcggatttgcgtgtcaaatgtgaaatctatgggctcaacccataaattgcgtttgaaactgtagatcttgagtggagtagaggcaagtggaattcccggtgtagcggtggaatgcgtagatatcgggaggaacaccagtggcgaaggcgacttgctgggctctaactgacgctgaggctcgaaagcgtgggtagcaaacagg

SEQ ID NO: 472 - DNA, 252 bp, Unknown
  Artificiall/Consensus sequence
tacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcttgctgggcttttactgacgctgaggctcgaaagcgtggggagcaaacagg

SEQ ID NO: 473 - DNA, 253 bp, Unknown
  Artificiall/Consensus sequence
tacgtagggggctagcgttatccggatttactgggcgtaaagggtgcgtaggcggtttagtaagtcagcggtgaaattttggtgcttaacaccaaacgtgccgttgatactgctgggctagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 474 - DNA, 253 bp, Unknown
  Artificiall/Consensus sequence
tacgtagggggcaagcgttatccggatttactgggtgtaaagggagcgtaggcggcttggtaagtcagaagtgaaagcccagggcttaaccctgggactgcttttgaaactgccaggcttgattgccggagaggtaagtggaattcctagtgtagcggtgaaatgcgtagatattaggaggaacaccagtggcgaaggcggcttactggacggtcaatgacgctgaggctcgaaagcgtggggagcaaacagg

SEQ ID NO: 475 - DNA, 253 bp, Unknown
  Artificiall/Consensus sequence
tacgtagggggcaagcgttatccggatttactgggtgtaaagggagcgtagacggcgtgccaagtctgatgtgaaaggccggggctcaaccccgggactgcattggaaactggcatgctagagtgccggaggggcaagcggaattcctagtgtagcggtgaaatgcgtagatattaggaggaacaccggtggcgaaggcggcttgctggacggtaactgacgttgaggctcgaaagcgtggggagcaaacagg

SEQ ID NO: 476 - DNA, 252 bp, Unknown
  Artificiall/Consensus sequence
tacgtagggggcgagcgttatccggaattattgggcgtaaagagtacgtaggtggtcctgtaagcgcggggtctaaggcagcggcttaaccgctgttcgccccgcgaactgcaggacttgagtgcaggagaggaaagcggaattcctagtgtagcggtgaaatgcgtagatattaggaggaacaccagtggcgaaggcggctttctggactgtaactgacactgaggtacgaaagcgtggggagcaaacagg

SEQ ID NO: 477 - DNA, 253 bp, Unknown
  Artificiall/Consensus sequence
tacgtagggggcaagcgttatccggatttactgggtgtaaagggagcgtaggtggcagggcaagtcagatgtgaaaacccggggctcaactccgggagtgcatttgaaactgtccagctagagtgcaggagaggtaagcggaattcctagtgtagcggtgaaatgcatagatattaggaggaacaccagtggcgaaggcggcttactggacggtaactgacgttgaggctcgaaagcgtggggagcaaacagg

SEQ ID NO: 478 - DNA, 252 bp, Unknown
  Artificiall/Consensus sequence
tacgtagggagcaagcgttatccggatttattgggtgtaaagggtgcgtaggcggctagataggtctatggtttaagtccgaagcttaacttcggttcgccatagaaaccgtctggcttgagtatggtagaggcaagtggaatttctagtgtagcggtaaaatgcgtagatattagaaggaacaccagtggcgaaggcgacttgctgggccatcactgacgctgaggcacgaaagcgtggggagcaaatagg

SEQ ID NO: 479 - DNA, 252 bp, Unknown
  Artificiall/Consensus sequence
tacgtagggagcaagcgttgtccggaattactgggtgtaaagggagcgtaggcggggcattaagttgattgtgaaatctaccggctcaactggtagctgcgatcaaaactgatgctcttgagtgaagtagaggcaggcggaattcctagtgtagcggtgaaatgcgtagatattaggaggaacaccagtggcgaaggcggcctgctgggcttttactgacgctgaggctcgaaagcatggggagcaaacagg

SEQ ID NO: 480 - DNA, 253 bp, Unknown
  Artificiall/Consensus sequence
tacggaggatacgagcgttatccggaattattgggtttaaagggtgcgtaggtggctatttaagtcaggggtgaaaagcatgagctcaactcatgtcttgcctttgaaactggacagctagagaaaagacgaggtatgtggaatgtgtggtgtagcggtgaaatgcatagatatcacacagaactccgattgcgcaggcagcgtaccagacttcttctgacactgaagcacgaaagcgtggggatcaaacagg

SEQ ID NO: 481 - DNA, 252 bp, Unknown
  Artificiall/Consensus sequence
tacgtaggtggcgagcgttatccggaatcattgggcgtaaagggtgcgcaggtggtacattaagtccgaagtaaaaggcagcagctcaactgctgttggctttggaaactgatgaactggagtgcaggagagggcgatggaattccatgtgtagcggtaaaatgcgtagatatatggaggaacaccagtggcgaaggcggtcgcctggcctgcaactgacactgaggcacgaaagcgtggggagcaaatagg

SEQ ID NO: 482 - DNA, 253 bp, Unknown
  Artificiall/Consensus sequence
tacgtaggtggcgagcgttgttcggatttattgggcgtaaagggtctgtaggaggtttgttaaattcgaggtgaaatcccgtggctcaaccacggaactgccttggagactgatagactagggtgctggagaggtaaacggaataccaagtgtagcggtggaatgcgtagatatttggtagaacaccaagagcgaaggcagtttactggacagtaaccgactctgagagacgaaagcgtggggagcaaacagg

SEQ ID NO: 483 - DNA, 253 bp, Unknown
  Artificiall/Consensus sequence
tacggagggtgcaagcgttaatcggaatcactgggcgtaaagcgcacgtaggcggtctggtaagtcagaggtgaaagcccacagcccaactgtggaactgcctttgatactgccagacttgagtaccggagagggtggcggaattccaggtgtaggagtgaaatccgtagatatctggaggaacaccggtggcgaaggcggccacctggacggtaactgacgctgaggctcgaaagcgtggggagcaaacagg

SEQ ID NO: 484 - DNA, 253 bp, Unknown
  Artificiall/Consensus sequence
tacgtaggtgacaagcgttgtccggatttactgggtgtaaagggcgcgtaggcggaccggcaagtcaggagtgaaataccggggctcaaccccggggctgcttttgaaactgtcggccttgagtatcggagaggaaagcggaattcccagtgtagcggtgaaatgcgtagatattgggaggaacaccagtggcgaaggcggctttctggacgacaactgacgctgaggcgcgaaagtgtggggagcaaacagg

SEQ ID NO: 485 - DNA, 252 bp, Unknown
  Artificiall/Consensus sequence
tacgtaggtggcgagcgttatccggatttattgggcgtaaagcgtgcgcagacggtttgttaagtttgaaatcaaagcctggagcttaactccagttagtttcaaaaactggcaggctagagtgtggtagaggcaaatggaatttctagtgtagcggtaaaatgcgtagatattagaaggaacaccagtggcgaaggcgatttgctgggccattactgacgttcatgcacgaaagcgtggggagcaaacagg

SEQ ID NO: 486 - DNA, 253 bp, Unknown
  Artificiall/Consensus sequence
tacgtaggtggcaagcgttatccggatttactgggtgtaaagggtgtgtaggcgggtctgcaagtcagatgtgaaaactatgggctcaactcatagcttgcatttgaaactgtggatcttgagtgtcggagaggtaaatggaattcccggtgtagaggtgaaattcgtagatatcgggaggaacaccagtggcgaaggcggtttactggacgattactgacgctgagacacgaaagtgtggggagcaaacagg

SEQ ID NO: 487 - DNA, 254 bp, Unknown
  Artificiall/Consensus sequence
tacgggggatgcaagcgttatccggatttattgggtttaaagggtgcgtaggctgtgaggtaagtcagcggtgaaatgcccccgctcaacggggtgaagtgccattgatactgccttgctggaatgcggatgccgtgggaggaatgtgtggtgtagcggtgaaatgcatagatatcacacagaacaccgattgcgaaggcatctcacgaatccgcgattgacgctgatgcacgaaagcgtgggtatcaaacagg

SEQ ID NO: 488 - DNA, 253 bp, Unknown
  Artificiall/Consensus sequence
tacggaaggtccgggcgttatccggatttattgggtttaaagggagcgtaggccgggttttaagcgtgccgtgaaatgtcggggctcaaccttgacactgcggcgcgaactggagtccttgagtgcgcggaacgtatgcggaattcgtggtgtagcggtgaaatgcttagatatcacgaagaaccccgattgcgaaggcagcatacggcagcgctactgacgctgaagctcgaaggcgcgggtatcgaacagg

SEQ ID NO: 489 - DNA, 252 bp, Unknown
  Artificiall/Consensus sequence
tacggaggatgcgagcgttatccggatttattgggtttaaagggtgcgtaggcgggctgataagtcagcggttaaaatgcggtgctcaacgccgtagtgccgttgaaactgtcggtcttgagtgagcgagaagtatgcggaatgcgtggtgtagcggtgaaatgcatagatatcacgcagaactccgattgcgaaggcagcataccggcgctcaactgacgctgaagcacgaaagcgtgggtatcgaacagg

SEQ ID NO: 490 - DNA, 252 bp, Unknown
  Artificiall/Consensus sequence
tacgtagggagcgagcgttgtccggaattactgggtgtaaagggagcgtaggcggggatgcaagttgggtgtcaaaactaccggctcaactggtagtcgcactcaaaactgcagctcttgagtgaagtagaggcaggcggaattcctagtgtagcggtgaaatgcgtagatattaggaggaacaccagtggcgaaggcggcctgctgggcttttactgacgctgaggctcgaaagtgtggggagcaaacagg

SEQ ID NO: 491 - DNA, 253 bp, Unknown
  Artificiall/Consensus sequence
tacgtagggagcgagcgttgtccggaattactgggcgtaaagagcgcgtaggtgggtatttaagtcagatgtgaaaacttggggctcaaccgcaagcctgcatttgaaactggatatcttgagggcaggagaggaaagtggaattcctagtgtagcggtgaaatgcgtagatattaggaggaacaccagtggcgaaggcgactttctggactgtacctgacactgaggcgcgaaagcgtggggagcgaacggg

SEQ ID NO: 492 - DNA, 253 bp, Unknown
  Artificiall/Consensus sequence
tacgtagggggcgagcgttgtccggaattactgggcgtaaagggcgcgtaggcggcataataagtctgttgtgaaaatccagcgcttaacgttggacgtgcaatggaaactattaagctcgagtgtggtagaggcaagtggaattcccagtgtagcggtgaaatgcacagagattgggaggaacaccagtggcgaaggcgacttgctgggccaagactgacgctgaagcgcgaaagcgtggggagcaaacagg

SEQ ID NO: 493 - DNA, 253 bp, Unknown
  Artificiall/Consensus sequence
tacgtagggggcaagcgttatccggattcactgggtgtaaagggagcgtagacggcgagacaagtctggagtgaaaggccggggcccaaccccgggactgctctggaaactgcctggctggagtacaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 494 - DNA, 253 bp, Unknown
  Artificiall/Consensus sequence
tacgtagggtgcgagcgttatccggaattattgggcataaagggcatctaggcggccaggcaagtctggggtgaaaacttgcggctcaaccgcaagcctgccctggaaactgcctggctagagtgctggagaggtggacggaactgcacgagtagaggtgaaattcgtagatatgtgcaggaatgccgatgatgaagatagttcactggacggcaactgacgctgaagtgcgaaagctgggggagcgaacagg

SEQ ID NO: 495 - DNA, 253 bp, Unknown
  Artificiall/Consensus sequence
tacgtagggggcgagcgttgtccggaattactgggcgtaaagggcgcgcaggcggccgatcaagtcagatgtgaaacccccgggcttaacctgggaactgcatttgaaactggttggcttgagtgcaggagaggaaagcggaattcctagtgtagcggtgaaatgcgtagatattaggaagaacaccagtggcgaaggcggctttctggactgcaactgacgctgaggcgcgaaagcgtggggagcgaacagg

SEQ ID NO: 496 - DNA, 252 bp, Unknown
  Artificiall/Consensus sequence
tacgtagggagcaagcgttgtccggaattactgggtgtaaagggagcgtaggcgggtctgcaagttgaatgtgaaatctaacggctcaaccgatagctgcgttcaaaactgcagatcttgagtgaagtagaggcaggcggaattcctagtgtagcggtgaaatgcgtagatattaggaggaacaccagtggcgaaggcggcctgctgggcttttactgacgctgaggctcgaaagcgtgggtagcaaacagg

SEQ ID NO: 497 - DNA, 252 bp, Unknown
  Artificiall/Consensus sequence
tacgtaggtggcgagcgttatccggaatcattgggcgtaaagggtgcgtaggcggcgagttaagtctgaggtaaaaggttgcagctcaactgtaacaagccttggaaactgactggctagagtgcaggagagggcagtggaattccatgtgtagcggtaaaatgcgtagatatatggaggaacaccagtggcgaaggcggctgtctggcctgtaactgacgctgaggcacgaaagcgtggggagcaaatagg

SEQ ID NO: 498 - DNA, 254 bp, Unknown
  Artificiall/Consensus sequence
tacgtagggggcgagcgttgtccggaattactgggcgtaaagggcgcgcaggcggccgatcaagttagatgtgaaatacccgggcttaacctgggaactgcatttaaaactggttggctaggagtgcaggagagggaagcggaattcctagtgtagcggtgaaatgcgtagatattaggaggaacaccagtggcgaaggcggctttctggactgtaactgacgctgaggcgcgaaagcgtggggagcgaacagg

SEQ ID NO: 499 - DNA, 252 bp, Unknown
  Artificiall/Consensus sequence
tacgtatgtcacaagcgttatccggatttattgggcgtaaagcgcgtctaggcggctatgtaagtctgatgtgaaaatgcggggctcaactccgtattgcgttggaaactgtgtagctagagtatcggagaggtaagcggaactacaagtgtagaggtgaaattcgtagatatttgtaggaatgccgatggggaagccagcttactggacgaatactgacgctaaagcgcgaaagcgtgggtagcaaacagg

SEQ ID NO: 500 - DNA, 253 bp, Unknown
  Artificiall/Consensus sequence
tacgtaggtggcaagcgttgtccggatttactgggtgtaaagggcgtgtaggcggagcagcaagtcagaagtgaaatctctgggctcaacccagaaactgcttttgaaactgttgcccttgagtatcggagaggcaggcggaattcctagtgtagcggtgaaatgcgtagatattaggaggaacaccagtggcgaaggcggattgctggacgacaactgacggtgaggcgcgaaagcgtggggagcaaacagg

SEQ ID NO: 501 - DNA, 253 bp, Unknown
  Artificiall/Consensus sequence
tacgtatggagcaagcgttatccggatttactgggtgtaaagggagcgcagacggcaaggcaagtctgatgtgaaagtccgaggctcaacctcgggactgcattggaaactgtctggctagagtgcaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 502 - DNA, 253 bp, Unknown
  Artificiall/Consensus sequence
tacgtagggggcgagcgttgtccggaattactgggcgtaaagggtgcgtaggcggtttaacaagtccaatgtgaaatacccgggcttaacctggggggtgcattggaaactgttagacttgagtgcaggagaggaaagcggaattcctagtgtagcggtgaaatgcgtagatattaggaggaacaccagtggcgaaggcggctttctggactgcaactgacgctgaggcacgaaagcgtggggagcaaacagg

SEQ ID NO: 503 - DNA, 252 bp, Unknown
  Artificiall/Consensus sequence
tacgtagggggcaagcgttatccggaattattgggcgtaaagagtacgtaggtggttacctaagcacgaggtataaggcaatggctcaaccattgttcgccttgtgaactgggttgcttgagtgcaggagaggaaagcggaattcctagtgtagcggtgaaatgcgtagatattaggaggaacaccagtggcgaaggcggctttctggactgtaactgacactgaggtacgaaagcgtggggagcaaacagg

SEQ ID NO: 504 - DNA, 253 bp, Unknown
  Artificiall/Consensus sequence
tacggagggtgcaagcgttaatcggaatcactgggcgtaaagcgcacgtaggctgttatgtaagtcaggggtgaaagcccacggctcaaccgtggaactgcccttgatactgcacgactcgaatccgggagagggtggcggaattccaggtgtaggagtgaaatccgtagatatctggaggaacatcagtggcgaaggcggccccctggacgaagactgacgctcaggtgcgaaagcgtggggagcaaacagg

SEQ ID NO: 505 - DNA, 253 bp, Unknown
  Artificiall/Consensus sequence
tacggaggattcaagcgttatccggatttattgggtttaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacagg

SEQ ID NO: 506 - DNA, 253 bp, Unknown
  Artificiall/Consensus sequence
tacgtaggtcccgagcgttatccggatttattgggtttaaagggtgcgtaggcggcctgttaagtcagcggtgaaatctaggagcttaactcctaaattgccattgatactggcgggcttgagtgtagatgaggtaggcggaatgcgtggtgtagcggtggaatgcatagatatcacgcagaactccgattgcgaaggcagcttactaaggtacaactgacgctgaggctcgaaagcgtggggagcaaacagg

SEQ ID NO: 507 - DNA, 252 bp, Unknown
  Artificiall/Consensus sequence
tacggagggtgcaagcgttaatcggaattactgggcgtaaagcgcacgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacagg

SEQ ID NO: 508 - DNA, 252 bp, Unknown
  Artificiall/Consensus sequence
tacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggctttctggactgtaactgacactgaggcacgaaagccaggggagcgaacggg

SEQ ID NO: 509 - DNA, 252 bp, Unknown
  Artificiall/Consensus sequence
tacagaggatgcaagcgttatccggaatgattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacagg

SEQ ID NO: 510 - DNA, 253 bp, Unknown
  Artificiall/Consensus sequence
tacgtaggtggcaagcgttgtccggatttactgggtgtaaagggcgcgtaggcgggattgcaagtcagatgtgaaatctgggggcttaacccccaaactgcatttgaaactgtagttcttgagtatcggagaggcaggcggaattcctagtgtagcggtgaaatgcgtagatattaggaggaacaccagtggcgaaggcggcctgctggacgacaactgacgctgaggcgcgaaagcgtggggagcaaacagg

SEQ ID NO: 511 - DNA, 253 bp, Unknown
  Artificiall/Consensus sequence
tacggagggtgcaagcgttgtccggatttactgggtgtaaagggcgtgtagccgggaaggcaagtcagatgtgaaatccacgggctcaactcgtgaactgcatttgaaactgtttttcttgagtatcggagaggcaatcggagttcctagtgtagcggtgaaatgcgtagatattaggaggaacaccagtggcgaaggcggattgctggacgaagactgacgctcaggtgcgaaagcgtggggagcaaacagg

SEQ ID NO: 512 - DNA, 253 bp, Unknown
  Artificiall/Consensus sequence
tacgtagggggcaagcgttatccggatttactgggtgtaaagggggcgcagacggcaatgcaagccaggagtgaaagcccggggcccaaccccgggactgctcttggaactgcatggctggagtacaggaggggcaggcggaattcctagtgtagcggtgaaatgcgtagatattaggaggaacaccggtggcgaaggcggcctgctggactgtgactgacgttgaggcccgaaggcgtggggagcaaacagg

SEQ ID NO: 513 - DNA, 254 bp, Unknown
  Artificiall/Consensus sequence
tacgtagggggcaagcgttatccggatttactgggtgtaaagggagcgtagacggcgatgcaagtctgaagtgaaagcccggggctcaaccccgtggactgctttggaaactgcgttgctggagtgcaggagaggtgagtggaattcctagtgtagcggtgaaatgcgtagatattaggaggaacaccagtggcgaaggcgacttactggacgataactgacgttgaggctcgaaagcgtggggagcaaacagg

SEQ ID NO: 514 - DNA, 253 bp, Unknown
  Artificiall/Consensus sequence
tacggaggatgcgagcgttatccggaatcattgggtttaaagggtccgtaggcgggctaataagtcaggggtgaaatcgttcagctcaactgagcaactgcctttgaaactgttagtcttgaatagttgtgaagtagttggaatgtgtagtgtagcggtgaaatgcttagagattacacagaacaccgatagcgaaggcatattactaacaattgattgacgctgatggacgaaagcgtggggatcaaacagg

SEQ ID NO: 515 - DNA, 253 bp, Unknown
  Artificiall/Consensus sequence
tacgtagggagcgagcgttgtccggaattactgggtgtaaagggagtgtaggcgggaagataagttggatgtgaaaactatcggctcaaccgatagactgcattcaaaactatttttcttgagtgaagtagaggcaggcggaattcctagtgtagcggtgaaatgcgtagatattaggaggaacaccagtggcgaaggcggcctgctgggcttttactgacgctgaggctcgaaagtgtgggtagcaaacagg

SEQ ID NO: 516 - DNA, 252 bp, Unknown
  Artificiall/Consensus sequence
tacgtagggtgcgagcgttgtccggaattactgggtgtaaagggagcgtaggcgggggttcaagccctatgttaaatccatcggctcaaccggtggctgcgtagggaactggatctcttgagtgaagtagaggcaggcggaattcctagtgtagcggtgaaatgcgtagatattaggaggaacaccagtggcgaaggcggcctgctgggcttttactgacgctgaggctcgaaagcgtggggagcaaacagg

SEQ ID NO: 517 - DNA, 253 bp, Unknown
  Artificiall/Consensus sequence
tacgtagggagcgagcgttgtccggaattactgggtgtaaagggtgcgtaggcggctctgcaagtcagccgtgaaagcccggggcttaaccccggaactgcggttgaaactgtggggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacagg

SEQ ID NO: 518 - DNA, 252 bp, Unknown
  Artificiall/Consensus sequence
tacgtaggtggcgagcgttgtccggaattactgggtgtaaagggagcgtaggcgggatggcaagttgaatgtataacctatgggctcaacccatagtggcgttcaaaactgccgttcttgagtggagtagaggcaggcggaattcctagtgtagcggtgaaatgcgtagatattaggaggaacaccagtggcgaaggcggcctgctgggctttaactgacgctgatgctcgaaagcgtgggtagcaaacagg

SEQ ID NO: 519 - DNA, 253 bp, Unknown
  Artificiall/Consensus sequence
tacgtagggggcgagcgttgtccggaattactgggcgtaaagggcgcgtaggcggttgaataagtctgttgtgaaattccaaggcttaactttggcagtgcaatggaaactgttcgacttgagtacggcagaggcaagtggaattcccagtgtagcggtgaaatgcacagagattgggaggaacaccagtggcgaaggcgacttgctgggccgaaactgacgctgaggcgcgaaagcgtggggagcaaacagg

SEQ ID NO: 520 - DNA, 253 bp, Unknown
  Artificiall/Consensus sequence
tacgtaggtggcgagcgttatccggaatgattgggcgtaaagggtgcgtaggcggcctgctaagtctggagtgaaaggtaccggctcaaccggtacaggctctggaaactggcgggctagagagcaggagagggcggtggaactccatgtgtagcggtaaaatgcgtagatatatggaagaacaccagtggcgaaggcggccgcctggcctgttaactgacgctgaggcacgaaagcgtggggagcaaatagg

SEQ ID NO: 521 - DNA, 253 bp, Unknown
  Artificiall/Consensus sequence
tacgtagggagcaagcgttgtccggaattactgggcgtaaagggtgcgtaggtggccatgtaagttaggtgtgaaagaccggggcttaaccccggggcggcacttaaaactgtgtggcttgagtacaggagagggaagtggaattcctagtgtagcggtgaaatgcgtagatattaggaggaacaccagtggcgaaggcgactttctggactgtaactgacactgaggcacgaaagcgtggggagcaaacagg

SEQ ID NO: 522 - DNA, 254 bp, Unknown
  Artificiall/Consensus sequence
gacagaggatgcaagcgttatccggaatgattgggcgtaaagcgtctgtaggtggcttttcaagtccgccgtcaaatcccaatggctcaaccctggacaggcggtggaaactaccaagctggagtatggtaggggcagagggaatttccggtggagcggtgaaatgcattgagatcggaaagaacaccaacggcgaaagcactctgctgggccgacactgacactgagagacgaaagctaggggagcaaatggg

SEQ ID NO: 523 - DNA, 253 bp, Unknown
  Artificiall/Consensus sequence
tacgtagggagcgagcgttgtccggatttactgggtgtaaagggcgcgtaggcgggatagcaagtcagatgtgaaatctgggggcttaacccccaaactgcatttgaaactgttattcttgagtgatggagaggcaagcggaattcctagtgtagcggtgaaatgcgtagatattaggaggaacaccagtggcgaaggcggcttgctggacattaactgacgctgaggcgcgaaagcgtggggagcaaacagg

SEQ ID NO: 524 - DNA, 253 bp, Unknown
  Artificiall/Consensus sequence
tacgtagggggcgagcgttgtccggaattactgggcgtaaagggcgcgtaggcggttgtgcaagtctgttgtgaaattccggggctcaactccggcagtgcaatggaaactgtacgacttgagtacggcagaggcaagtggaattcccagtgtagcggtgaaatgcacagagattgggaggaacaccagtggcgaaggcgacttgctgggccgaaactgacgctgaggcgcgaaagcgtggggagcaaacagg

SEQ ID NO: 525 - DNA, 252 bp, Unknown
  Artificiall/Consensus sequence
tacgtaggtggcaagcgttgtccggaattactgggtgtaaagggagcgtaggcgggaaagcaagttgaatgtttaaactatcggctcaaccgataatcgcgttcaaaactgtttttcttgagtgaagtagaggtaggcggaattcctagtgtagcggtgaaatgcgtagatattaggaggaacaccagtggcgaaggcggcctactgggctttaactgacgctgaggctcgaaagcatgggtagcaaacagg

SEQ ID NO: 526 - DNA, 253 bp, Unknown
  Artificiall/Consensus sequence
tacgtaggtcccgagcgttaatcggaattactgggcgtaaagcgagcgcagacggttacttaagcaggatgtgaaatccccgggcttaacctgggaactgcgttctgaactgggtgactagagtgtgtcagagggaggtagaattccacgtgtagcagtgaaatgcgtagagatgtggaggaataccgatggcgaaggcagcctcctgggatgacactgacgttcatgctcgaaagcgtggggagcaaacagg

SEQ ID NO: 527 - DNA, 253 bp, Unknown
  Artificiall/Consensus sequence
tacgtaggtggcaagcgttatccggaattactgggtgtaaagggtgagtaggcgggtttgcaagtcagatgtgaaaactataggctcaacctatagcctgcatttgaaactgcagatcttgagtgtgggagaggtaagcggaattcccggtgtagcggtgaaatgcgtagatatcgggaggaacaccagtggcgaaggcggcttactggaccacaactgacgctgagacacgaaagcgtggggagcaaacagg

SEQ ID NO: 528 - DNA, 253 bp, Unknown
  Artificiall/Consensus sequence
tacgtaggtggcgagcgttgtccggaattactgggcgtaaagggcgcgtaggcgggaatttaagtcagatgtgaaagctccgggcttaacttggagagtgcatttgatactggatttcttgaggacaggagaggaaagcggaattcctagtgtagcggtgaaatgcgtagatattaggaggaacaccagtggcgaaggcggctttctggactgtaactgacgctgatgcgcgaaagcgtggggagcaaacggg

SEQ ID NO: 529 - DNA, 253 bp, Unknown
  Artificiall/Consensus sequence
tacgtagggagcaagcgttgtccggatttactgggtgtaaagggtgcgtaggcggttttgcaagtcaggagtgaaatccatgggcttaacccatggactgcttttgaaactgcaagacttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacagg

SEQ ID NO: 530 - DNA, 253 bp, Unknown
  Artificiall/Consensus sequence
tacgtaggtagcaagcgttgtccggaatgactgggcgtaaagggtgcgtaggtggcttaacaagttggtagtgaaattccgaggcttaacttcggcactactaccaagactgttgagcttgagtacaggagaggtaagtggaattcctagtgtagcggtggaatgcgtagatattaggaggaacaccagtggcgaaggcgacttactggcctgcaactgacactgaggcacgaaagcgtggggagcaaacagg

SEQ ID NO: 531 - DNA, 253 bp, Unknown
  Artificiall/Consensus sequence
tacgtaggtggcaagcgttgtccggatttactgggtgtaaagggcgtgtaggcgggattacaagtcagatgtgaaatctcacggctcaaccgggagtctgcatttgaaactgtagttcttgagtgatggagaggcaggcggaattccttgtgtagcggtgaaatgcgtagatataaggaggaacaccagtggcgaaggcggcctgctggacgacaactgacgctgaggcgcgaaagcgtggggagcaaacagg

SEQ ID NO: 532 - DNA, 253 bp, Unknown
  Artificiall/Consensus sequence
tacgtagggggcaagcgttatccggaattactgggtgtaaagggtgagtaggcggcatggtaagccagatgtgaaagcccgcagcttaactgcgggattgcatttggaactactaagctagagtacaggagaggaaagcggaattcctagtgtagcggtgaaatgcgtagatattaggaagaacaccggtggcgaaggcggctttctggactgaaactgacgctgaggcacgaaagcgtggggagcgaacagg

SEQ ID NO: 533 - DNA, 253 bp, Unknown
  Artificiall/Consensus sequence
tacgtagggggcaagcgttatccggaatcactgggtgtaaagggagcgtagacggcagggcaagcctggagtgaaaggcgggggcccaacccccggactgctctgggaactgcccggctggagtgcaggagaggtaagtggaattcctagtgtagcggtgaaatgcgtagatattaggaggaacaccagtggcgaaggcggcttactggacgataactgacgctgaggctcgaaagcgtggggagcaaacagg

SEQ ID NO: 534 - DNA, 253 bp, Unknown
  Artificiall/Consensus sequence
tacgtagggcgcgagcgttgtccggaattattgggcgtgaagggcttgtaggcggccggtcgcgtccgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggctcgaaagcgtggggagcaaacagg

SEQ ID NO: 535 - DNA, 253 bp, Unknown
  Artificiall/Consensus sequence
tacgtagggtgcgagcgttaatcggaattactgggcgtaaagcgagcgcagacggttatttaagcaggatgtgaaatccccgggcttaacctgggaactgcgttctgaactggatagctagagtgtgtcagaggggggtagaattccacgtgtagcagtgaaatgcgtagagatgtggaggaataccgatggcgaaggcagcctcctgggataacactgacgttcatgcccgaaagcgtggggagcaaacagg

SEQ ID NO: 536 - DNA, 253 bp, Unknown
  Artificiall/Consensus sequence
tacggaggatgcaagcgttatccggatttactgggtgtaaagggagcgtaggcggtatggcaagtctgatgtgaaagcccggggctcaaccgcgggactgcattggaaactgtcgtactagagtgtcggagaggtaagtggaattcctagtgtagcggtgaaatgcgtagatattaggaggaacaccagtggcgaaggcggcttgctgggcctttactgacgctgaggctcgaaagcgtggggagcaaacagg

SEQ ID NO: 537 - DNA, 253 bp, Unknown
  Artificiall/Consensus sequence
tacgtagggggcaagcgttatccggaattactgggtgtaaagggagcgtaggcggcatggtaagccagatgtgaaagccttgggcttaacccgaggattgcatttggaactatcaagctagagtacaggagaggaaagcggaattcctagtgtagcggtgaaatgcgtagatattaggaagaacaccagtggcgaaggcgactttctggacgaaaactgacgctgaggcgcgaaagccaggggagcgaacggg

SEQ ID NO: 538 - DNA, 253 bp, Unknown
  Artificiall/Consensus sequence
tacgtagggggcaagcgttatccggatttactgggtgtaaagggagcgtagacggtaatgcaagtctggagtgaaaacccggggctcaaccccgggactgctttggaaactgtgtaactagagtgtcggagaggcaagtggaattcctagtgtagcggtgaaatgcgtagatattaggaggaacaccagtggcgaaggcggcttgctggacgatgactgacgttgaggctcgaaagcgtggagagcaaacagg

SEQ ID NO: 539 - DNA, 253 bp, Unknown
  Artificiall/Consensus sequence
tacggaggatccgagcgttatccggatttattgggtttaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacagg

SEQ ID NO: 540 - DNA, 253 bp, Unknown
  Artificiall/Consensus sequence
tacggaggatccgagcgttatccggatttactgggtgtaaagggagcgcaggcggtgcagcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttgctgggcttttactgacgctgaggctcgaaagcgtggggagcaaacagg

SEQ ID NO: 541 - DNA, 252 bp, Unknown
  Artificiall/Consensus sequence
tacggaggatacgagcgttatccggaattattgggcgtaaagcgcgcgcaggcggatcagtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 542 - DNA, 253 bp, Unknown
  Artificiall/Consensus sequence
tacggaaggtccaggcgttatccggatttattgggtttaaagggagcgcaggcggactcttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaagcgtggggatcaaacagg

SEQ ID NO: 543 - DNA, 253 bp, Unknown
  Artificiall/Consensus sequence
aacgtaggtcacaagcgttgtccggaattactgggtgtaaagggagcgcaggcgggtatgcaagttgggagtgaaatacatgggctcaacccatgaactgctctcaaaactgtgtatcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacagg

SEQ ID NO: 544 - DNA, 253 bp, Unknown
  Artificiall/Consensus sequence
tacggaggatccaagcgttatccggatttattgggtttaaagggtgcgtaggcggtttgataagttagaggtgaaataccggtgcttaacaccggaactgcctctaatactgttgaactagagagtagttgcggtaggcggaatgtatggtgtagcggtgaaatgcttagagatcatacagaacaccgattgcgaaggcagcttaccaaactataactgacgctgaagcacgaaagcgtgggtatcgaacagg

SEQ ID NO: 545 - DNA, 253 bp, Unknown
  Artificiall/Consensus sequence
tacgtaggtcccgagcgttgtccggatttattgggcgtaaagcgagcgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 546 - DNA, 253 bp, Unknown
  Artificiall/Consensus sequence
tacgtagggagcgagcgttatccggatttattgggtgtaaagggtgcgtagacgggaatacaagttagttgtgaaatacctcggcttaactgaggaactgcaactaaaactggttttcttgagtgctggagaggaaagtggaattcctagtgtagcggtgaaatgcgtagatattaggaggaacaccagtggcgaaggcgacttactggactgaaactgacgttgaggcacgaaagtgtggggagcaaacagg

SEQ ID NO: 547 - DNA, 253 bp, Unknown
  Artificiall/Consensus sequence
tacgtagggggcaagcgttatccggatttactgggtgtaaagggagcgtaggtggcaaggcaagtcagatgtgaaaacccggggctcaaccccgggactgcatttgaaactgtctagctagagtgcaggagaggtaagtggaattcctagtgtagcggtgaaatgcatagatattaggaggaacaccagtggcgaaggcggcttactggactgtaactgacactgaggctcgaaagtgtgggtatcaaacagg

SEQ ID NO: 548 - DNA, 253 bp, Unknown
  Artificiall/Consensus sequence
tacgtaggtggcaagcgttgtccggaattactgggtgtaaagggcgtgtaggcgggtaatcaagtcagatgtgaaataccggggcttaactccggggctgcatctgaaactgaatatcttgagtactggagaggaaagtggaattcctagtgtagcggtgaaatgcgtagagattaggaggaacaccagtggcgaaggcggcttactggacgataactgacgctgaggctcgaaagcgtggggagcaaacagg

SEQ ID NO: 549 - DNA, 253 bp, Unknown
  Artificiall/Consensus sequence
tacgtagggggcaagcgttatccggatttactgggtgtaaagggagcgtagacggccaggcaagtctgaagtgaaagcccggggctcaaccccgggaccgctttggaaactgtatggctagagtgcgggaggggtaggcggaattcctagtgtagcggtgaaatgcgtagatattaggaggaacaccggtggcgaaggcggcctactggaccgtaactgacgttgaggctcgaaggcgtggggagcaaacagg

SEQ ID NO: 550 - DNA, 253 bp, Unknown
  Artificiall/Consensus sequence
tacgtagggggcaagcgttatccggatttattgggtgtaaagggtgcgtagacggtaatgcaagttagttgtgaaatccctcggcttaactgaggaattgcaactaaaactacatttcttgagtattggaggggaaagtggaattcctagtgtagcggtgaaatgcgtagatattaggaggaacaccggtggcgaaggcgactttctggacaattactgacgttgaggcacgaaagtgtggggagcaaacagg

SEQ ID NO: 551 - DNA, 252 bp, Unknown
  Artificiall/Consensus sequence
tacgtagggagcaagcgttgtccggaattactgggtgtaaagggagcgtaggcgggctcgcaagttgaatgtgaaatccagaggcttaacctctggctgcgttcaaaactgcgggtcttgagtgaagtagaggcaggcggaattcctagtgtagcggtgaaatgcgtagatattaggaggaacaccagtggcgaaggcggcctgctgggcttttactgacgctgaggctcgaaagcatgggtagcaaacagg

SEQ ID NO: 552 - DNA, 253 bp, Unknown
  Artificiall/Consensus sequence
tacgtagggagcaagcgttgtccagatttactgggtgtaaagggtgcgtaggcggcgatgcaagtcaggcgtgaaatccatcggcttaactgatgaactgcgtttgaaactgtgtcgcttgagtgagtcagaggcaggcggaattcccggtgtagcggtgaaatgcgtagagatcgggaggaacaccagtggcgaaggcggcctgctggggcttaactgacgctgaggcacgaaagcgtggggagcaaacagg

SEQ ID NO: 553 - DNA, 254 bp, Unknown
  Artificiall/Consensus sequence
aacgtagggggcaagcgttatccggaattactgggtgtaaagggtgagtaggcggcatggtaagttagatgtgaaagcccagggcttaaccctgggattgcatttaaaactactaagcttagagtacaggagaggtaagcggaattcctagtgtagcggtgaaatgcgtagatattaggaagaacaccggtggcgaaggcggcttactggactgaaactgacgctgaggcacgaaagcgtggggagcaaacagg

SEQ ID NO: 554 - DNA, 253 bp, Unknown
  Artificiall/Consensus sequence
tacgtagggggcaagcgttatccggatttactgggtgtaaagggagcgtagacggcaaggcaagtctgatgtgaaagactggggctcaaccctgggactgcattggaaactgtcctgctggagtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 555 - DNA, 253 bp, Unknown
  Artificiall/Consensus sequence
tacgtagggagcaagcgttgtccggaattactgggcgtaaagggtgcgtaggcggtcgtgtaagtcatatgtgaaatacccgggcttaacccggggggtgcatgtgatactgcatggcttgagtacaggagaggaaagtggaattcctagtgtagcggtgaaatgcgtagatattaggaggaacaccagtggcgaaggcggctttctggactgtaactgacgctgaggcacgaaagcgtggggagcaaacagg

SEQ ID NO: 556 - DNA, 252 bp, Unknown
  Artificiall/Consensus sequence
tacgtagggggcgagcgttatccggattcattgggcgtaaagcgctcgtaggcggtccgttaggtcgggagtcaaatccgggggctcaacccccgcccgctcccgataccggcggacttgagtttggtaggggaaggcggaattccaagtgtagcggtggaatgcgcagatatttggaagaacaccggtggcgaaggcggccttctgggccacaactgacgctgaggagcgaaagctaggggagcgaacagg

SEQ ID NO: 557 - DNA, 253 bp, Unknown
  Artificiall/Consensus sequence
aacgtaggtcacaagcgttgtccggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacagg

SEQ ID NO: 558 - DNA, 253 bp, Unknown
  Artificiall/Consensus sequence
aacgtagggtgcaagcgttgtccggaattactgggtgtaaagggagcgcaggcggaccggcaagttggaagtgaaaactatgggctcaacccataaattgctttcaaaactgctggccttgagtagtgcagaggtaggtggaattcccggtgtagcggtggaatgcgtagatatcgggaggaacaccagtggcgaaggcggctctctggtctgcaactgacgctgaggctcgaaagcatgggtagcgaacagg

SEQ ID NO: 559 - DNA, 253 bp, Unknown
  Artificiall/Consensus sequence
aacgtaggtcacaagcgttgtccggaattactgggtgtaaagggagcgcaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacagg

SEQ ID NO: 560 - DNA, 253 bp, Unknown
  Artificiall/Consensus sequence
tacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccttgggaatgtactgacgctcatgtgcgaaagcgtggggagcaaacagg

SEQ ID NO: 561 - DNA, 253 bp, Unknown
  Artificiall/Consensus sequence
tacgtagggggcaagcgttgtccggaatcactgggcgtaaagagcacgcaggcggtctggtaagtcagatgtgaaagtttgaggcttaaccttaaaagtgcatctgatactgtcagacttgagtctcggagaggtaagcggaattcctagtgtagcggtgaaatgcgtagagattaggaagaacaccggtggcgaaggcggcttactggacgagtactgacgctcaggtgcgaaagcgtggggagcgaacagg

SEQ ID NO: 562 - DNA, 253 bp, Unknown
  Artificiall/Consensus sequence
tacgtagggtgcgagcgttgtccggaattattgggcgtaaagggctcgtaggcggtttgtcgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 563 - DNA, 253 bp, Unknown
  Artificiall/Consensus sequence
tacgtagggggcaagcgttatccggattcactgggtgtaaagggagcgtagacggccatgcaagcctggagtgaaagcccggggcccaaccccgggactgctctgggaactgtgcggctggagtgcgggaggggcaggcggaattcctggtgtagcggtgaaatgcgtagatatcaggaggaacaccggcggcgaaggcggcctgctggaccgcgactgacgttgaggctcgaaagcgtggggagcaaacagg

SEQ ID NO: 564 - DNA, 253 bp, Unknown
  Artificiall/Consensus sequence
tacgtagggagcgagcgttgtccggatttactgggtgtaaagggtgcgtaggcggctgtgcaagtcagtagtgaaatccatgggcttaacccatgaactgctattgaaactgcacagcttgagtgaagtagaggtaggcggaattcccggtgtagcggtgaaatgcgtagagatcgggaggaacaccagtggcgaaggcggcctactgggctttaactgacgctgaggcacgaaagcgtgggtagcaaacagg

SEQ ID NO: 565 - DNA, 253 bp, Unknown
  Artificiall/Consensus sequence
tacgtagggggcaagcgttatccggatttactgggtgtaaagggagcgtagacggtgcagcaagtctgatgtgaaaggtcggggcccaaccccgggactgcattggaaactgttgaactggagtacaggagaggtaagcggaattcctagtgtagcggtgaaatgcgtagatattaggaggaacaccagtggcgaaggcggctctctggcttgtaactgacgctgaggctcgaaagcgtggggagcaaacagg

SEQ ID NO: 566 - DNA, 253 bp, Unknown
  Artificiall/Consensus sequence
tacgtatggagcaagcgttatccggatttactgggtgtaaagggagcgtaggcggtgcggcaagtctgatgtgaaattccggggctcaaccccgggactgcattggaaactgtcggactggagtgtcggagaggtaagtggaattcctagtgtagcggtgaaatgcgtagatattaggaggaacaccagtggcgaaggcggcttactggacgacaactgacgctgaggctcgaaagcgtggggagcaaacagg

SEQ ID NO: 567 - DNA, 253 bp, Unknown
  Artificiall/Consensus sequence
tacgtatggtgcaagcgttatccggatttactgggtgtaaagggcgcgcaggcgggcttgcaagttgggagtgaaatcccggggcttaaccccggaactgctctcaaaactgcgagtcttgagtgatggagaggcaggcggaattcccagtgtagcggtgaaatgcgtagatattgggaggaacaccagtggcgaaggcggcctgctggacattaactgacgctgaggcgcgaaagcgtggggagcaaacagg

SEQ ID NO: 568 - DNA, 253 bp, Unknown
  Artificiall/Consensus sequence
gacgtaggtcacaagcgttgtccggaattactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttactggacgataactgacgttgaggctcgaaagcgtggggagcaaacagg

SEQ ID NO: 569 - DNA, 253 bp, Unknown
  Artificiall/Consensus sequence
tacgtaggtggcaagcgttgtccggatttactgggtgtaaagggcgtgtagccgggtcggcaagtcagatgtgaaatccacgggctcaactcgagaactgcatttgaaactgttgatcttgagtatcggagaggcaatcggaattcctagtgtagcggtgaaatgcgtagatattaggaggaacaccagcggcgaaggcggcttactggacgataactgacgctgaggctcgaaagcgtggggatcaaacagg

SEQ ID NO: 570 - DNA, 253 bp, Unknown
  Artificiall/Consensus sequence
tacgtaggtggcgagcgttatccggatttactgggtgtaaagggtgtgtaggcggaggagcaagtcaggcgtggaaattacgggctcaacccgtaacttgcgcttgaaactgttccccttgagtgtcggagaggtaaatggaattcccagtgtagcggtgaaatgcgtagatattgggaggaacaccggtggcgaaggcggtttactggacgacaactgacgctgagacacgaaagtgtggggagcaaacagg

SEQ ID NO: 571 - DNA, 253 bp, Unknown
  Artificiall/Consensus sequence
tacggaggatccaagcgttatccggatttattgggtttaaagggtgcgtaggcggttttataagttagaggtgaaaattcggggctcaactccggacgtgcctctaatactgtatgactagagaatagatgcggtaggcggaatgtatggtgtagcggtgaaatgcgtagagatcatacagaacaccgattgcgaaggcagcttaccaaactatatctgacgttgaggcacgaaagcgtggggagcaaacagg

SEQ ID NO: 572 - DNA, 253 bp, Unknown
  Artificiall/Consensus sequence
tacgtatggtgcgagcgttgtccggatttactgggtgtaaagggcgtgtaggcgggattgcaagtcagatgtgaaattccggggctcaaccccggaactgcatttgaaactgtagttcttgagtactggagaggcaggcggaattcctagtgtagcggtgaaatgcgtagatattaggaggaacaccagtggcgaaggcggcctgctggacagcaactgacgctgaggcgcgaaagcgtggggagcaaacagg

SEQ ID NO: 573 - DNA, 252 bp, Unknown
  Artificiall/Consensus sequence
tacgtaggtggcaagcgttatccggaattattgggcgtaaagagtgcgtaggtggttacctaagcagggggtgaaaggcaatggctcaaccattgttagccccctgaactgggtatcttgagtgcaggagaggaaagcggaattcctagtgtagcggtgaaatgcgtagatattaggaggaacaccagtggcgaaggcggctttctggactgaaactgacactgaggcacgaaagtgtggggagcaaacagg

SEQ ID NO: 574 - DNA, 253 bp, Unknown
  Artificiall/Consensus sequence
tacgtagggagcgagcgttgtccggaattactgggtgtaaagggagtgtaggcgggactgcaagtcagatgtgaaaactatgggcttaacccatagactgcatttgaaactgcggttcttgagtgaagtagaggtaagcggaattcctagtgtagcggtgaaatgcgtagatattaggaggaacatcagtggcgaaggcggtctactggacgataactgacgctgaggcgcgaaagcgtggggagcaaacagg

SEQ ID NO: 575 - DNA, 253 bp, Unknown
  Artificiall/Consensus sequence
tacgtatggagcaagcgttatccggatttactgggtgtaaagggagcgtagacggcagggcaagtctgatgtgaaaacccggggctcaaccccgggactgcattggaaactgtccggctggagtgcaggaggggcaagcggaattcctagtgtagcggtgaactgcgtagatattaggaggaacaccagtggcgaaggcggcttactggacgataactgacgttgaggctcgaaagcgtggggagcaaacagg

SEQ ID NO: 576 - DNA, 253 bp, Unknown
  Artificiall/Consensus sequence
tacgtagggggcaagcgttatccggatttactgggtgtaaagggagcgtagacggcgaagaaagtctgaagtgaaagcccgcggctcaaccgcggaatggctttggaaacttttttgctggagtaccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 577 - DNA, 253 bp, Unknown
  Artificiall/Consensus sequence
tacgtagggggcaagcgttatccggatttactgggtgtaaagggagcgtagacggcactgcaagtctggagtgaaagcccggggctcaaccccgggactgctttggaaactgtggtgctggagtgcaggagaggtaagtggaattcctagtgtagcggtgaaatgcgtagatattaggaggaacaccagtggcgaaggcggcttactggacgataactgacgctgaggctcgaaagcgtggggagcaaacagg

SEQ ID NO: 578 - DNA, 252 bp, Unknown
  Artificiall/Consensus sequence
tacgtaggtggcgagcgttatccggaatgattgggcgtaaagggtgcgtaggcggtcgattaagtctggagtgaaaggtaccggctcaaccggtataggctctggaaactgatggactggagtacaggagagggtggcggaactccatgtgtagcggtaaaatgcgtagatatatggaagaacaccggtggcgaaggcggccgcccggactgtaactgacgctgaggcacgaaagcgtggggagcaaatagg

SEQ ID NO: 579 - DNA, 253 bp, Unknown
  Artificiall/Consensus sequence
tacgtagggggcaagcgttatccggatttactgggtgtaaagggagcgtagacggagcagcaagtctgatgtgaaaggcgggggctcaacccccggactgcattggaaactgtaggtcttgagtaccggagaggttatcggaattccttgtgtagcggtgaaatgcgtagatataaggaagaacaccagtggcgaaggcagcttgctggactgtaactgacgctgatgctcgaaagtgtgggtatcaaacagg

SEQ ID NO: 580 - DNA, 253 bp, Unknown
  Artificiall/Consensus sequence
tacgtagggggcgagcgttgtccggaattactgggcgtaaagggtgcgtaggcggtagcttaagttggatgtgaaatacccgggcttaacttggggggtgcatccaatactgggcaactagagtgcaggagagggaagcggaattcctagtgtagcggtgaaatgcatagatattaggaggaacaccagtggcgaaggcggctttctggactgtaactgacgctgaggcgcgaaagtgtggggagcaaacagg

SEQ ID NO: 581 - DNA, 253 bp, Unknown
  Artificiall/Consensus sequence
tacgtagggggcaagcgttatccggatttactgggtgtaaagggagcgtagacggccaggcaagtctgatgtgaaaggcaggggctcaacccctggactgcattggaaactgtcaggctggagtgccggagaggtaagcggaattcctagtgtagcggtgaaatgcgtagatattaggaggaacaccagtggcgaaggcggcttactggactgtaactgacgttgaggcttgaaagcgtggggagcaaacagg

SEQ ID NO: 582 - DNA, 253 bp, Unknown
  Artificiall/Consensus sequence
tacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacagg

SEQ ID NO: 583 - DNA, 253 bp, Unknown
  Artificiall/Consensus sequence
tacgtagggagcgagcgttgtccggaattactgggtgtaaagggagcgtaggtgggattgcaagtcagatgtgaaaggcggaggctcaacctccgagctgcatttgaaactgtagttcttgagtgaagtagaggtaagcggaattcctggtgtagcggtgaaatgcgtagatatcaggaggaacaccggtggcgaaggcggcttactgggcttttactgacgctgaggctcgaaagcgtggggagcaaacagg

SEQ ID NO: 584 - DNA, 252 bp, Unknown
  Artificiall/Consensus sequence
tacgtagggtgcaagcgttgtccggaattactgggtgtaaagggagcgtaggcggggacgcaagttgaatgtttaaactatgggctcaacccatagtcgcgttcaaaactgtgactcttgagtgaagtagaggcaggcggaattcctagtgtagcggtgaaatgcgtagatattaggaggaacaccagtggcgaaggcggcctgctgggcttttactgacgctgaggctcgaaagtgcggggagcaaacagg

SEQ ID NO: 585 - DNA, 253 bp, Unknown
  Artificiall/Consensus sequence
tacgtagggggcaagcgttatccggatttactgggtgtaaagggagcgtagacggcacggcaagccagatgtgaaagcccggggctcaaccccgagactgcatttggaactgctgagctagagtgtcggagaggcaagcggaattcctagtgtagcggtgaaatgcgtagatattaggaggaacaccagtggcgaaggcggcttgctgggccatcactgacgctgaggcacgaaagtgtggggagcaaacagg

SEQ ID NO: 586 - DNA, 253 bp, Unknown
  Artificiall/Consensus sequence
tacgtaggtggcaagcgttatccggatttactgggtgtaaagggtgtgtaggcgggaaggcaagtcagatgtgaaacctgtgggctcaactcacagcctgcatttgaaactgtctttcttgagagtcggaggggtaatcggaattcccggtgtagcggtgaaatgcgtagagatcgggaggaacatcagtggcgaaggcggattactggacgacaactgacgctgagacacgaaagcgtggggagcaaacagg

SEQ ID NO: 587 - DNA, 253 bp, Unknown
  Artificiall/Consensus sequence
tacggagggtgcgagcgttgtccggaatcattgggcgtaaagagttcgtaggtggcctgttaagtctggtgttaaatgcagatgctcaacatctgttcggcactggatactggcaagcttgaatgcggtagaggtaaagggaattcctggtgtagcggtgaaatgcgtagatattaggaggaacaccagtggcgaaggcggcttactggactgtaactgacgttgaggctcgaaagcgtggggagcaaacagg

SEQ ID NO: 588 - DNA, 252 bp, Unknown
  Artificiall/Consensus sequence
tacgtatggtgcaagcgttatccggatttactgggtgtaaaggagcgtagacggttgtgcaagtctgaagtgaaagcccggggctcaaccccggtactgctttggaaactgtgtaactggagtgcaggagaggtaagtggaattcctagtgtagcggtgaaatgcgtagatattaggaggaacaccagtggcgaaggcgactttctggactgtaactgacactgaggctcgaaagcgtggggagcaaacagg

SEQ ID NO: 589 - DNA, 253 bp, Unknown
  Artificiall/Consensus sequence
tacgtaggtggcaagcgttgtccggatttactgggtgtaaagggagcgtagacggcatcacaagtcagaagtgaaaatccggggctcaaccccggaactgcttttgaaactgtggagctggagtgcaggagaggtaagcggaattcctagtgtagcggtagaatgcgtagatattagaaggaacaccggtggcgaaggcgatttgctgggccattactgacgctgagacacgaaagcgtggggagcaaatagg

SEQ ID NO: 590 - DNA, 252 bp, Unknown
  Artificiall/Consensus sequence
tacgtaggtcccaagcgttgtccggatttattgggcgtaaagcgagcgcaggtggtttcttaagtctgatgtagaaggcagtggctcaaccattgtgtgcattggaaactgggagacttgagtgcaggagaggagagtggaattccatgtgtagcggtgaaatgcgtagatatatggaggaacaccggaggcgaaagcggctctctggcctataactgacactgaggctcgaaagcgtggggagcaaacagg

SEQ ID NO: 591 - DNA, 253 bp, Unknown
  Artificiall/Consensus sequence
tacgtagggggcaagcgttatccggatttactgggtgtaaagggagcgtagacggcacggcaagtctgatgtgaaagcccggggctcaacttcgggactgcattggaaactgttgagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 592 - DNA, 253 bp, Unknown
  Artificiall/Consensus sequence
tacagaggtctcaagcgttgttcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaaggctgacgctcaggtgcgaaagcgtggggagcaaacagg

SEQ ID NO: 593 - DNA, 253 bp, Unknown
  Artificiall/Consensus sequence
tacgtagggggcaagcgttatccggatttactgggtgtaaagggcgcgtaggcgggggaacaagtcagatgtgaaatctatgggcttaacccataaactgcatttgaaactatttctcttgagtgatggagaggcaagcggaattcctagtgtagcggtgaaatgcgtagatattaggaggaacaccagtggcgaaggcggcttgctggacagtaactgacgttgaggctcgaaagcgtggggagcaaacagg

SEQ ID NO: 594 - DNA, 253 bp, Unknown
  Artificiall/Consensus sequence
tacgtagggagcaagcgttgtccggaattactgggcgtaaagggtgcgtaggtggccatgtaagtcaggtgtgaaagaccggggctcaaccccggggttgcacttgaaactgtgtggcttgagtacaggagagggaagtggaattcctagtgtagcggtgaaatgcgtagatattaggaggaacaccagtggcgaaggcgactttctggactgtaactgacgttgaggctcgaaagcgtggggagcaaacagg

SEQ ID NO: 595 - DNA, 253 bp, Unknown
  Artificiall/Consensus sequence
tacgtatggagcaagcgttatccggatttactgggtgtaaagggagcgtagacggcgctgcaagtctgatgtggaaggccggggctcaaccccgggactgcattggaaactgtggagcttgagtgccggagaggtaagcggaattcctagtgtagcggtgaaatgcgtagatattaggaggaacaccagcggcgaaggcggcttactggactgtaactgacgttgaggctcgaaagcgtggggagcaaacagg

SEQ ID NO: 596 - DNA, 253 bp, Unknown
  Artificiall/Consensus sequence
tacggaggattcaagcgttatccggatttactgggtgtaaagggcgtgtaggcgggacaacaagtcagatgtgaaaactatgggctcaacccatagcctgcatttgaaactgtcgttcttgagtgctggagaggcaaatggaactcctagtgtagcggtgaaatgcgtagatattaggaagaacaccagtggcgaaggcgatttgctggacagtaactgacgctgaggcgcgaaagcgtggggagcaaacagg

SEQ ID NO: 597 - DNA, 253 bp, Unknown
  Artificiall/Consensus sequence
tacgtaggtggcaagcgttatccggatttattgggtgtaaagggtgagtaggcgggctgacaagtcagatgtgaaatgttcgggcttaacctgagaactgcatttgaaactgccagtcttgagtgtcggaggggtaatcggaattcccggtgtagcggtgaaatgcgtagagatcgggaggaacaccagtggcgaaggcggcctactgggcaccaactgacgctgaggctcgaaagtgtgggtagcaaacagg

SEQ ID NO: 598 - DNA, 253 bp, Unknown
  Artificiall/Consensus sequence
tacgtaggttgcaagcgttgtccggatttactgggtgtaaagggagcgtagacggctgtgtaagtctgatgtgaaagaccggggctcaaccccgggcctgcattggaaactatatagctagagtgtcggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 599 - DNA, 253 bp, Unknown
  Artificiall/Consensus sequence
tacgtaggtggcaagcgttgtccggatttactgggtgtaaagggcgtgtaggcgggtttacaagtcagatgtgaaataccggggctcaactccggggctgcatttgaaactgtagatcttgagtgtcggagaggaaagcggaattcctagtgtagcggtgaaatgcgtagatattaggaggaacaccagtggcgaaggcggcttgctggactgtaactgacgctgaggctcgaaagtgtggggagcaaacagg

SEQ ID NO: 600 - DNA, 253 bp, Unknown
  Artificiall/Consensus sequence
tacgtaggtggcaagcgttgtccggatttactgggtgtaaagggcgtgtaggcgggtttacaagtcagatgtgaaataccggggctcaaccccggtactgcattggaaactgtcggactagagtgtcggaggggtaagtggaattcctagtgtagcggtgaaatgcgtagatattaggaggaacaccagtggcgaaggcggcttactggacgataactgacgctgaggctcgaaagtgtgggtagcaaacagg

SEQ ID NO: 601 - DNA, 253 bp, Unknown
  Artificiall/Consensus sequence
tacgtagggggcaagcgttatccggatttactgggtgtaaagggagcgtagacggcaaagcaagtctgaagtgaaagcccggggcttaacctcgggactgctttggaaactgtttagctagagtgccggagaggtaagcggaattcctagtgtagcggtgaaatgcgtagatattaggaggaacaccagtggcgaaggcggcctactgggcaccaactgacgctgaggctcgaaagtgtgggtagcaaacagg

SEQ ID NO: 602 - DNA, 253 bp, Unknown
  Artificiall/Consensus sequence
tacgtaggtggcgagcgttgtccggatttactgggtgtaaagggcgcgtaggcgggcttgcaagtcagatgtgaaataccggggcttaaccccggggctgcatttgaaactgtgagtcttgagtgtcggagaggaaagcggaattcctagtgtagcggtgaaatgcgtagatattaggaggaacaccagtggcgaaggcggctttctggacgataactgacgctgatgcgcgaaagtgtggggagcaaacagg

SEQ ID NO: 603 - DNA, 253 bp, Unknown
  Artificiall/Consensus sequence
tacgtagggggcgagcgttgtccggaattattgggcgtaaagggtgcgtaggcggccaagtaagtcagatgtgaaatgccagggcttaaccctggagctgcatttgaaactgcatggcttgagtgcaggagagggaagcggaattcctagtgtagcggtgaaatgcatagatattaggaggaacaccagtggcgaaggcggctttctggactgtaactgacgctgaggcacgaaagcgtggggagcaaacagg

SEQ ID NO: 604 - DNA, 253 bp, Unknown
  Artificiall/Consensus sequence
tacggaggatccgagcgttatccggatttactgggtgtaaagggagcgtagacggctgtgcaagtttgaagtgaaagcccggggctcaaccgcgggactgctttgaaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacagg

SEQ ID NO: 605 - DNA, 253 bp, Unknown
  Artificiall/Consensus sequence
tacgtaggtggcgagcgttgtccggatttactgggtgtaaagggcgtgtaggcgggactgcaagtcagatgtgaaatacggaggcttaacctccgggctgcatttgaaactgcaattcttgagtgatggagaggtaagcggaattcccggtgtagaggtaaaattcgtagatatcgggaggaacaccagtggcgaaggcggcttactggacattaactgacgctgaggcgcgaaagtgtggggagcaaacagg

SEQ ID NO: 606 - DNA, 253 bp, Unknown
  Artificiall/Consensus sequence
tacgtaggtggcaagcgttatccggatttactgggtgtaaagggcgtgtaggcgggattgcaggtcagatgtgaaaaccatgggctcaactcatggcctgcatttgaaactgtagttcttgagtactggagaggcagacggaattcctagtgtagcggtgaaatgcgtagatattaggaggaacaccagtggcgaaggcggtctactgggcaccaactgacgctgaggctcgaaagcatgggtagcaaacagg

SEQ ID NO: 607 - DNA, 253 bp, Unknown
  Artificiall/Consensus sequence
tacgtagggggcaagcgttatccggatttactgggcgtaaagggagcgtagacggcaagacaagtctggagtgaaagcccggggctcaaccgcgggactgctctggaaactgccttgctggagtgctggagaggcaagcggaattcctagtgtagcggtgaaatgcgtagatattaggaggaacaccagtggcgaaggcggcttgctggacggtaactgacgttgaggctcgaaagcgtggggagcaaacagg

SEQ ID NO: 608 - DNA, 253 bp, Unknown
  Artificiall/Consensus sequence
  misc_feature (252)..(252): n is a, c, g, or t
tacgtaggtggcaagcgttatccggatttattgggtgtaaagggcgtgtaggcgggactgtaagtcaggcgtgaaaactgggggctcaacctccagcctgcgtttgaaactatagttcttgagtgtcggagaggtaatcggaattccgtgtgtagcggtgaaatgcgtagatatacggaggaacaccagtggcgaaggcggcctgctggacattaactggcgctgaggagcgaaagcgtggggagcaaacang

SEQ ID NO: 609 - DNA, 253 bp, Unknown
  Artificiall/Consensus sequence
tacgtagggggcaagcgttgtccggaatgattgggcgtaaagggcgcgtaggcggccaactaagtctggagtgaaagtcctgcttttaaggtgggaattgctttggaaactggatggcttgagtgcaggagaggtaagcggaattcccggtgtagcggtgaaatgcgtagatattaggaggaacaccagtggcgaaggcggcttactggacggtaactgacgttgaggctcgaaagcgtggggagcaaacagg

SEQ ID NO: 610 - DNA, 253 bp, Unknown
  Artificiall/Consensus sequence
tacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtgggtagcaaacagg

SEQ ID NO: 611 - DNA, 253 bp, Unknown
  Artificiall/Consensus sequence
tacgtatgtcgcgagcgttatccggaattactgggcgtaaagcgcacgcaggcggtttgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 612 - DNA, 253 bp, Unknown
  Artificiall/Consensus sequence
tacgtagggcgcgagcgttgtccggaattattgggcgtaaagggctcgtaggcggtttgtcgcgtcgggagtgaaaactcagggctcaaccctgagcgtgcttccgatacgggcagactagaggtattcaggggagaacggaattcctggtgtagcggtggaatgcgcagatatcaggaggaacaccggtggcgaaggcggttctctgggaattacctgacgctgaggagcgaaagcatggggagcgaacagg

SEQ ID NO: 613 - DNA, 253 bp, Unknown
  Artificiall/Consensus sequence
tacggagggtgcaagcgttaatcggaattactgggcgtaaagcgcacgcaggcggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcatggggagcgaacagg

SEQ ID NO: 614 - DNA, 253 bp, Unknown
  Artificiall/Consensus sequence
tacggaggatccaagcattatccagatttattgggtttaaagggtgcgtaggcagtttgataagttagaggtaaaataccggtgcttaacaccggaactgcctctaatactgttgaactagagagtagttgcagtaggcgaaatatatgatgtagcggtgaaatgcttagagatcatacagaacaccaattgcgaaggcagcttaccaaactatatctgacgttgaggcacaaaagcgtggggagcaaacagg

SEQ ID NO: 615 - DNA, 252 bp, Unknown
  Artificiall/Consensus sequence
tacgtaggtggcaagcgttgtccggaattactgggtgtaaagggagcgtaggtgggggtacaagttgaatgtttaacctatcggctcaaccgatagtcgcgttcaaaactgtatctcttgagtggagtagaggcaggcggaattcctagtgtagcggtgaaatgcgtagatattaggaggaacaccagtggcgaaggcggcctgctgggctctaactgacgctgaggctcgaaagcgtgggtagcaaacagg

SEQ ID NO: 616 - DNA, 252 bp, Unknown
  Artificiall/Consensus sequence
tacgtagggggcaagcgttatccggaattattgggcgtaaagagttcgtaggtggttttgtaagcgcggggtgaaaggcagtggctcaaccattgttagccttgcgaactgcaagacttgagtgcgggagaggaaagtggaattcctagtgtagcggtgaaatgcgtagatattaggaggaacaccagtggcgaaggcgactttctggaccgtaactgacactgaggaacgaaagcgtggggagcaaacagg

SEQ ID NO: 617 - DNA, 253 bp, Unknown
  Artificiall/Consensus sequence
tacgtagggggcaagcgttatccggaattactgggcgtaaagggcgcgtaggtggacgtttaagtcagatgtgaaaactccgggctcaacttggagactgcatttgaaactggatatcttgagggtaggagaggaaagtggaattcctagtgtagcggtgaaatgcgtagatattaggaggaacaccagtggcgaaggcgactttctggactatacctgacactgaggcgcgaaagcgtggggagcaaacagg

SEQ ID NO: 618 - DNA, 252 bp, Unknown
  Artificiall/Consensus sequence
aacgtaggtcacaagcgttgtccggaattactgggtgtaaagggagcgcaggcggagctgcaagttgggtgtcaaatctacgggcttaacccgtatccgcactcaaaactgtagttcttgagtagtgcagaggtaggcggaattcccggtgtagcggtggaatgcgtagatatcgggaggaacaccagtggcgaaggcggcctactgggcaccaactgacgctgaggctcgaaagtatgggtagcaaacagg

SEQ ID NO: 619 - DNA, 253 bp, Unknown
  Artificiall/Consensus sequence
tacagaggtctcaagcgttaatcggaatcactgggcgtaaagcgcacgtaggctgttatgtaagtcaggggtgaaatcccacggctcaaccgtggaactgcccttgatactgcacgacttgaatccgggagagggtggcggaattccaggtgtaggagtgaaatccgtagatatctggaggaacatcagtggcgaaggcggccacctggaccagtattgacgctgaggtgcgaaagcgtggggagcaaacagg

SEQ ID NO: 620 - DNA, 253 bp, Unknown
  Artificiall/Consensus sequence
tacgtaggaggcaagcgttatccggaatgactgggcgtaaagggtgcgtaggtggttcagcaagttggcagcgtaactccggggctcaacctcggcactactgccaaaactgtcgaacttgagtgcaggaggggcaatcggaattcctagtgtagcggtggaatgcgtagatattaggaggaacaccagtggcgaaggcggattgctggactgtaactgacactgaggcacgaaagcgtggggagcaaacagg

SEQ ID NO: 621 - DNA, 253 bp, Unknown
  Artificiall/Consensus sequence
tacgtaggtggcaagcgttgtccggatttactgggtgtaaagggcgtgtaggcggagattcaagtcaggagtgaaatctatgggcttaacccataaactgcttttgaaactgaatcccttgagtatcggagaggcaggcggaattcctagtgtagcggtgaaatgcgtagatattaggaggaacaccagtggcgaaggcggcctgctggacgacaactgacgctgaggcgcgaaagcgtgggtagcaaacagg

SEQ ID NO: 622 - DNA, 253 bp, Unknown
  Artificiall/Consensus sequence
tacggaagatgcgagcgttatccggatttattgggtttaaagggagcgtagatgggttgttaagtcagttgtgaaagtttgcggctcaaccgtaaaattgcagttgatactgggtgtcttgagtacagtagaggcaggcggaattcgtggtgtagcggtgaaatgcttagatattaggaggaacaccagtggcgaaggcggcttactggacgataactgacgctgaggctcgaaagcgtggggagcaaacagg

SEQ ID NO: 623 - DNA, 252 bp, Unknown
  Artificiall/Consensus sequence
tacggaggatccgagcgttatccggatttattgggtttaaagggcgcgtaggcgggacgccaagtcagcggtaaaagactgcagctaaactgtagcacgccgttgaaactggcgacctggagacaagtcgagggaggcggaacaagtgaagtagcggtgaaatgcttagatatcacttggaaccccgatagcgaaggcagcttcccagccttgatctgacgctgatgcgcgagagcgtgggtatcaaacagg

SEQ ID NO: 624 - DNA, 253 bp, Unknown
  Artificiall/Consensus sequence
tacggaggatccaagcgttgtccggatttattgggtttaaagggtgcgtaggcggattactaagtcagaggtgaaagtttgcagcttaactgtaaaattgcctttgaaactggtagtcttgagtatagttgaggtgggcggaatgtgtcatgtagcggtgaaatgcttagatatgatacagaacaccgattgcgaaggcagctcactaaactgtaactgacgctgaggcacgaaagcgtggggagcaaacagg

SEQ ID NO: 625 - DNA, 252 bp, Unknown
  Artificiall/Consensus sequence
tacggaggatgcgagcgttatccggatttattgggtttaaagggtgcgtaggcggagtgtcaagtcagcggtaaaatttcggggctcaaccccgtcgtgccgttgaaactgacacccttgagtgagtgagaagtaagcggaatgcgtggtgtagcggtgaaatgcatagatatcacgcagaacgccgattgcgaaggcagcttaccggcgctcaactgacgctgaggcacgaaagtgcgggtatcgaacagg

SEQ ID NO: 626 - DNA, 253 bp, Unknown
  Artificiall/Consensus sequence
tacgtaggtggcgagcgttatccggaattactgggtgtaaagggcgtgtaggcgggactacaagtcagatgtgaaaaccagaggctcaacctctggcctgcatttgaaactgcagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacagg

SEQ ID NO: 627 - DNA, 253 bp, Unknown
  Artificiall/Consensus sequence
tacgtagggggcaagcgttatccggaattactgggtgtaaagggtgcgtaggcggtatggcaagtttgatgtgaaacccacaggcttaacctgtggcttgcatcgaaaactactgaactagagtgcaggagaggaaagcggaattcctagtgtagcggtgaaatgcgtagatattaggaagaacaccagtggcgaaggcggctttctggactgttactgacactgaggcacgaaagtgtggggagcaaacagg

SEQ ID NO: 628 - DNA, 253 bp, Unknown
  Artificiall/Consensus sequence
tacgtagggagcaagcgttatccggatttattgggtgtaaagggagcgtaggcggtaagacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgtaactgacgttgaggcgcgaaagcgtggggagcaaacagg

SEQ ID NO: 629 - DNA, 253 bp, Unknown
  Artificiall/Consensus sequence
tacgtatggagcaagcgttatccggatttactgggtgtaaagggagtgtaggcggcatggcaagtctgatgtgaaaatccggggcttaaccccggacctgcattggaaactgtcaggctggagtgtcggagaggtaagtggaattcctagtgtagcggtgaaatgcgtagatattaggaggaacaccagtggcgaaggcggattgctggacagcaactgacggtgaggcgcgaaagtgtggggagcaaacagg

SEQ ID NO: 630 - DNA, 252 bp, Unknown
  Artificiall/Consensus sequence
tacgtaggtggcaagcgttatccggaattattgggcgtaaagagggagcaggcggcaatggaggtctgtggtaaaaggctgaagcttaacttcagtaagccatggaaaccaaatagctagagtgcagaagaggatcgtggaattccatgtgtagcggtgaaatgcgtagatatatggaggaacaccagtggcgaaggcgacgatctggtctgtaactgacgctcagtcccgaaagcgtggggagcaaatagg

SEQ ID NO: 631 - DNA, 253 bp, Unknown
  Artificiall/Consensus sequence
tacgtaggtggcaagcgttgtccggatttactgggtgtaaagggcgtgtagccgggaggataagtcagatgtgaaatctgcgggcttaacccgcaaactgcatttgaaactgttcttcttgagtactggagaggcagacggaattcctagtgtagcggtgaaatgcgtagatattaggaggaacaccagtggcgaaggcggtctgctggacagcaactgacggtgaggcgcgaaagcgtggggagcaaacagg

SEQ ID NO: 632 - DNA, 253 bp, Unknown
  Artificiall/Consensus sequence
tacgtagggggcgagcgttatccggaattattgggtgtaaagggtgcgtagacgggagtttaagttagttgtgaaatccctcggcttaactgaggaactgcaactaaaactgaatttcttgagtgcgggagagggaagtggaattcctagtgtagcggtgaaatgcgtagatattaggaggaacaccagtggcgaaggcgactttctggaccgtaactgacgttgaggcacgaaagtgtggggagcaaacagg

SEQ ID NO: 633 - DNA, 253 bp, Unknown
  Artificiall/Consensus sequence
tacggagggtgcaagcgttatccggatttactgggtgtaaagggagcgtagacggcgtagcaagtctgaagtgaaagcccggggctcaaccccgggactgcattggaaactgtcagtctagagtgtcggaggggtaagtggaattcctagtgtagcggtgaaatgcgtagatattaggaggaacaccagtggcgaaggcggcttactggacgataactgacgttgaggctcgaaagcgtggggagcaaacagg

SEQ ID NO: 634 - DNA, 252 bp, Unknown
  Artificiall/Consensus sequence
tacggaggattcaagcgttatccggatttattgggtttaaagggtgcgtaggcggtttattaagttagtggttaaatgtttgagctaaactcaatacagccattaatactggtaaactggagttcagacgaggtaggcggaataagttaagtagcggtgaaatgcatagatataacttagaactccgatagcgaaggcagcttaccagactgaaactgacgctgatgcacgagagcgtgggtagcgaacagg

SEQ ID NO: 635 - DNA, 254 bp, Unknown
  Artificiall/Consensus sequence
tacgtagggggcaagcgttgttcggaatgtctgggcgtaaagggtgtgtaggtggtttgataagttagatgtgtaatacccagggcttaactcgggtgctgcatctaaaactgttagacttgagtactggagaggatagtggaattcctagtgtagcggtggaatgcgtagatattaggaggaacatcagtggcgaaggcgactatctggacagcaactgacactgaggcacgaaagcgtggggagcaaacagg

SEQ ID NO: 636 - DNA, 253 bp, Unknown
  Artificiall/Consensus sequence
tacgtagggggcaagcgttatccggatttactgggtgtaatgggagcgtagacggtactgcaagtctgaagtgaaagcccggggctcaaccccggtactgctttggaaactgtggaactagagtgtcggagaggtaagtggaattcctagtgtagcggtgaaatgcgtagatattaggaggaacaccagtggcgaaggcgacttactggacgatcactgacgttgaggctcgaaagcgtggggagcaaacagg

SEQ ID NO: 637 - DNA, 252 bp, Unknown
  Artificiall/Consensus sequence
tacggaggatgcgagcgttatccggatttattgggtgtaaagggtgcgcaggcggaagcgcaagtcagcggtaaaattgtgaggctcaacctcatcgagccgttgaaactgccggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacagg

SEQ ID NO: 638 - DNA, 253 bp, Unknown
  Artificiall/Consensus sequence
tacgtagggggcaagcgttatccggatttactgggtgtaaagggagcgtagacggagatgcaagccagatgtgaaaacccagggctcaaccctgggactgcatttggaactgtgttgctagagtgtcggagaggtaagtggaattcctagtgtagcggtgaaatgcgtagatattaggaggaacaccagtggcgaaggcggcttactggacgatgactgacgttgaggctcgaaagcgtggggagcaaacagg

SEQ ID NO: 639 - DNA, 253 bp, Unknown
  Artificiall/Consensus sequence
tacgtatggtgcaagcgttatccggatttactgggtgtaaagggagcgcaggcggcgcgttaagcctggtgtgaaagcccgcggcccaaccgcgggactgcattgggaactggcgcgctggagtgccggaggggtaggcggaattcctagtgtagcggtgaaatgcgtagatattaggaggaacaccagtggcgaaggcggcctactggacggtgactgacgctgaggctcgaaagcgtggggagcaaacagg

SEQ ID NO: 640 - DNA, 254 bp, Unknown
  Artificiall/Consensus sequence
tacgtagggggcaagcgttatccggaattactgggtgtaaagggagcgtaggcggcatggtaagccagatgtgaaagcccggggcttaactccgaggattgcatttggaactatcaagctagagtacaggagaggaaagcggaattcctagtgtagcggtgaaatgcgtagatatcgggaggaacaccagtggcgaaggcggcctactgggcaccaactgacgctgaggctcgaaagcgtggggagcaaacagg

SEQ ID NO: 641 - DNA, 253 bp, Unknown
  Artificiall/Consensus sequence
tacggagggtgcgagcgttaatcggaatcactgggcgtaaagcgcgcgtaggcggcttttcaagtcaggggtgaaatcccacggcccaaccgtggaactgcctttgaaactgtagagcttgagtgtcggagagggtggcggaattccaggtgtaggagtgaaatccgtagatatctggaggaacaccggtggcgaaggcggccacctggacgacaactgacgctgaggtgcgaaagcgtgggtagcaaacagg

SEQ ID NO: 642 - DNA, 253 bp, Unknown
  Artificiall/Consensus sequence
tacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgagatgcgaaagccagggtagcgaacggg

SEQ ID NO: 643 - DNA, 253 bp, Unknown
  Artificiall/Consensus sequence
tacggaggatccaagcgttatccggatttattgggtttaaagggtgcgtaggcggttttataagttagaggtgaaatctcggggctcaactccgaaattgcctctaatactgtaggactagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 644 - DNA, 253 bp, Unknown
  Artificiall/Consensus sequence
tacgtagggggcaagcgttatccggatttactgggtgtaaagggagcgcaggccgccgtgcaagcgtgccgtgaaaagcagcggcccaaccgctgccctgcggcgcgaactgcttggcttgagtgcgccggaagcgggcggaattcgtggtgtagcggtgaaatgcttagatatcacgaagaaccccgattgcgaaggcagcccgctgtggcgccactgacgctgaggctcgaaggtgcgggtatcgaacagg

SEQ ID NO: 645 - DNA, 253 bp, Unknown
  Artificiall/Consensus sequence
tacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaagaacaccggtggcgaaggcggcttactggactgttactgacgctgagtcacgaaagcgtggggagcaaacagg

SEQ ID NO: 646 - DNA, 253 bp, Unknown
  Artificiall/Consensus sequence
tacggagggtgcgagcgttaatcggaataactgggcgtaaagggcacgcagacggttacttaagcgggatgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 647 - DNA, 253 bp, Unknown
  Artificiall/Consensus sequence
  misc_feature (252)..(252): n is a, c, g, or t
tacgtatggtgcaagcgttatccggatttactgggtgtgaagggagcgtagacggatgggcaagtctgatgtgaaaacccggggctcaaccccgggactgcattggaaactgtcaatctggagtaccggagaggtaagcggaattcctagtgtagcggtgaaatgcgtagatattaggaggaacaccagtggcgaaggcggcttactggacggtaactgacgttgaggctcgaaagtgtgggtatcaaacang

SEQ ID NO: 648 - DNA, 253 bp, Unknown
  Artificiall/Consensus sequence
aacgtaggtcacaagcgttgtccggaattactgggtgtaaagggagcgtagacggcgacgcaagtctggagtgaaagcccggggcccaaccccgggactgctttggaaactgtgttgctggagtgcaggagaggtaagtggaattcctagtgtagcggtgaaatgcgtagatattaggaggaacaccagtggcgaaggcggcttactggacggtaactgacgttgaggctcgaaagcgtggggagcaaacagg

SEQ ID NO: 649 - DNA, 253 bp, Unknown
  Artificiall/Consensus sequence
tacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggactgacaatgacgctgaggctcgaaagtgtgagtagcaaacagg

SEQ ID NO: 650 - DNA, 253 bp, Unknown
  Artificiall/Consensus sequence
tacggaggatccgagcgttgtccggaattactgggtgtaaagggagcgtaggcgggacggcaagtcagatgtgaaaactatgggctcaacccatagactgcatttgaaactgttgttcttgagtgaggtagaggtaagcggaattcctggtgtagcggtgaaatgcgtagagatcaggaggaacatcggtggcgaaggcggcttgctgggctttaactgacgctgaggctcgaaagtgtggggagcaaacagg

SEQ ID NO: 651 - DNA, 253 bp, Unknown
  Artificiall/Consensus sequence
tacgtagggtgcgagcgttaatcggaattactgggcgtaaagcgtgcgcaggcggttttgcaagacagatgtgaaatccccgggctcaacctgggaactgcatttgtgactgcaaggctggagtgcggcagagggagatggaattccgcgtgtagcagtgaaatgcgtagatatgcggaggaacaccgatggcgaaggcaatctcctgggcctgcactgacgctcatgcacgaaagcgtggggagcaaacagg

SEQ ID NO: 652 - DNA, 253 bp, Unknown
  Artificiall/Consensus sequence
tacgaagggggcgagcgttgttcggaattactgggcgtaaagggagcgtagatgggttgttaagtcagttgtgaaagtttgcggctcaaccgtaaaattgcaattgatactggcagtcttgagtacagttgaggtaggcggaattcgtggtgtagcggtgaaatgcttagatatcacgaagaactccgattgcgaaggcagcttactaacctgtaactgacattgatgctcgaaagtgtgggtatcaaacagg

SEQ ID NO: 653 - DNA, 253 bp, Unknown
  Artificiall/Consensus sequence
tacggaggatgcgagcgttatccggatttattgggtttaaagggtgcgtaggtggtgatttaagtcagtggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaggccaggggagcgaaaggg

SEQ ID NO: 654 - DNA, 253 bp, Unknown
  Artificiall/Consensus sequence
tacggaggatccgagcgttatccggatttactgggtgtaaagggagcgtaggtggttcggcaagtctgatgtgaaagcccggggctcaaccccgggactgcattggaaactgtcggacttgagtgctggagaggtaagtggaattcctagtgtagcggtgaaatgcgtagatattaggaggaacaccagtggcgaaggcgacttactggacgataactgacgttgaggctcgaaagcgtggggagcaaacagg

SEQ ID NO: 655 - DNA, 253 bp, Unknown
  Artificiall/Consensus sequence
tacggagggtgcaagcgttaatcggaattactgggcgtaaatcgcacgcaggcggtttgttaagtcagatgtgaaatccccgggctcaacctgggaactgcatccgaaactggcagactagagccttgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 656 - DNA, 253 bp, Unknown
  Artificiall/Consensus sequence
tacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcttgctgggcttttactgacgctgaggctcgaaagcgtggggagcaaacagg

SEQ ID NO: 657 - DNA, 253 bp, Unknown
  Artificiall/Consensus sequence
tacggagggtgcaagcgttaatcggaattactggtcgtaaagcgcacgcaggcggtttgttaagtcagatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 658 - DNA, 253 bp, Unknown
  Artificiall/Consensus sequence
tacggaaggtccgggcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggcttactggactgtaactgacactgaggctcgaaagcgtggggagcaaacagg

SEQ ID NO: 659 - DNA, 253 bp, Unknown
  Artificiall/Consensus sequence
tacgtatggtgcaagcgttatccggatttactgggtgtaaagggtgcgtaggtggcaaggcaagtctgaagtgaaaatccggggctcaaccccggaactgctttggaaactgtttagctagagtacaggagaggtaagtggaattcctagtgtagcggtgaaatgcgtagatattaggaggaacaccagtggcgaaggcgactttctggacagtaactgacgttgaggcacgaaagtgtggggagcaaacagg

SEQ ID NO: 660 - DNA, 253 bp, Unknown
  Artificiall/Consensus sequence
tacggaggatccaagcgttatccgaatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccggtggcgaaggcggctttctggactgtaactgacgctgaggcacgaaagcgtggggagcaaacagg

SEQ ID NO: 661 - DNA, 252 bp, Unknown
  Artificiall/Consensus sequence
tacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctggactgtaactgacgctgatgctcgaaagtgtgggtatcaaacagg

SEQ ID NO: 662 - DNA, 253 bp, Unknown
  Artificiall/Consensus sequence
tacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgatgctcgaaagtgtgggtatcaaacagg

SEQ ID NO: 663 - DNA, 253 bp, Unknown
  Artificiall/Consensus sequence
tacggaggatccgagcgttatccggatttactgggtgtaaagggagcgtagacggaagagcaagtctgatgtgaaagcccggggcttaaccccgggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 664 - DNA, 252 bp, Unknown
  Artificiall/Consensus sequence
tacgtagggggctagcgttgtccggaatcactgggcgtaaagggttcgcaggcggaaatgcaagtcagatgtaaaaggcagtagcttaactactgtaagcatttgaaactgcatatcttgagaagagtagaggtaagtggaatttttagtgtagcggtgaaatgcgtagatattaaaaagaataccggtggcgaaggcgactttctggacttgaactgacgctgaggcacgaaagcgtggggagcaaacagg

SEQ ID NO: 665 - DNA, 253 bp, Unknown
  Artificiall/Consensus sequence
tacggaggatccgagcgttatccggatttactgggtgtaaagggagcgtagacggcgaagcaagtctgaagtgaaaaccaagggctcaaccctgggactgctttggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacagg

SEQ ID NO: 666 - DNA, 252 bp, Unknown
  Artificiall/Consensus sequence
tacgtaggtggcaagcgttgtccggaattattgggcgtaaagcgcgcgcaggcggctttctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgaaaactgacgctgagaagcgaaagcatggggagcgaacagg

SEQ ID NO: 667 - DNA, 252 bp, Unknown
  Artificiall/Consensus sequence
tacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaggtggaattcctagtgtagcggtgaaatgcgtagatattaggaagaacaccagtggcgaaggcgactttctggacgaaaactgacgctgagatgcgaaagccagggtagcgaacggg

SEQ ID NO: 668 - DNA, 252 bp, Unknown
  Artificiall/Consensus sequence
tacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggcttactggacgataactgacgctgaggctcgaaagcgtggggagcaaacagg

SEQ ID NO: 669 - DNA, 253 bp, Unknown
  Artificiall/Consensus sequence
tacgtaggtggcaagcgttatccggatttattgggcgtaaagcgagcgcaggcggttgcttaggtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacagg

SEQ ID NO: 670 - DNA, 252 bp, Unknown
  Artificiall/Consensus sequence
tacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacagg

SEQ ID NO: 671 - DNA, 253 bp, Unknown
  Artificiall/Consensus sequence
tacgtaggtggcaagcgttatccggatttactgggtgtaaagggagcgcaggcggtgcggcaagtctgatgtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacagg

SEQ ID NO: 672 - DNA, 253 bp, Unknown
  Artificiall/Consensus sequence
tacgtagggggcaagcgttatccggatttactgggtgtaaagggagcgcaggcggtgcggcaagtctgatgtgaaagcccggggctcagccccggtactgcattggaaactgtaggactagagtgtcggaggggtaagtggaattcctagtgtagcggtgaaatgcgtagatattaggaggaacaccagtggcgaaggcggcttactggacgactactgacgctgaggctcgaaagcgtggggagcaaacagg

SEQ ID NO: 673 - DNA, 253 bp, Unknown
  Artificiall/Consensus sequence
tacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagcttgctggactgtaactgacgctgaggcacgaaggccaggggagcgaaaggg

SEQ ID NO: 674 - DNA, 253 bp, Unknown
  Artificiall/Consensus sequence
tacggaggatccgagcgttatccggatttattgggtttaaagggagcgtaggcggttcggcaagtctgatgtgaaagcccggggcttaactccgggactgcattggaaactgtcggactagagtgtcggagaggtaagtggaattcctagtgtagcggtgaaatgcgtagatattaggaggaacaccagtggcgaaggcagcctcctgggacataactgacgctcaggcacgaaagtgtgggtagcaaacagg

SEQ ID NO: 675 - DNA, 252 bp, Unknown
  Artificiall/Consensus sequence
tacggaggatgcgagcgttatccggatttattgggtgtaaagggtgcgtaggcggttttttaagttagtggttaaacgtcggggcttcaccttgatttgccattaatactgtaagactcgagttcagacgaggtaggcggaataagttaagtagcggtgaaatgcttagatataacttagaactccgatagcgaaggcagcttaccagactgcgactgacgctgaagcacgagagcgtgggtagcgaacagg

SEQ ID NO: 676 - DNA, 254 bp, Unknown
  Artificiall/Consensus sequence
tacgtagggggcaagcgttatccggatttactgggtgtaaagggagcgtagacggcgacgcaagtctgaagtgaaatacccgggctcaacctgggaactgctttggaaactgggttacttgagtgtgtttgaggtaggcggaatgcgtggtgtagcggtgaaatgcttagatatcacgaagaactccgattgcgaaggcagctcactagactggttactgacactgaggctcgaaagtgtgggtatcaaacagg

SEQ ID NO: 677 - DNA, 253 bp, Unknown
  Artificiall/Consensus sequence
tacggaggatgcgagcgttatccggatttattgggtttaaagggtgcgtaggtggcttattaagtcagcggtgaaagtttgtggcttaaccataaaattgccgttgaaactggttagcttgagtatatttgaggtaggcggaatgcgtggtgtagcggtgaaatgcatagatatcacgcagaactccgattgcgaaggcagcttactaaggtataactgacactgaagcacgaaagcgtgggtatcaaacagg

SEQ ID NO: 678 - DNA, 253 bp, Unknown
  Artificiall/Consensus sequence
tacggaggattcaagcgttatccggatttattgggtttaaagggtgcgtaggcggaagcttaagtcagttgtgaaagtttgcggctcaaccgtaaaattgcagttgatactgcgtgtcttgagtacagtagaggtgggcggaattcgtggtgtagcggtgaaatgcttagatatcacgaagaactccgattgcgaaggcagctcactggagtgtaactgacgctgatgctcgaaagtgtgggtatcaaacagg

SEQ ID NO: 679 - DNA, 253 bp, Unknown
  Artificiall/Consensus sequence
tacgtaggtggcaagcgttgtccggatttattgggcgtaaagcgcgcgcaggcggtttcttaagtctgatgtgaaagcccacggcttaaccgtggagggtcattggaaactgggagacttgagtgcagaagaggaaagtggaattccaagtgtagcggtgaaatgcgtagagatttggaggaacaccagtggcgaaggcgactttctggtctgcaactgacgctgaggcgcgaaagcatggggagcaaacagg

SEQ ID NO: 680 - DNA, 253 bp, Unknown
  Artificiall/Consensus sequence
tacgtaggtggcgagcgttgtccggatttattgggtttaaagggtgcgtaggtggattgttaagtcagttgtgaaagtttgcggctcaaccgtaaaattgcagttgatactgggtgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacagg

SEQ ID NO: 681 - DNA, 253 bp, Unknown
  Artificiall/Consensus sequence
tacgtagggggcaagcgttatccggaattactgggtgtaaagggcgcgtaggcgggtctgcaagtcagatgtgaaatgccggggcttaactccggaactgcatctgaaactgtggatcttgagtactggagaggaaagtggaattcctagtgtagcggtgaaatgcgtagatattaggaggaacaccggtggcgaaggcggctttctggacagaaactgacgctgaggcgcgaaagcgtggggagcaaacagg

SEQ ID NO: 682 - DNA, 253 bp, Unknown
  Artificiall/Consensus sequence
tacgtagggggcaagcgttatccggatttactgggtgtaaagggagcgtaggcggcaaggtaagccagaagtgaaagcccgcggctcaactgcgggactgcttttggaactatctagctagattgcaggagaggtaagtggaattcctagtgtagcggtgaaatgcgtagatattaggaggaacaccagtggcgaaggcggcttactggactgtaaatgacgctgaggctcgaaagcgtggggagcaaacagg

SEQ ID NO: 683 - DNA, 253 bp, Unknown
  Artificiall/Consensus sequence
aacgtagggtgcaagcgttgtccggaattactgggtgtaaagggagcgcaggcgggaagacaagttggaagtgaaatctatgggctcaacccataaactgctttcaaaactgtttttcttgagtagtgcagaggtaggcggaattccttgtgtagcggtgaaatgcgtagatataaggaagaacaccagtggcgaaggcggataactggacggcaactgacggtgaggcgcgaaagcatgggtagcaaacagg

SEQ ID NO: 684 - DNA, 253 bp, Unknown
  Artificiall/Consensus sequence
tacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 685 - DNA, 253 bp, Unknown
  Artificiall/Consensus sequence
tacgtagggggcgagcgttgtccggaattactgggcgtaaagggtgcgtaggcggttagataagtcggatgtggaatacccgggcttaacccgggggtgtcatacgaaactgtgtaacttgagtgcagaagaggaaagcggaattcccagtgtagcggtgaaatgcgtagatattgggaggaacaccagtggcgaaggcggctttctgggctgtaactgacgctgaggcacgaaagcgtggggagcaaacagg

SEQ ID NO: 686 - DNA, 253 bp, Unknown
  Artificiall/Consensus sequence
tacgtagggggcaagcgttgtccggaatcattgggcgtaaagcgcgtgtaggcggccaggtaagtccgttctgaaagcccggggctcaaccccgggaggcggatggatactgcttggctcgagtccggaagaggcgagtggaattcccggtgtagcggtgaaatgcgcagatatcgggaggaacaccaatggcgaaggcagctcgctgggacggtactgacgctgagacgcgaaagcgtggggagcaaacagg

SEQ ID NO: 687 - DNA, 252 bp, Unknown
  Artificiall/Consensus sequence
tacgtagggggcaagcgttatccggaattattgggcgtaaagagtgcgtaggtggctttttaagcgcagggtttaaggcaatggcccaaccattgttcgccctgcgaactgaatagcttgagtgcaggagaggaaagcggaattcctagtgtagcggtgaaatgcgtagatattaggaggaacaccagtggcgaaggcggctttctggactgtaactgacactgaggcacgaaagcgtggggagcaaacagg

SEQ ID NO: 688 - DNA, 253 bp, Unknown
  Artificiall/Consensus sequence
aacgtagggtgcaagcgttatccggatttactgggtgtaaagggagcgcaggcggtacggcaagtctgatgtgaaagcccggggcttaaccccgggactgctttggaaactgttttgctagagtgctggagaggtaagtggaattcctagtgtagcggtgaaatgcgtagatattaggaggaacaccagtggcgaaggcggcttactggacgattactgacgctgaggctcgaaagcgtgggtatcaaacagg

SEQ ID NO: 689 - DNA, 253 bp, Unknown
  Artificiall/Consensus sequence
aacgtagggtgcaagcgttgtccggaattgctgggtgtaaagggagcgtaggcgggatcgcaagtcagatgtgaaaactatgggcttaacccataaactgcatttgaaactgtggttcttgagtgaagtagaggtgggcggaattcctagtgtagcggtgaaatgcgtagatattaggaagaacaccagtggcgaaggcggcttactggacagtaactgacgttgaggctcgaaagcgtggggagcaaacagg

SEQ ID NO: 690 - DNA, 253 bp, Unknown
  Artificiall/Consensus sequence
tacgtaggtggcgagcgttatccggatttactgggtgtaaagggtgtgtaggcgggacggcaagtcagatgtgaaaattatgggctcaactcataacctgcatttgaaactgctgttcttgagtatcggagaggtaagtggaattcccggtgtagcggtgaaatgcgtagatatcgggaggaacaccggtggcgaaggcgacttactggacgacaactgacgctgagacacgaaagtgtggggagcaaacagg

SEQ ID NO: 691 - DNA, 253 bp, Unknown
  Artificiall/Consensus sequence
aacgtaggtcacaagcgttgtccggatttactgggtgtaaagggagcgcaggcggtctggcaagtctgatgtgaaatcccggggctcaactccggaattgcattggaaactgtcaaactagagtgccggagaggtaagtggaattcctagtgtagcggtgaaatgcgtagatattaggaggaacaccagtggcgaaggcggcttactggactgtaactgacattgaggctcgaaagcgtggggagcaaacagg

SEQ ID NO: 692 - DNA, 253 bp, Unknown
  Artificiall/Consensus sequence
tacgtagggagcgagcgttatccggatttattgggtgtaaagggtgcgtagacgggaatacaagttagttgtgaaatacctcggcttaactgaggaactgcaactaaaactatatttcttgagtgcaggagaggtaagtggaattccatgtgtagcggtaaaatgcttagatatatggaggaacaccagtggcgaaggcggctttctggactgacactgacgctgaggcacgaaagcgtggggagcaaacagg

SEQ ID NO: 693 - DNA, 252 bp, Unknown
  Artificiall/Consensus sequence
tacgtagggagcaagcgttatccggatttattgggcgtaaagcgcgcgtaggcggcctgttaagcggaatctctaatctgagggctcaacccccagccggattccgaactggcaggctcgagtttggtagaggaagatggaattcccagtgtagcggtgaaatgcgcagatattgggaagaacaccgatggcgaaggcagtcttctgggccaacactgacgctgaggtgcgaaagcgtggggagcaaacagg

SEQ ID NO: 694 - DNA, 253 bp, Unknown
  Artificiall/Consensus sequence
tacgtaggtggcgagcgttgtccggaattactgggtgtaaagggcgtgtaggcgggcagataagtcagatgtgaaataccggggctcaaccccggggctgcatttgaaactgtatgtcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacagg

SEQ ID NO: 695 - DNA, 252 bp, Unknown
  Artificiall/Consensus sequence
tacgtagggggcgaacgttatccggaatgattgggcgtaaagggtacgtaggcggctttttaagtcaggtgtgaaaggcatgggctcaacccatgtaagcacttgaaactgggaagcttgagggaaggagaggaaagtggaattcctagtgtagcggtgaaatgcgtagatattaggaggaataccggtggcgaaggcgactttctggactttttctgacgctgaggtacgaaagcgtggggagcaaacagg

SEQ ID NO: 696 - DNA, 253 bp, Unknown
  Artificiall/Consensus sequence
tacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtggaatgcgtagagattaggaagaataccagtggcgaaggcgcctttctggactgtaactgacactgaggctcgaaagcgtggggagcaaacagg

SEQ ID NO: 697 - DNA, 253 bp, Unknown
  Artificiall/Consensus sequence
tacggagggtgcaagcgttaatcggaatcactgggcgtaaagcgcgcgtaggctgtatgtcaagtcaagggtgaaagcccacggctcaaccgtggaactgcccttgatactgcacgactcgaatccgggagagggtggcggaattccaggtgtaggagtgaaatccgtagatatctggaggaacatcagtggcgaaggcggccacctggaccggtattgacgctgaggtgcgaaagcgtggggagcaaacagg

SEQ ID NO: 698 - DNA, 253 bp, Unknown
  Artificiall/Consensus sequence
tacataggtggcaagcgttgtccggaatgactgggcgtaaagggagcgtaggcggtctgttaagttgggagtgaaatcccggggctcaaccccggaactgctttcaagactgacggacttgagtgtaagaggggtaagcggaattcctagtgtagcggtggaatgcgtagatattaggaggaacaccagtggcgaaggcggcttactggattataactgacgctgaggctcgaaagcgtgggtagcaaacagg

SEQ ID NO: 699 - DNA, 252 bp, Unknown
  Artificiall/Consensus sequence
tacgtaggtagcgagcgttgtccggaattactgggtgtaaagggagcgtaggcggggtcgcaagttgaatgttaaacctatgggcttaacccatagtcgcgttcaaaactgcggttcttgagtgaagtagaggcaggcggaattcctagtgtagcggtgaaatgcgtaaatattaggaggaacaccagtggcgaaggcggcctgctgggctttaactgacgctgaggctcgaaagcgtgggtagcaaacagg

SEQ ID NO: 700 - DNA, 253 bp, Unknown
  Artificiall/Consensus sequence
tacggaggatccaagcattatccggatttattgggtttaaagggagcgtaggtggacagttaagtcagttatgaaagtttgcggctcaaccgtaaaattgcagttgatactagctatcttgagtacagtagaggtgggcggaattcgtggtgtagcggtgaaatgcttagatatcacgaagaactccaattgcgaaggcagctcactagactgcaactgacactgatgctcgaaagtgtaggtatcaaacagg

SEQ ID NO: 701 - DNA, 252 bp, Unknown
  Artificiall/Consensus sequence
tacgtaggtggcaagcgttgtccggaattattgggtgtaaagggagcgtaggcgggtgagcaagttgaatgtgaaagcgaccggcttaactggtcgttgcgttcaaaactgcatatcttgagtgaagtagaggcaggcggaattcctagtgtagcggtgaaatgcgtagatattaggaggaacaccagtggcgaaggcggcctgctgggcttttactgacgctgaggctcgaaagcgtgggtggcaaacagg

SEQ ID NO: 702 - DNA, 253 bp, Unknown
  Artificiall/Consensus sequence
tacgtagggggcaagcgttatccggatttactgggtgtaaagggagcgcagacggctatgcaagtctgaagtgaaagcccggggctcaaccccgggattgctttggaaactgtgtagctagagtgtcggagaggtaagcagaattcccagtgtagcggtgaaatgcgtagatattgggaagaataccggtggcgaaggcggcttactggacgataactgacgttcaggctcgaaggcgtggggagcaaacagg

SEQ ID NO: 703 - DNA, 253 bp, Unknown
  Artificiall/Consensus sequence
tacggaggatccgagcgttatccggatttattgggtttaaagggagcgtaggtagattgttaagtcagttgtgaaagtttgcagctcaaccgtaaaattgcagttgatactggcagtcttaagtacagtagaggtgggcggaattcgtggtgtagcggtgaaatgcttagatatcacgaagaactccaattgcgaaggcagctcactggactgcaactgacactgatgctcgaaagtgtaggtatcaaacagg

SEQ ID NO: 704 - DNA, 253 bp, Unknown
  Artificiall/Consensus sequence
tacgtatggtgcaagcgttatccggatttactgggtgtaaagggagcgcagacggcactgcaagtctgaagtgaaagcccggggctcaaccccgggactgctttggaaactgtcgtactagagtgtcggaggggcaagcggaattcctagtgtagcggtgaaatgcgtagatattaggaggaacaccagtggcgaaggcggcttactggacgataactgacgctcaggcacgaaagcgtggggagcaaacagg

SEQ ID NO: 705 - DNA, 252 bp, Unknown
  Artificiall/Consensus sequence
tacgtaggtggcaagcgttgtccggaattactgggtgtaaagggagcgtaggcgggattgcaagtcaagtgtcaaatctatcggcttaaccgatagccgcgcttgaaactgcagttcttgagtgaagtagaggcaggcggaattcctagtgtagcggtgaaatgcgtagatattaggaggaacaccagtggcgaaggcggcctgctgggcttttactgacgctgaggctcgaaagcatggggagcaaatagg

SEQ ID NO: 706 - DNA, 253 bp, Unknown
  Artificiall/Consensus sequence
  misc_feature (3)..(3): n is a, c, g, or t
  misc_feature (252)..(252): n is a, c, g, or t
tangtaggtggcaagcgttgtccggatttactgggtgtaaagggcgtgtaggcgggtcggcaagtcagatgtgaaataccggggctcaactccggaactgcaactgaaactgtcgatcttgagtactggagaggaaagtggaattcctagtgtagcggtgaaatgcatagagattaggaggaacaccagtggcgaaggcggctttctggacagtaactgacgctgatgcgcgaaagccaggggagcaaacgng

SEQ ID NO: 707 - DNA, 252 bp, Unknown
  Artificiall/Consensus sequence
tacgtagggggctagcgttatccggaattactgggcgtaaagggtgcgtaggcggtctttcaagtcagaagtgaaaggctacggctcaaccgtagtaagcttttgaaactgtaagacttgagtgcaggagaggagagtggaattcctagtgtagcggtgaaatgcgtagatattaggaggaacaccagtagcgaaggcggctctctggactgtaactgacgctgaggcacgaaagtgtgggtagcaaacagg

SEQ ID NO: 708 - DNA, 252 bp, Unknown
  Artificiall/Consensus sequence
tacgtagggggcaagcgttatccggatttactgggtgtaaagggagcgtagacggcatggaagtctgaagtgaaaacccgaggctcaaccacgggattgctttggaaactgtcaagcttgggtgccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 709 - DNA, 253 bp, Unknown
  Artificiall/Consensus sequence
tacgtagggagcgagcgttgtccggaattactgggtgtaaagggtgcgtaggcgggagaacaagtcaggcgtgaaaggtatcggcttaaccgatagactgcgcttgaaactgattttcttgagtgaagtagaggcaggcggaattcccggtgtagcggtgaaatgcatagagatcgggaggaacaccagtggcgaaggcggcctgctgggctttaactgacgctgaagcacgaaagcatgggtagcaaacagg

SEQ ID NO: 710 - DNA, 253 bp, Unknown
  Artificiall/Consensus sequence
tacgtaggcggcaagcgttgtccggatttattgggtttaaagggcgcgtaggcggggatgcaagtcagatgtgaaatctatgggcttaacccataaactgcatttgaaactgtatctctcgagtgtcggagaggtagatggaattccttgtgtagcggtgaaatgcgtagatataaggaagaacaccagtggcgaaggcgatctactggacgataactgacgctgaggcgcgaaagcgtggggagcaaacagg

SEQ ID NO: 711 - DNA, 253 bp, Unknown
  Artificiall/Consensus sequence
tacggagggtgcaagcgttaatcggaataactgggcgtaaagggcatgtaggcggataagcaagtaaggtgtgaaatccctgggctcaacctaggaactgcactttaaactactaatctagagtattgcagagggagatggaatttcaggtgtagcggtgaaatgcgtagatatctgaaagaacaccagaggcgaaggcgatctcctgggcaaatactgacgctgaggtgcgaaagcgtggggagcaaacagg

SEQ ID NO: 712 - DNA, 253 bp, Unknown
  Artificiall/Consensus sequence
tacgtatggggcaagcgttatccggatttactgggtgtaaagggagcgtaggcggtatggcaagtcagcggtgaaatttccgggctcaacccggactgtgccgttgaaactggtgagctagagtgcacaagaggcaggcggaatgcgtggtgtagcggtgaaatgcatagatatcacgcagaaccccgattgcgaaggcagcctgctagggtgaaacagacgctgaggcacgaaagcgtgggtatcaaacagg

SEQ ID NO: 713 - DNA, 253 bp, Unknown
  Artificiall/Consensus sequence
tacgtagggggcaagcgttatccggaattactgggtgtaaagggtgcgtaggtggcatggcaagtctgatgtgaaacccccgggctcaacctggggcatgcattgggaactgtcaggctagagtgcaggagaggtaagcggaattcctagtgtagcggtgaaatgcgtagatattaggaggaacaccagtggcgaaggcggcttactggactgtaacagacactgaggcacgaaagcgtggggagcaaacagg

SEQ ID NO: 714 - DNA, 252 bp, Unknown
  Artificiall/Consensus sequence
tacgtaggtggcgagcgttgtccggaattactgggtgtaaagggagcgtaggcgggtgtgcaagttgaatgtgaaaggtatcagctcaactgatacatgcgatcaaaactgcagatcttgagtgaagtagaggcaggcggaattcctagtgtagcggtaaaatgcgtagatattaggaggaacaccagtggcgaaggcggcctgctgggctttaactgacgctgaggctcgaaagtgtggggagcaaacagg

SEQ ID NO: 715 - DNA, 253 bp, Unknown
  Artificiall/Consensus sequence
tacgtaggtggcaagcgttatccggatttattgggcgtaaagggaacgcaggcggtcttttaagtctgatgtgaaaaccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctcatgcacgaaagcgtggggatcgaacagg

SEQ ID NO: 716 - DNA, 253 bp, Unknown
  Artificiall/Consensus sequence
tatggagggtgcgagcgttaatcggaattactgggcgtaaagcgcacgtaggctgtcatgtaagtcaggggtgaaatcccacggctcaaccgtggaactgcccttgatactgcgtgacttgaatccgggagagggtggcggaattccaggtgtaggagtgaaatccgtagatatctggaggaacatcagtggcgaaggcggccacctggaccggtattgacgctgaagcgcgaaagcgtgggtagcaaacagg

SEQ ID NO: 717 - DNA, 252 bp, Unknown
  Artificiall/Consensus sequence
tacgtagggggcgagcgttatccggattcattgggcgtaaagcgcgcgtaggcggccgcgcaggcggggggtcaaatcccggggctcaaccccgggccgccccccgaaccgcgcggcttgggtccggcaggggagggtggaacgcccggtgtagcggtggaatgcgcagatatcgggcggaacaccggtggcgaaggcggccctctgggccggcaccgacgctgaggcgcgagagctaggggagcgaacagg

SEQ ID NO: 718 - DNA, 252 bp, Unknown
  Artificiall/Consensus sequence
tacgtaggtggcgagcgttatccggatttattgggcgtaaagcgtccgcagccggtttattaagtctagaataaaagcctggagcttaactccagttcgttctagaaactgatatacttgagtgtagtagaggcaaatggaatttctagtgtagcggtaaaatgcgtagatattagaaggaacaccagtggcgaaggcgatttgctaggctattactgacggtcagggacgaaagcgtggggagcaaatagg

SEQ ID NO: 719 - DNA, 253 bp, Unknown
  Artificiall/Consensus sequence
tacgtagggagcaagcgttatccggaatgactgggcgtaaagggtgcgtaggtggtttggcaagttggcggcgtaattccggggctcaactccggcgctaccgccaaaactgtcggactcgagtgcaggaggggtaagtggaatccctagtgtagcggtggaatgcgtagatattaggaagaacatcggtggcgaaggcgacttactggactgtaactgacactgaggcacgaaagcgtggggagcaaacagg

SEQ ID NO: 720 - DNA, 253 bp, Unknown
  Artificiall/Consensus sequence
tacgtatggagcaagcgttatccggatttactgggtgtaaagggtgcgtaggtggcaaggcaagtcagatgtgaaagcccggggctcaaccccggtactgcttttgaaactgtcagactggagtgcaggagaggtaagcggaattcctagtgtagcggtgaaatgcgtagatatacggaggaacaccagtggcgaaggcggcctgctggacattaactgacgctgaggcgcgagagcgtggggagcaaacagg

SEQ ID NO: 721 - DNA, 253 bp, Unknown
  Artificiall/Consensus sequence
tacgtagggggcaagcgttatccggatttactgggtgtaaagggagcgtagacggcaaggcaagtctgaagtgaaagcccggggctcaaccgcgggactgctttggaaactgtctggctggagtgccggagaggtaagcggaattcctagtgtagcggtgaaatgcgtagatattaggagaaacatcagtggcgaaggcggattgctggacgacaactgacggtgaggcgcgaaagcgtggggagcaaacagg

SEQ ID NO: 722 - DNA, 253 bp, Unknown
  Artificiall/Consensus sequence
tacgtagggagcgagcgttgtccggaattactgggtgtaaagggagcgtaggcgggatcgcaagtcagatgtgaaaactatgggcttaacccataaactgcatttgaaactgtacttcttgagtgatggagaggcaggcggaattccctgtgtagcggtgaaatgcttagatatcacgaagaactccgattgcgaaggcagcctgctaagctgcaactgacattgaggctcgaaagtgtgggtatcaaacagg

SEQ ID NO: 723 - DNA, 253 bp, Unknown
  Artificiall/Consensus sequence
tacgtaggtggcgagcgttatccggaattactgggtgtaaagggtgtgtaggcgggtctgcaagtcagatgtgaaataccggggcttaactccggggctgcatcagaaactgcaggtcttgagagtgggagaggtaagcggaattcccggtgtagcggtgaaatgcgtagatatcgggaggaacaccagtggcgaaggcggcttactggacagtaactgacgttgaggctcgaaagcgtggggagcaaacagg

SEQ ID NO: 724 - DNA, 253 bp, Unknown
  Artificiall/Consensus sequence
tacgtagggggcaagcgttatccggatttattgggtgtaaagggtgcgtagacgggagattaagttagttgtgaaagcccttggcttaactgaggaattgcaactaaaactggttttcttgagtgcaggagaggtaagtggaattcctagtgtagcggtgaaatgcgtagatattaggaggaacaccagtggcgaaggcggctttctggactgaaactgacgctgaggctcgaaagcgtggggagcaaacagg

SEQ ID NO: 725 - DNA, 254 bp, Unknown
  Artificiall/Consensus sequence
tacgtagggggcaagcgttatccggatttactgggtgtaaagggagcgtagacggcgatgcaagtctgaagtgaaaacccggggctcaaccccgcggagtgctttggaaactgtgttgctggagtgcaggagaggtgagtggaattcctagtgtagcggtgaaatgcgtagatattaggaggaacaccagcggcgaaggcggctcactggactgtaactgacgttgaggctcgaaagcgtggggagcaaacagg

SEQ ID NO: 726 - DNA, 253 bp, Unknown
  Artificiall/Consensus sequence
tacgtaggtggcaagcgttgtccggatttactgggtgtaaagggcgtgtaggcgggatggtaggtcagatgtgaaatacctaggcttaacttaggggctgcatttgaaaccaccgttcttgagtgctggagagggaagcggaattcctagtgtagcggtgaaatgcgtagatattaggaggaacaccagtggcgaaggcggctttctggacagtaactgacgctgaggcgcgaaagcgtggggagcaaacagg

SEQ ID NO: 727 - DNA, 253 bp, Unknown
  Artificiall/Consensus sequence
tacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattccaggtgtaggagtgaaatccgtagatatctggaggaacaccggtggcgaaggcggccacctggacgataactgacgttgaggctcgaaagcgtggggagcaaacagg

SEQ ID NO: 728 - DNA, 253 bp, Unknown
  Artificiall/Consensus sequence
tacgtaggtggcaagcgttgtccggatttactgggtgtagagggcgcgtaggcgggaatgcaagtcagatgtgaaatctccgggctcaacccggaagctgcatttgaaactgtatttcttgagtgatggagaggcaagcggaattcctagtgtagcggtgaaatgcgtagatattaggaggaacaccagtggcgaaggcggcttgctggacattaactgacgctgaggcacgaaggccaggggagcgaaaggg

SEQ ID NO: 729 - DNA, 253 bp, Unknown
  Artificiall/Consensus sequence
tacgtatggggcaagcgttatccggatttactgggtgtaaagggagcgtaggcggtacggcaagtcagaagtgaaagcctggggctcaaccccggaattgcttttgaaactgtcgaactagagtgtcggaggggtaagcggaattcctagtgtagcggtgaaatgcgtagatattaggaggaacaccggtggcgaaggcggcttactggacggtaactgacgttgaggctcgaaagcgtggggagcaaacagg

SEQ ID NO: 730 - DNA, 253 bp, Unknown
  Artificiall/Consensus sequence
tacgtaggtggcaagcgttgtccggaattactgggtgtaaagggagcgtaggcgggtgtgtaagttgaatgtgaaaactatgggctcaacccatagactgcgttcaaaactgcacatcttgagtgaggtagaggtaagcggaattcccggtgtagcggtggaatgcgtagatatcgggaggaacaccagtggcgaaggcggcttactgggccttaactgacgctgatgctcgaaagcgtgggtagcaaacagg

SEQ ID NO: 731 - DNA, 253 bp, Unknown
  Artificiall/Consensus sequence
tacgtagggagcgagcgttgtccggaattactgggtgtaaagggtgcgtaggcggtttggtaagtcagaagtgaaatccatgggcttaacccatgaactgcttttgaaactatcggacttgagtgaagtagaggtaggcggaattcccggtgtagcggtgaaatgcgtagagatcgggaggaacaccagtggcgaaggcggcttactggacggtaactgacgttgaggctcgaaagcgtggggagcaaacagg

SEQ ID NO: 732 - DNA, 253 bp, Unknown
  Artificiall/Consensus sequence
tacgtaggtggcaagcgttatccggatttactgggtgtaaagggcgtgtaggcgggttaacaagtcagatgtgaaataccggggcttaactccggggctgcatttgaaactgtcgttcttgagtgaagtagaggcaggcggaattcctagtgtagcggtgaaatgcgtagatattaggaggaacaccagtggcgaaggcggcctactgggctttaactgacgctgaggcacgaaagcatgggtagcaaacagg

SEQ ID NO: 733 - DNA, 252 bp, Unknown
  Artificiall/Consensus sequence
tacggaggatgcgagcgttatccggatttattgggtttaaagggtgcgtaggcgggacgccaagtcagcggtaaaatgtcggggctcaaccccgttgtgccgttgaaactggcgttcttgagtgggcgagaagtatgcggaatgcgtggtgtagcggtgaaatgcatagatatcacgcagaactccgattgcgaaggcagcataccggcgccctactgacgctgaagcacgaaagcgtgggtatcaaacagg

SEQ ID NO: 734 - DNA, 253 bp, Unknown
  Artificiall/Consensus sequence
tacgtaggtcacaagcgttgtccggaattactgggtgtaaagggagcgcaggcgggaagacaagttggaagtgaaaaccatgggctcaacccatgaattgctttcaaaactgtttttcctgagtagtgcagaggtagatggaattcccggtgtagcggtggaatgcgtagatatcgggaggaacaccagtggcgaaggcggcttactgggctttaactgacgctgaggctcgaaagcgtggggagcaaacagg

SEQ ID NO: 735 - DNA, 252 bp, Unknown
  Artificiall/Consensus sequence
tacgtaggtggcaagcgttgtccggatttactgggtgtaaagggagcgtaggcgggaagacaagttgaatgttaaaactatgggctcaactcatagttgcgttcaaaactgcctttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacagg

SEQ ID NO: 736 - DNA, 253 bp, Unknown
  Artificiall/Consensus sequence
tacggaggatccgagcgttatccggatttattgggtttaaagggagcgtaggtggacatgtaagtcagttgtgaaagtttgcggctcaaccgtaaaattgaagttgatactgtgtgtcttgagtgcagttgaggcaggcggaattcgtggtgtagcggtgaaatgcttagatatcacgaagaactccgattgcgaaggcagcctgctggactgtaactgacgctgatgcccgaaagtgtgggtatcaaacagg

SEQ ID NO: 737 - DNA, 253 bp, Unknown
  Artificiall/Consensus sequence
tacgtagggggcaagcgttatccggatttactgggtgtaaagggagcgtagacggtgtggcaagtctgatgtgaaaggcaggggctcaactcctggactgcattggaaactgccagacttgagtgccggaggggtaagcggaattcctagtgtagcggtgaaatgcgtagatattaggaggaacaccagtggcgaaggcgacttactggacgataactgacgttgaggctcgaaagcgtggggagcaaacagg

SEQ ID NO: 738 - DNA, 252 bp, Unknown
  Artificiall/Consensus sequence
tacgtaggtggcaagcgttgtccggaatgattgggcgtaaagggagcgcaggtgggaaggtaagtctagtttaaaagatcggggctcaaccccgttagggacgagaaactatcatccttgagtgcaggagaggaaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 739 - DNA, 252 bp, Unknown
  Artificiall/Consensus sequence
tacgtagggggcgagcgttatccggaattattgggcgtaaagagtacgtaggtggtcttttaagcgcagggtttaaggcaacggcttaaccgttgttcgccttgtgaactgaaggacttgagtacaggagaggaaagcggaattcctagtgtagcggtgaaatgcgtagatattaggaggaacaccagtggcgaaggcggcttactggacgattactgacgctgaggctcgaaagcgtggggagcaaacagg

SEQ ID NO: 740 - DNA, 253 bp, Unknown
  Artificiall/Consensus sequence
tacgtagggggcaagcgttatccggatttactgggtgtaaagggagcgtagacggcgatgcaagtctggggtgaaagcccagggctcaaccctgggactgctttggaaactgtatggctagagtgctggagaggtaagtggaattcctagtgtagcggtgaaatgcgtagatattaggaggagcaccagtggcgaaggcggcttactggacgataactgacgctgaggcgcgaaagcgtggggagcaaacagg

SEQ ID NO: 741 - DNA, 253 bp, Unknown
  Artificiall/Consensus sequence
tacgtatggtgcaagcgttatccggatttactgggtgtaaagggagcgtaggcggcatggcaagtctgatgtgaaaacccagggctcaaccctgggagtgcattggaaactgtcaagctggagtgtcggagaggtaagcggaattcctagtgtagcggtgaaatgcgtagatattaggaggaacaccagtggcgaaggcggcttactggacgatgactgacgctgaggctcgaaagcgtggggagcaaacagg

SEQ ID NO: 742 - DNA, 253 bp, Unknown
  Artificiall/Consensus sequence
tacgtagggggcgagcgttgtccggaattactgggtgtaaagggtgcgtaggcgggactgcaagtcaggcgtgaaatcccggggctcaaccccgggggtgcgtttgaaactgtggatcttgagtgaagtagaggcaggcggaattcctagtgtagcggtgaaatgcgtagatattaggaggaacaccagtggcgaaggcggcctgctgggctttaactgacgctgaagcacgaaagcatggggagcaaacagg

SEQ ID NO: 743 - DNA, 253 bp, Unknown
  Artificiall/Consensus sequence
tacgtagggagcgagcgttgtccggatttactgggtgtaaagggcgtgtaggcggagatgcaagtcaggagtgaaatctgggggctcaacccccaaactgcttttgaaactgcatcccttgagtatcggagaggcaggcggaattcctagtgtagcggtgaaatgcgtagatattaggaggaacaccagtggcgaaggcggcctgctgggctttaactgacgctgaggcacgaaagcgtgggtagcaaacagg

SEQ ID NO: 744 - DNA, 253 bp, Unknown
  Artificiall/Consensus sequence
tacgtaggtggcaagcgttatccggatttattgggcgtaaagcgaacgcaggcggttttttaagtctgatgtgaaagccttcggctcaaccgaagaaatgcattggaaactggataacttgagtgcagaagaggagagtggaacaccatgtgtagcggtgaaatgcgtagatatatggtagaacaccagtggcgaaagcggctctctggtctgtaactgacgctgaggttcgaaagcatgggtagcaaacagg

SEQ ID NO: 745 - DNA, 253 bp, Unknown
  Artificiall/Consensus sequence
tacgtaggtggcaagcgttatccggatttactgggtgtaaagggcgcgtaggcggggatgcaagtcagatgtgaaatccctgggcttaacccgggaactgcatttgaaactgtatcccttgagtatcggagaggcaggcggaattcctagtgtagcggtgaaatgcgtagatattaggaggaacaccagtggcgaaggcggtctactggacgataactgacgctgaggcgcgaaagcgtggggagcaaacagg

SEQ ID NO: 746 - DNA, 254 bp, Unknown
  Artificiall/Consensus sequence
tacgtagggagcaagcgttgtccggatttactgggtgtaaagggtgcgtaggcggctctgcaagtcaggcgtgaaaaccatgggcttaacccattggattgcgtttgaaactgtggagcttgagtgaagtagaggtaggcggaattcccggtgtagcggtgaaatgcgtagggatcgggaggaacaccagtggcgaaggcggcttactgggctttaactgacgctgaggcgcgaaagcgtggggagcaaacaag

SEQ ID NO: 747 - DNA, 253 bp, Unknown
  Artificiall/Consensus sequence
tacgtaggtggcgagcgttgtccggaatgactgggcgtaaagggagcgtaggttgttgtttaagttaaatgtgaaagcccgcggctcaactgcggaactgcatttaatactggacaactagagtgcaggaggggtaagcggaattcctagtgtagcggtggaatgcgtagatattaggaagaacaccagaggcgaaggcggcttactggactgtaactgacactgaggctcgaaagcgtggggagcaaacagg

SEQ ID NO: 748 - DNA, 253 bp, Unknown
  Artificiall/Consensus sequence
tacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 749 - DNA, 253 bp, Unknown
  Artificiall/Consensus sequence
tacgtagggagcaagcgttatccggatttactgggtgtaaagggtgcgtaggcggcctggcaagtcagaagtgaaatttaggggctcaacctctaaactgcttctgaaactaccgggctagagtgcaggagaggaaagcggaactccacgtgtagcggtgaaatgcgtagagatgtggaggaacaccagtagcgaaggcggctttctggactgtaactgacgctgaggcacgaaagcgtggggagcaaacagg

SEQ ID NO: 750 - DNA, 254 bp, Unknown
  Artificiall/Consensus sequence
tacgtagggggcgagcgttgtccggaatgactgggcgtaaagggtgtgtaggcggttcggtaagttagaagtgtaatacccagggcttaactcgggtgctgcttctaaaactgccggacttgagtgctggagaggatagtggaattcctagtgtagcggtggaatgcgtagatattaggaggaacatcagtggcgaaggcgactatctggacagtaactgacgctgaggctcgaaagtgtgggtagcaaacagg

SEQ ID NO: 751 - DNA, 252 bp, Unknown
  Artificiall/Consensus sequence
tacgtaggtggcaagcgttgtccggaattactgggtgtaaagggagcgtaggcgggagcataagttgattgtcaaatctatgggcttaacccatagccgcgatcaaaactgtgtttcttgagtgaagtagaggcaggcggaattcctagtgtagcggtgaaatgcgtaaatattaggaggaacaccagtggcgaaggcggcctgctgggctttaactgacgctgaggctcgaaagcgtgggtagcaaacagg

SEQ ID NO: 752 - DNA, 253 bp, Unknown
  Artificiall/Consensus sequence
tacgtaggtggcaagcgttgtccggatttactgggtgtaaagggcgtgcagccgggaatgcaagtcagatgtgaaatccacgggctcaactcgtgaactgcatttaaaactactcttcttgagtaccggagaggcaatcggaattcctagtgtagcggtgaaatgcgtagatattaggaggaacaccagtggcgaaggcggcctgctggacgacaactgacgctgaggctcgaaagtgtgggtagcaaacagg

SEQ ID NO: 753 - DNA, 253 bp, Unknown
  Artificiall/Consensus sequence
tacgtagggggcaagcgttatccggatttactgggtgtaaagggagcgtagacagcgacacaagtctgaagtgaaatacccgggctcaacctgggaactgctttggaaactgtttaactagagtgctggagaggtaagcggaattcctagtgtagcggtgaaatgcgtagatattaggaggaacaccagtggcgaaggcagctcactagactgcaactgacactgatgctcgaaagtgtgggtatcaaacagg

SEQ ID NO: 754 - DNA, 253 bp, Unknown
  Artificiall/Consensus sequence
tacgtagggagcgagcgttgtccggatttactgggtgtaaagggtgcgtaggcggcttttcaagtcaggcgtgaaatctgggggcttaacctccaaactgcgtttgaaactggagagcttgagtgaagtagaggcaggcggaattcccggtgtagcggtgaaatgcgtagagatcgggaggaacaccagtggcgaaggcggcctgctgggctttaactgacgctgaggcacgaaagcatgggtagcaaacagg

SEQ ID NO: 755 - DNA, 253 bp, Unknown
  Artificiall/Consensus sequence
tacgtaggtggcaagcgttgtccggatttactgggtgtaaagggcgtgtagccgggaaggcaagtcagatgtgaaatccacgggctcaactcgtgaactgcatttgaaactgtctggctcgagtgccggagaggtaagcggaattcctagtgtagcggtgaaatgcgtagatatggggaggaacaccagtggcgaaggcggcttactggactgtaactgacgttgaggctcgaaagcgtggggagcaaacagg

SEQ ID NO: 756 - DNA, 253 bp, Unknown
  Artificiall/Consensus sequence
tacgtagggagcaagcgttgtccggatttactgggtgtaaagggcgtgtagccgggagggcaagtcagatgtgaaatccacgggcttaactcgtgaactgcatttgaaactgttcttcttgagtatcggagaggcaatcggaattcctagtgtagcggtgaaatgcgtagagattaggaagaacaccagtggcgaaggcgactctctggactgtaactgacgctgaggctcgaaagcgtgggtagcaaacagg

SEQ ID NO: 757 - DNA, 253 bp, Unknown
  Artificiall/Consensus sequence
tacgtatgtcacaagcgttatccggaattactgggcgtaaagcgagcgcagacggttacttaagcaggatgtgaaatccctgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacagg

SEQ ID NO: 758 - DNA, 253 bp, Unknown
  Artificiall/Consensus sequence
tacgtagggggcaagcgttatccggatttactgggtgtaaagggagcgtagatggatgtttaagtcagttgtgaaagtttgcggctcaaccgtaaaattgcagttgaaactggtagtcttgagtacagtagaggtaggcggaattcgtggtgtagcggtgaaatgcttagatatcacgaagaactccgattgcgaaggcagcctgctggactgtaactgacgctgatgcacgaaagcgtggggatcaaacagg

SEQ ID NO: 759 - DNA, 253 bp, Unknown
  Artificiall/Consensus sequence
tacgtatggagcaagcgttatccggatttactgggtgtaaagggagcgtagacggctgtgcaagtctgaagtgaaagcccggggctcaaccccggtactgctttggaaactgtacggctagagtgctggagaggtaagtggaattcctagtgtagcggtgaaatgcgtagatattaggaggaacaccagtggcgaaggcggcttactggacggtaactgacgctgaggctcgaaagcgtggggagcaaacagg

SEQ ID NO: 760 - DNA, 253 bp, Unknown
  Artificiall/Consensus sequence
tacgtagggggcaagcgttatccggatttactgggtgtaaagggagcgtagacggcgcggcaagtctgaagtgaaaggcaggggcttaacccctgaactgctttggaaactgccatgctagagtgctggagaggtaagtggaattcctagtgtagcggtgaaatgcgtagatattaggaggaacaccagtggcgaaggcggcttactggacagtaactgacgttgaggctcgaaagcatggggagcgaacagg

SEQ ID NO: 761 - DNA, 253 bp, Unknown
  Artificiall/Consensus sequence
tacgtaggtggcgagcgttatccggaattactgggtgtaaagggtgtgtaggcggggaagcaagtcagatgtgaaaaccaaaggctcaacctttggcttgcatttgaaactgttcttcttgagagtgggagaggtaaacggaattcctagtgtagtagtgaaatgcgtagatattaggaggaacaccggtggcgaaggcggtttactggaccacaactgacgctgagacacgaaagcgtggggagcaaacagg

SEQ ID NO: 762 - DNA, 253 bp, Unknown
  Artificiall/Consensus sequence
tacggaggatgcgagcgttatccggatttattgggtttaaagggagcgtagatggatgtttaagtcagttgtgaaagtttgcggctcaaccgtaaaattgcaattgatactggcagtcttgagtacagttgaggtaggcggaattcgtggtgtagcggtgaaatgcttagagatcatacagaacaccgattgcgaaggcagcttaccaaactatgactgacgttgaggcacgaaagcgtgggtatcaaacagg

SEQ ID NO: 763 - DNA, 253 bp, Unknown
  Artificiall/Consensus sequence
tacgaagggggcaagcgttgtccggaattactgggtgtaaagggagcgcaggcggatttgcaagttggaagtgaaacccatgggctcaacccatggactgctttcaaaactgcagatcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacagg

SEQ ID NO: 764 - DNA, 253 bp, Unknown
  Artificiall/Consensus sequence
tacgtaggtggcaagcgttatccggaattactgggtgtaaagggtgtgtaggcgggactgcaagtcagatgtgaaaatcatgggctcaacccatgacctgcgtctgaaactgtggttcttgagagtgggagaggtagatggaattcccggtgtagcggtgaaatgcgtagatatcgggaggaacaccagtggcgaaggcgatctactggaccataactgacgctgaggctcgaaagcgtggggagcaaacagg

SEQ ID NO: 765 - DNA, 253 bp, Unknown
  Artificiall/Consensus sequence
tacgtgggtcgcaagcgttatccggaatcattgggtgtaaagggagcgcaggcggtacggcaagtctgatgtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacagg

SEQ ID NO: 766 - DNA, 253 bp, Unknown
  Artificiall/Consensus sequence
aacgtagggtgcaagcgttgtccggaattactgggtgtaaagggagcgtagacggcatggcaagtctgaagtgaaaacccagggctcaaccctgggactgctttggaaactgtcaagctagagtgccggaggggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 767 - DNA, 253 bp, Unknown
  Artificiall/Consensus sequence
tacgtagggggcaagcgttatccggatttactgggtgtaaagggagcgtagacggctgtgcaagtctggagtgaaagcccggggctcaaccgcgggactgcttttgaaactgttcgactagagtgcaggagaggtaagtggaattcctagtgtagcggtgaaatgcgtagatattaggaggaacaccggtggcgaaggcggcttactggactgtaactgacgttgaggctcgaaagcgtggggagcaaacagg

SEQ ID NO: 768 - DNA, 253 bp, Unknown
  Artificiall/Consensus sequence
tacagaggtctcaagcgttgttcggaatcactgggtgtaaagggagcgtagacggtttagcaagtctgaagtgaaagcccggggctcaaccccggtactgctttggaaactgttagacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 769 - DNA, 253 bp, Unknown
  Artificiall/Consensus sequence
tacgtagggtgcgagcgttaatcggaattactgggcgtaaagcgtgcgcaggcggttgggtaagacaggtgtgaaatccccgagcttaacttgggaactgcacttgtgactgctcaactagagtatgtcagagggaggtggaattccaagtgtagcagtgaaatgcgtagatatttggaagaacaccgatggcgaaggcagcctcctgggataatactgacgctgaggcacgaaggccaggggagcgaaaggg

SEQ ID NO: 770 - DNA, 253 bp, Unknown
  Artificiall/Consensus sequence
tacgtaggtggcaagcgttatccggatttactgggtgtaaagggcgcgtaggcggggatgcaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 771 - DNA, 253 bp, Unknown
  Artificiall/Consensus sequence
aacgtaggtcacaagcgttgtccggatttactgggtgtaaagggagcgtagacggcatcacaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgctgaggctcgaaagcatgggtagcaaacagg

SEQ ID NO: 772 - DNA, 253 bp, Unknown
  Artificiall/Consensus sequence
tacggaggatccgagcgttatccggatttactgggtgtaaagggcgtgtaggcgggactgcaagtcaggtgtgaaaaccacgggctcaacctgtggcctgcatttgaaactgtagttcttgagtgctggagaggcaatcggaattccgtgtgtagcggtgaaatgcgtagatatacggaggaacaccagtggcgaaggcggcttactggacgatgactgacgttgaggctcgaaagcgtggggagcaaacagg

SEQ ID NO: 773 - DNA, 253 bp, Unknown
  Artificiall/Consensus sequence
tacgtagggagcgagcgttgtccggaattactgggtgtaaagggagcgtaggcggccaggcaagtctgatgtgaaaggcaggggctcaacccctggactgcattggaaactgtcaggctggagtgccggagaggtaagcggaattcctagtgtagcggtgaaatgcgtagatattaggaggaacaccagtggcgaaggcggcttactggacggtaactgacgttgatgctcgaaagcgtggggagcaaacagg

SEQ ID NO: 774 - DNA, 253 bp, Unknown
  Artificiall/Consensus sequence
tacgtagggggcgagcgttgtccggaatgattgggcgtaaagggagcgtagacggcatggcaagccagatgtgaaaacccagggctcaaccttgggattgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 775 - DNA, 253 bp, Unknown
  Artificiall/Consensus sequence
tacgtagggggcaagcgttatccggatttactgggtgtaaagggagcgtagacggcactgcaagtctggagtgaaagcccggggctcaaccccgggactgctttggaaactgtggtgctggagtgcaggagaggtaagtggaattcctagtgtagcggtgaaatgcgtagatattaggaggaacaccagtggcgaaggcggcttactggactgtaactgacactgaggctcgaaagccagggtagcgaacggg

SEQ ID NO: 776 - DNA, 253 bp, Unknown
  Artificiall/Consensus sequence
tacgtatggtgcaagcgttatccggatttactgggtgtaaagggagcgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacagg

SEQ ID NO: 777 - DNA, 253 bp, Unknown
  Artificiall/Consensus sequence
tacgtagggggcaagcgttatccggatttactgggtgtaaagggagcgtagacggtttagcaagtctgaagtgaaagcccggggctcaaccccggtactgctttggaaactgttagacttgagtgctggagaggaaagtggaattcctagtgtagcggtgaaatgcgtagatattaggaggaacaccagtggcgaaggcgactttctggacagtaactgacgttgaggcacgaaagtgtggggagcaaacagg

SEQ ID NO: 778 - DNA, 253 bp, Unknown
  Artificiall/Consensus sequence
aacgtaggtcacaagcgttgtccggaattactgggcgtaaagggagcgtaggcggatgattaagtgggatgtgaaatacccgggcttaacttgggtgctgcattccaaactggttatctagagtgcaggagaggagaatggaattcctagtgtagcggtgaaatgcgtagagattaggaagaacaccagtggcgaaggcgactctctggactgtaactgacgctgaggctcgaaagcgtggggagcaaacagg

SEQ ID NO: 779 - DNA, 253 bp, Unknown
  Artificiall/Consensus sequence
tacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagcctgctggactgtaactgacgctgatgctcgaaagccaggggagcgaacggg

SEQ ID NO: 780 - DNA, 253 bp, Unknown
  Artificiall/Consensus sequence
tacggaggatccgagcgttatccggatttactgggtgtaaagggagcgtagacggagcagcaagtctgatgtgaaaacccggggcttaaccccgggactgcattggaaactgttgatctggagtgccggagaggtaagcggaattcctagtgtagcggtgaaatgcgtagatattaggaggaacaccagtggcgaaggcggcctactgggctgtaactgacgctgaggctcgaaagcgtgggtagcaaacagg

SEQ ID NO: 781 - DNA, 253 bp, Unknown
  Artificiall/Consensus sequence
tacggagggtgcgagcgttaatcggaataactgggcgtaaagggcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 782 - DNA, 253 bp, Unknown
  Artificiall/Consensus sequence
tacgtatggtgcaagcgttatccggatttactgggtgtaaagggagcgcaggcggaaggctaagtccgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacagg

SEQ ID NO: 783 - DNA, 253 bp, Unknown
  Artificiall/Consensus sequence
tacgtatggtgcaagcgttatccggatttactgggtgtaaagggcgtgtaggcgggagtgcaagtcagatgtgaaaactatgggctcaacccatagcctgcatttgaaactgtacttcttgagtgatggagaggcaggcggaattccctgtgtagcggtgaaatgcgtagatatagggaggaacaccagtggcgaaggcggcctgctggacgatgactgacgttgaggctcgaaagcgtggggagcaaacagg

SEQ ID NO: 784 - DNA, 253 bp, Unknown
  Artificiall/Consensus sequence
tacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgctgaggcacgaaggccaggggagcgaaaggg

SEQ ID NO: 785 - DNA, 253 bp, Unknown
  Artificiall/Consensus sequence
tacgtaggtggcaagcgttgtccggatttactgggcgtaaagggagcgtaggcggacttttaagtgagatgtgaaatacccgggctcaacttgggtgctgcatttcaaactggaagtctagagtgcaggagaggagagtggaattcctagtgtagcggtgaaatgcgtagatattaggaggaacaccagttgcgaaggcggctctctggactgtaactgacactgaggcacgaaagcgtggggagcaaacagg

SEQ ID NO: 786 - DNA, 253 bp, Unknown
  Artificiall/Consensus sequence
tacgtagggcgcgagcgttgtccggatttattgggtttaaagggagcgtaggcggacgcttaagtcagttgtgaaaatttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactggcactgatgctcgaaagtgtgggtatcaaacagg

SEQ ID NO: 787 - DNA, 253 bp, Unknown
  Artificiall/Consensus sequence
tacggaggatccaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccggtggcgaaggcggctttctggactgtaactgacgctgaggcacgaaagcgtggggagcaaacagg

SEQ ID NO: 788 - DNA, 253 bp, Unknown
  Artificiall/Consensus sequence
tacgtagggggcaagcgttatccggatttactgggtgtaaagggagcgtagacggcatggcaagccagatgtgaaaacccagggctcaaccttgggattgcatttggaactgccaggcttgagtgcaggagaggtaagtggaattcctagtgtagcggtggaatgcgtagatattaggaggaataccagaggcgaaggcgacttactggactgtaactgacgctgaggctcgaaagcgtggggagcaaacagg

SEQ ID NO: 789 - DNA, 252 bp, Unknown
  Artificiall/Consensus sequence
aacgtaggtcacaagcgttgtccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggccctctggactgtaactgacgctgaggcacgaaagcgtggggagcaaacagg

SEQ ID NO: 790 - DNA, 252 bp, Unknown
  Artificiall/Consensus sequence
aacgtaggtcacaagcgttgtccggaattactgggtgtaaagggagcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 791 - DNA, 253 bp, Unknown
  Artificiall/Consensus sequence
tacggaaggtccgggcgttatccggatttactgggtgtaaagggagcgtagacggtgtggcaagtctgatgtgaaaggcatgggctcaacccgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagtgtgggtagcaaacagg

SEQ ID NO: 792 - DNA, 253 bp, Unknown
  Artificiall/Consensus sequence
tacggaggatccgagcgttatccggaattactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaagaacaccagtggcgaaggcggcttgctggacagtaactgacgttcaggctcgaaagcgtggggagcaaacagg

SEQ ID NO: 793 - DNA, 252 bp, Unknown
  Artificiall/Consensus sequence
tacgtaggtggcaagcgttgtccggaattattgggcgtaaagcgcgcgcaggcggccgtgcaagtccatcttaaaagcgtggggcttaaccccatgaggggatggaaactgcagggctggagtgtcggaggggaaagtggaattcctagtgtagcggtgaaatgcgtagagattaggaagaacaccggtggcgaaggcggcttactggactgatactgacgctgaggcacgaaagcgtggggagcaaacagg

SEQ ID NO: 794 - DNA, 253 bp, Unknown
  Artificiall/Consensus sequence
tacgtaggtggcaagcgttgtccggatttactgggcgtaaagggagcgtaggcggatctttaagtgggatgtgaaatactcgggctcaacctgagggctgcattccaaactggggatctagagtacaggaggggagagtggaattcctagtgtagcggtgaaatgcgtagagattaggaagaacaccagtggcgaaggcgactctctggactgtaactgacgctgaggctcgaaagcgtggggagcaaacagg

SEQ ID NO: 795 - DNA, 252 bp, Unknown
  Artificiall/Consensus sequence
tacgtaggtcccgagcgttgtccggatttattgggcgtaaagagagtgcaggcggttttctaagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacagg

SEQ ID NO: 796 - DNA, 253 bp, Unknown
  Artificiall/Consensus sequence
tacgtaggtggcaagcgttaatcggaataactgggcgtaaagggcacgcaggcggtgacttaagtgagatgtgaaagccccgggcttaacctgggaattgcatttcatactgggagtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 797 - DNA, 253 bp, Unknown
  Artificiall/Consensus sequence
tacgtagggggcaagcgttatccggatttactgggtgtaaagggagcgtagacggtttagcaagtctgaagtgaaagcccggggctcaaccccggtactgctttggaaactgtaggactagagtgcaggagaggtaagtggaattcctagtgtagcggtgaaatgcgtagatattaggaggaacaccagtggcgaaggcggcttactggactgtaactgacgttgaggctcgaaagccaggggagcgaacggg

SEQ ID NO: 798 - DNA, 252 bp, Unknown
  Artificiall/Consensus sequence
tacggaggatccgagcgttatccggaattattgggcgtaaagagtgcgtaggtggcaccttaagcgcagggtttaaggcaatggctcaaccattgttcgccctgcgaactggggggcttgagtgcaggagaggaaagcggaattcctagtgtagcggtgaaatgcgtagatattaggaggaacaccagtggcgaaggcggctttctggactgtaactgacactgaggcacgaaagcgtggggagcaaacagg

SEQ ID NO: 799 - DNA, 253 bp, Unknown
  Artificiall/Consensus sequence
tacgtagggagcgagcgttgtccggatttactgggtgtaaagggtgcgtaggcgggatggcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacagg

SEQ ID NO: 800 - DNA, 253 bp, Unknown
  Artificiall/Consensus sequence
tacgtagggagcgagcgttgtccggaattactgggtgtaaagggagcgtaggcaggtgcttaagtcagttgtgaaagtttgcggctcaaccgtaaaattgcagttgatactgggcgccttgagtgcagcataggtaggcggaattcgtggtgtagcggtgaaatgcttagatatcacgaagaactcctattgcgaaggcagcttactggactgtaactgacgctgatgctcgaaagtgtgggtatcaaacagg

SEQ ID NO: 801 - DNA, 253 bp, Unknown
  Artificiall/Consensus sequence
tacggaggatgcgagcgttatccggatttattgggtttaaagggtgcgtaggcggcacgccaagtcagcggtgaaagtttgtggctcaaccataaaattgccgttgaaactggttgacttgagtatatttgaggtaggcggaatgcgtggtgtagcggtgaaatgcatagatatcacgcagaactccgattgcgaaggcagcttactaaactataactgacactgaagcacgaaagcgtggggatcaaacagg

SEQ ID NO: 802 - DNA, 253 bp, Unknown
  Artificiall/Consensus sequence
tacggaggatgcgagcgttatccggatttattgggtttaaagggtgcgtaggcggcacgccaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacagg

SEQ ID NO: 803 - DNA, 253 bp, Unknown
  Artificiall/Consensus sequence
tacggaggattcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcctgctgggccttaactgacgctgaggctcgaaagcgtggggagcaaacagg

SEQ ID NO: 804 - DNA, 252 bp, Unknown
  Artificiall/Consensus sequence
tacggaaggtccaggcgttgtccggaattattgggcgtaaagcgcgcgcaggcggattggtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 805 - DNA, 253 bp, Unknown
  Artificiall/Consensus sequence
tacggaggatccgagcgttgtccggatttactgggtgtaaagggcgtgcagccgggtctgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacagg

SEQ ID NO: 806 - DNA, 252 bp, Unknown
  Artificiall/Consensus sequence
tacgtaggtggcaagcgttgtccggaattattgggcgtaaagcgcgcgcaggcggatcagtcagtctgtcttaaaagttcggggcttaaccccgtgaggggatggaaactgctgatctagagtatcggagaggaaagtggaattccatgtgtagcggtgaaatgcgtagatattaggaagaacaccagtggagaaggcgactttctggacgaaaactgacgctgaggcgcgaaagccaggggagcgaacggg

SEQ ID NO: 807 - DNA, 253 bp, Unknown
  Artificiall/Consensus sequence
  misc_feature (252)..(252): n is a, c, g, or t
tacgtatggtgcaagcgttatccggatttactgggtgtaaagggagcgtagacggagtggcaagtctgatgtgaaaacccggggctcaaccccggtactgcatttgaaactgtctagctagagtgcaggagaggtaagcggaattcctagtgtagcggtgaaatgcgtagatattaggaggaacaccagtggcgaaggcggcttactggacggtaactgacgttgaggctcgaaagcgtggggagcaaacang

SEQ ID NO: 808 - DNA, 253 bp, Unknown
  Artificiall/Consensus sequence
  misc_feature (3)..(3): n is a, c, g, or t
  misc_feature (252)..(252): n is a, c, g, or t
tanggagggtgcaggcgttaatcggaattactgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacang

SEQ ID NO: 809 - DNA, 253 bp, Unknown
  Artificiall/Consensus sequence
tacgtagggggcaagcgttatccggatttactgggtgtaaagggagcgtaggtggctaggtaagtcaggtgtgaaagcccagggctcaaccctgggactgcatttgaaactggcatactagagtgcaggagaggtaagtggaattcctagtgtagcggtgaaatgcgtagatattaggaggaacaccagtggcgaaggcggcttactggacggtaactgacgttgaggctcgaaagcgtggggagcaaacagg

SEQ ID NO: 810 - DNA, 253 bp, Unknown
  Artificiall/Consensus sequence
tacggaaggtccgggcgttatccggatttattgggtttaaagggagcgtagacggcatcacaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 811 - DNA, 252 bp, Unknown
  Artificiall/Consensus sequence
tacggaggatccgagcgttatccggatttattgggtttaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaatagg

SEQ ID NO: 812 - DNA, 252 bp, Unknown
  Artificiall/Consensus sequence
tacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacggcaactgacactgaggctcgaaagccaggggagcgaacggg

SEQ ID NO: 813 - DNA, 253 bp, Unknown
  Artificiall/Consensus sequence
tacgtatggtgcaagcgttatccggatttactgggtgtaaagggagcgcaggcggtgcggcaagtctgatgtgaaagcccgggactcaaccccggtactgcattggaaactgtcgtactagagtgtcggaggggtaagcggaattcctagtgtagcggtgaaatgcgtagatattaggaggaacaccagtggcgaaggcggcttactggacagatactgacgctaaagcgcgaaagcgtgggtagcaaacagg

SEQ ID NO: 814 - DNA, 253 bp, Unknown
  Artificiall/Consensus sequence
tacggaggatccgagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgatggcggcctgctggacgacaactgacgctgaggcgcgaaagcgtggggagcaaacagg

SEQ ID NO: 815 - DNA, 253 bp, Unknown
  Artificiall/Consensus sequence
tacgtagggggcaagcgttatccggatttactgggtgttaagggagcgtagacggagcagcaagtctgatgtgaaaggcaggggctcaacccctggactgcattggaaactgttgatcttgagtaccggagaggtaagcggaattcctagtgtagcggtgaaacgcgtagatattaggaggaacaccagtggcgaaggcggcttactggacggtaactgacgctgaggtgcgaaagcgtgggtagcaaacagg

SEQ ID NO: 816 - DNA, 252 bp, Unknown
  Artificiall/Consensus sequence
tacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaggcggctcactggactgtaactgacactgaggctcgaaagcgtggggagcaaacagg

SEQ ID NO: 817 - DNA, 253 bp, Unknown
  Artificiall/Consensus sequence
tacggaggattcaagcgttatccggatttactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtaactgacgttgaggctcgaaagcgtggggagcaaacagg

SEQ ID NO: 818 - DNA, 252 bp, Unknown
  Artificiall/Consensus sequence
tacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccacgtgtagcggtgaaatgcgtagatatatggaggaacaccggtggcgaaagcggctctctggtctgtaactgacgctcaggtgcgaaagcgtggggagcaaacagg

SEQ ID NO: 819 - DNA, 253 bp, Unknown
  Artificiall/Consensus sequence
tacgtaggtcccaagcgttgtccggatttactgggtgtaaagggcgtgtagccgggaaggcaagtcagatgtgaaatccacgggcttaactcgtgaactgcatttgaaactacttttcttgagtatcggagaggcaatcggaattcctagtgtagcggtgaaatgcgtagatattaggaggaacaccagtggcgaaggcggattgctggacgataactgacgctgaggctcgaaagcgtggggagcaaacagg

SEQ ID NO: 820 - DNA, 252 bp, Unknown
  Artificiall/Consensus sequence
tacgtagggagcaagcgttgtccggaattactgggtgtaaagggagcgtaggcgggatagtaagttgattgttaaaactatcggctcaactgatagatgcgatcaaaactgcaattcttgagtgaagtagaggcaggcggaattcctagtgtagcggtgaaatgcgtagatattaggaggaacaccagtggcgaaggcggcctgctgggctttaactgacgctgaggctcgaaagtgtgggtagcaaacagg

SEQ ID NO: 821 - DNA, 253 bp, Unknown
  Artificiall/Consensus sequence
tacgtatggagcaagcgttatccggatttactgggtgtaaagggtgcgtagacgggaatacaagttagttgtgaaatacctcggcttaactgaggaactgcaactaaaactatatttcttgagtgcaggagaggtaagtggaattcctagtgtagcggtgaaatgcgtagatattaggaggaacaccagtggcgaaggcgacttactggactgaaactgacgttgaggcacgaaagtgcgggtatcaaacagg

SEQ ID NO: 822 - DNA, 253 bp, Unknown
  Artificiall/Consensus sequence
tacgtatggagcaagcgttatccggatttactgggtgtaaagggagcgcaggcggctttgcaagtctgatgtgaaaggccggggctcaaccccgggactgcattggaaactgtaaagctagagtgccggagaggtaagcggaattcctagtgtagcggtgaaatgcgtagatattaggaggaacaccagtggcgaaggcggcttactggacggcaactgacgctgaggctcgaaagcgtggggagcaaacagg

SEQ ID NO: 823 - DNA, 252 bp, Unknown
  Artificiall/Consensus sequence
tacgtagggggcgagcgttgtccggaattactgggcgtaaagagtgcgtaggtggctttttaagcgcagggtttaaggcaatggcccaaccattgttcgccctgcgaactggaaggcttgagtgcaggagaggaaagcggaatttctagtgtagcggtgaaatgcgtagatattaggaggaacaccagtggcgaaggcggctttctggactgtaactgacactgaggcacgaaagtgtggggagcaaacagg

SEQ ID NO: 824 - DNA, 253 bp, Unknown
  Artificiall/Consensus sequence
tacgtatggtgcaagcgttatccggatttactgggtgtaaagggagcgcaggcggggaagcaagtcagacgtgaaaactatgggctcaacccataacgtgcgtttgaaactgtttttcttgagtgaagtagaggtaggcggaattccgagtgtagcggtgaaatgcgtagatattcggaggaacaccagtggcgaaggcggcctactgggcttttactgacgctgaggctcgaaagtgtggggagcaaacagg

SEQ ID NO: 825 - DNA, 253 bp, Unknown
  Artificiall/Consensus sequence
tacgtagggggcaagcgttatccggaatgactgggcgtaaagggtgcgtaggtggtttggcaagttggtagcgtaatcccggggcttaacctcggtgctactaccaaaactgctgggcttgagtgcaggaggggtgaatggaattcctagtgtagcggtggaatgcgtagatattaggaagaacaccagcggcgaaggcgattcactggactgtaactgacactgaggcacgaaagcgtggggagcaaacagg

SEQ ID NO: 826 - DNA, 253 bp, Unknown
  Artificiall/Consensus sequence
aacgtaggtcacaagcgttgtccggaattactgggtgtaaagggagcgcaggcgggatggtaagtcagatgtgaaaactatgggctcaacccatagactgcatttgaaactgctgttcttgagtgaagtagaggtaagcggaattcctagtgtagcggtgaaatgcgtagatattaggaggaacatcggtggcgaaggcggcttactgggcttttactgacgttgaggcacgaaagtgtggggagcaaacagg

SEQ ID NO: 827 - DNA, 253 bp, Unknown
  Artificiall/Consensus sequence
tacgtagggagcgagcgttatccggatttattgggtgtaaagggtgcgtaggcggacgcttaagtcagttgtgaaagtttgcggctcaaccgtaaaattgcagttgatactggatgtcttgagttcagttgaggcaggcggaattcgtggtgtagcggtgaaatgcttagatatcacgaagaactccgattgcgaaggcagcctgctaatctgcgactgacattgaggctcgaaagtgtgggtatcaaacagg

SEQ ID NO: 828 - DNA, 253 bp, Unknown
  Artificiall/Consensus sequence
tacgtaggtggcgagcgttatccggatttactgggcgtaaaggatgcgtaggtggatttttaagtgagatgtgaaatacccgggctcaacctgggtgctgcattccaaactggaaatctagagtgcaggaggggaaagtggaattcctagtgtagcggtgaaatgcgtagagattaggaagaacaccagtggcgaaggcgactttctggactgtaactgacgctgaggctcgaaagcgtggggagcaaacagg

SEQ ID NO: 829 - DNA, 253 bp, Unknown
  Artificiall/Consensus sequence
tacggaggatccaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctttctggactgttactgacactgaggcacgaaagtgtggggagcaaacagg

SEQ ID NO: 830 - DNA, 253 bp, Unknown
  Artificiall/Consensus sequence
tacgtaggtggcgagcgttgtccggaatcattgggcgtaaagggagcgcaggcggaccggcaagttggaagtgaaaactatgggctcaacccataaattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacagt

SEQ ID NO: 831 - DNA, 253 bp, Unknown
  Artificiall/Consensus sequence
tacggaggatccaagcgttatccggatttactgggtgtaaagggagcgtagacggcatagtaagtctgatgtgaaaggcgggggctcaacccctggactgcattggaaactattaagctggagtgtcggagaggtaagtggaattcctagtgtagcggtgaaatgcgtagatattaggaggaacaccagtggcgaaggcggcttactggacgatcactgacgttgaggctcgaaagcgtggggagcaaacagg

SEQ ID NO: 832 - DNA, 253 bp, Unknown
  Artificiall/Consensus sequence
tacgtaggtggcgagcgttatccggatttattgggtttaaagggagcgtagatggatgtttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctaagctgcaactgacattgaggcgcgaaagtgtgggtatcaaacagg

SEQ ID NO: 833 - DNA, 253 bp, Unknown
  Artificiall/Consensus sequence
tacggaggatccaagcgttatccggatttattgggtttaaagggtgcgtaggcggcagattaagttagaggtgaaataccggtgcttaacaccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 834 - DNA, 253 bp, Unknown
  Artificiall/Consensus sequence
tacgtagggggcgagcgttgtccggaattactgggcgtaaagggtgcgtaggcggttgattaagttggatgtgaaatccccgggcttaacctggggggtgcattcaaaactggtcaactagagtgcaggagagggaagcggaattcctagtgtagcggtgaaatgcgtagatattaggaggaacaccagtggcgaaggcggctttctggactgtaactgacgctgaggcacgaaagcgtgggtagcaaacagg

SEQ ID NO: 835 - DNA, 253 bp, Unknown
  Artificiall/Consensus sequence
tacgtaggtggcgagcgttgtccggatttactgggtgtaaagggcgagtaggcgggattacaagtctgatgtgaaataccgaggcttaacttcggggctgcattggaaactgtagttcttgagtgatggagaggcaggcggaattcctagtgtagcggtgaaatgcgtagatattaggaggaacaccagtggcgaaggcggcctgctggacattaactgacgctgaggcgcgaaagcgtggggagcaaacagg

SEQ ID NO: 836 - DNA, 253 bp, Unknown
  Artificiall/Consensus sequence
tacgtatggtgcaagcgttatccggatttactgggtgtaaagggcgtgtaggcgggctggcaagtcagatgtgaaaaccatgggctcaacccatggcctgcatttgaaactgttggtcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacagg

SEQ ID NO: 837 - DNA, 253 bp, Unknown
  Artificiall/Consensus sequence
tacgtaggtggcaagcgttatccggatttattgggtgtaaagggcgtgtaggcgggactgcaagtcaggtgtgaaaactatgggctcaacccatagcctgcacttgaaactgtagttcttgagtgctggagaggcaatcggaattccgtgtgtagcggtgaaatgcgtagatatacggaggaacaccagtggcgaaggcggattactggacgacaactgacggtgaggcgcgaaagcgtggggagcaaacagg

SEQ ID NO: 838 - DNA, 253 bp, Unknown
  Artificiall/Consensus sequence
aacgtagggagcgagcgttgtccggatttactgggtgtaaagggcgtgtaggcggatttgcaagtcagatgtgaaatacccgggctcaactcgggggctgcatttgaaactgtaggtcttgagtgatggagaggcaggcggaattcccggtgtagcggtgaaatgcgtagatatcgggaggaacaccagtggcgaaggcggcctgctggacattaactgacgctgaggcgcgaaagcgtggggagcaaacagg

SEQ ID NO: 839 - DNA, 252 bp, Unknown
  Artificiall/Consensus sequence
tacgtaggtggcgagcgttgtccggaattactgggtgtaaagggagcgtaggcgggaagacaagttggacgttaaatttatcggcttaaccggtaaccgcgttcaaaactgtttttcttgagtgaagtagaggttggcggaattcctagtgtagcggtgaaatgcgtagatattaggaggaacaccagtggcgaaggcggccaactgggctttaactgacgctgaggctcgaaagcgtggggagcaaacagg

SEQ ID NO: 840 - DNA, 252 bp, Unknown
  Artificiall/Consensus sequence
tacgtagggggcgagcgttgtccggatttactgggcgtaaagggtgagtaggtggtaacttaagtcaggtgtgaaatggcggggctcaaccgcgtcatgcacttgaaactgagatacttgagtgcaggagaggtaagcggaattcctagtgtagcggtgaaatgcgtagatattaggaggaacaccagtggcgaaggcggcttactggactgtaactgacactgagtcacgaaagcgtggggagcgaacagg

SEQ ID NO: 841 - DNA, 253 bp, Unknown
  Artificiall/Consensus sequence
tacgtagggggcgagcgttgtccggagtgactgggcgtaaagagcacgtaggcggtttgatatgtctgatgtgaaacacctgggcttaactcaggttctgcatcggaaactgtcagacttgagtacaggagaggaaagcggaattcccagtgtagcggtgaaatgcgtagatattgggaggaacaccagtggcgaaggcggctttctggactggaactgacgctgaggtgcgagagctaggggagcgaacagg

SEQ ID NO: 842 - DNA, 253 bp, Unknown
  Artificiall/Consensus sequence
tacggaggatccaagcgttatccggatttattgggtttaaagggtgcgtaggcggtgcggcaagtcaggcgtgaaataccggggcttaactccggggctgcgcttgaaactgtcgttcttgggtgaagtagaggcaggcggaattcctagtgtagcggtgaaatgcgtagatattaggaggaacaccagtggcgaaggcggcctgctgggctttaactgacgctgaggcacgaaagcgtggggagcaaacagg

SEQ ID NO: 843 - DNA, 253 bp, Unknown
  Artificiall/Consensus sequence
tatgtagggagcgagcgttgtccggaattactgggtgtaaagggtgcgtaggcggatacgcaagtcagtagtgaaatgcatgggcttaacccatgacgtgctattgaaactgtgtatcttgagtgaagtagaggcaggcggaattcccggtgtagcggtgaaatgcgtagagatcgggaggaacaccagtggcgaaggcggcctgctgggctttaactgacgctgaggcacgaaagtgtgggtagcaaacagg

SEQ ID NO: 844 - DNA, 253 bp, Unknown
  Artificiall/Consensus sequence
tacgtatggagcaagcgttatccggatttactgggtgtaaagggagtgtaggcggccaggcaagtcggaagtgaaagcccggggctcaaccccgggactgctttggaagctgttctgctagagtgctggagaggtaagtggaattcctagtgtagcggtgaaatgcgtagatattagggggaacaccagtggcgaaggcggcttactggacagtaactgacgttgaggctcgaaagcgtggggagcaaacagg

SEQ ID NO: 845 - DNA, 253 bp, Unknown
  Artificiall/Consensus sequence
tacgtaggtggcaagcgttgtccggatttactgggtgtaaagggcgtgtaggcgggtctgcaagtcagatgtgaaaactatgggcttaacccatagcctgcatttgaaactgtaggtcttgagtactggagaggcaggcggaattcctcgtgtagcggtgaaatgcgtagatatgaggaggaacaccagtggcgaaggcggcttactggacggtaactgacgttgaggctcgaaagcgtggggagcaaacagg

SEQ ID NO: 846 - DNA, 339 bp, Unknown
  Artificiall/Consensus sequence
tacggaggatccgagcgttatccggatttattgggtttaaagggagcgtaggcggatgcttaagtcagttgtgaaagtttgcggctcaaccgtaaaattgcagttgaaactgggtgtcttgagtgcagtagaggtaggcggaattccaagtcagcggtgaaatctccatgctcaacatggacactgccgttgaaactggcgttctagagtgtaaatgaggtaggcggaatgcgtggtgtagcggtgaaatgcatagatatcacgcagaactccgattgcgaaggcagcctgctgggatacaactgacgctgatgctcgaaagtgtgggtatcaaacagg

SEQ ID NO: 847 - DNA, 253 bp, Unknown
  Artificiall/Consensus sequence
tacgtagggagcgagcgttgtccggaattactgggtgtaaagggtgcgtaggcgggaaagcaagtccgacgtgaaatgccggggctcaactccggagctgcgttagaaactgtttttcttgagtgaagtagaggcaggcggaattcctagtgtagcggtgaaatgcgtagatattaggaggaacaccagtggcgaaggcggcctgctgggctttaactgacgctgaggcacgaaagcatggggagcaaacagg

SEQ ID NO: 848 - DNA, 252 bp, Unknown
  Artificiall/Consensus sequence
tgcgtaggtggcgagcgttgtccggaattactgggtgtaaagggagcgtaggcgggaaggcaagtcaagtgtgaaagctatcggctcaactgatagttgcgcttgaaactgcagttcttgagtgaagtagaggcaggcggaattcctagtgtagcggtgaaatgcgtagatattaggaggaacaccagtggcgaaggcggtctgctgggctttaactgacgctgaggctcgaaagtgtggggagcaaacagg

SEQ ID NO: 849 - DNA, 253 bp, Unknown
  Artificiall/Consensus sequence
tacgtagggagcaagcgttgtccggatttactgggtgtaaagggtgcgtaggcggattggcaagtcagaagtgaaatccatgggcttaacccataaactgcatttgaaactgtggttcttgagtgaagtagaggcaagcggaattccgagtgtagcggtgaaatgcgtagatattcggaggaacaccagtggcgaaggcggcttgctgggctttaactgacgctgaggcgcgaaagcgtggggagcaaacagg

SEQ ID NO: 850 - DNA, 253 bp, Unknown
  Artificiall/Consensus sequence
tacgtagggagcgagcgttgtccggaattactgggtgtaaagggagcgtaggcgggatcgcaagtcagatgtgaaaactatgggcttaacccataaactgcatttgaaactgtggttcctgagtgaagtagaggtaagcggaattcctggtgtagcggtgaaatgcgtagagatcaggaggaacatcggtggcgaaggcggcttactgggcctttactgacgctgaggctcgaaagtgtggggagcaaacagg

SEQ ID NO: 851 - DNA, 253 bp, Unknown
  Artificiall/Consensus sequence
tacggaggatccgagcgttatccggatttattgggtttaaagggtgcgtaggcggctttgcaagtcagatgtgaaagtttgcggctcaaccgtaaaattgcagttgatactggtatccttgagtgcagcagaggtgggcggaattcgtggtgtagcggtgaaatgcttagatatcacgaagaactccgattgcgaaggcagctcactggagtgtaactgacgctgatgctcgaaagtgtgggtatcaaacagg

SEQ ID NO: 852 - DNA, 253 bp, Unknown
  Artificiall/Consensus sequence
tacggagggtgcaagcgttaatcggaattactgggcgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggacggtaactgacgttgaggctcgaaagcgtggggagcaaacagg

SEQ ID NO: 853 - DNA, 254 bp, Unknown
  Artificiall/Consensus sequence
tacgtagggtgcgagcgttgtccggaattactgggcgtaaagagctcgtaggtggtttgtcgcgtcgtctgtgaaattccggggcttaacttcgggcgtgcaagcgatacgggcataacttgagtgctgtaggggagactggaattcctggtgtagcggtgaaatgcgcagatatcaggaggaacaccgatggcgaaggcaggtctctgggccgttactgacgctgaggagcgaaagcgtggggagcgaacagg

SEQ ID NO: 854 - DNA, 253 bp, Unknown
  Artificiall/Consensus sequence
tacggaggatccgagcgttaatcggaatcactgggcgtaaagcgcacgtaggctgttatgtaagtcaggggtgaaagcccacggctcaaccgtggaactgcccttgatactgcacgactcgaatccgggagagggtggcggaattccaggtgtaggagtgaaatccgtagatatctggaggaacatcagtggcgaaggcggccacctggaccggtattgacgctgaggtgcgaaagcgtggggagcaaacagg

SEQ ID NO: 855 - DNA, 253 bp, Unknown
  Artificiall/Consensus sequence
tacggaggatccgagcgttatccggatttattgggtgtaaagggagcgtaggtggcaaggcaagtcagatgtgaaaacccggggctcaaccccgggactgcatttgaaactgtctagctagagtgcaggagaggtaagtggaattcctagtgtagcggtgaaatgcatagatattaggaggaacaccagtggcgaaggcggcttactggactgtaactgacactgaggctcgaaagcgtggggagcaaacagg

SEQ ID NO: 856 - DNA, 253 bp, Unknown
  Artificiall/Consensus sequence
tacggaggatccgagcgttatccggatttattgggtttaaagggagcgtaggcggggtattaagtcagttgtgaaagtttgcggctcaaccgtaaaattgcagttgatactggtatccttgagtgcagcagaggtgggcggaattcgtggtgtagcggtgaaatgcatagatatcacgcagaaccccgattgcgaaggcagcctgctggactgtaactgacgctgatgctcgaaagtgtgggtatcaaacagg

SEQ ID NO: 857 - DNA, 253 bp, Unknown
  Artificiall/Consensus sequence
tacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcttactggacgataactgacgctgaggctcgaaagtgtgggtatcaaacagg

SEQ ID NO: 858 - DNA, 253 bp, Unknown
  Artificiall/Consensus sequence
tacgtatggagcaagcgttatccggatttactgggtgtaaagggtgcgtaggtggcagtgcaagtcagatgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacagg

SEQ ID NO: 859 - DNA, 252 bp, Unknown
  Artificiall/Consensus sequence
tacggaggatccgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagtgtgggtagcaaacagg

SEQ ID NO: 860 - DNA, 253 bp, Unknown
  Artificiall/Consensus sequence
tacgtaggatgcaagcgttatccggatttactgggtgtaaagggagcgcaggcgggactgcaagttggatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacagg

SEQ ID NO: 861 - DNA, 252 bp, Unknown
  Artificiall/Consensus sequence
tacagaggtctcaagcgttgttcggaatcactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacagg

SEQ ID NO: 862 - DNA, 253 bp, Unknown
  Artificiall/Consensus sequence
tacggaggatccgagcgttatccggaattactgggtgtaaagggagcgtaggcggcatggtaagccagatgtgaaagccttgggcttaacccgaggattgcatttggaactatcaagctagagtacaggagaggaaagcggaattcctagtgtagcggtgaaatgcgtagatattaggaggaacaccagtggcgaaggcggattgctggacgacaactgacggtgaggcgcgaaagcgtggggagcaaacagg

SEQ ID NO: 863 - DNA, 253 bp, Unknown
  Artificiall/Consensus sequence
aacgtagggtgcaagcgttatccggatttactgggtgtaaagggagtgtaggtggccaggcaagtcagaagtgaaagcccggggctcaaccccgggactgcttttgaaactgcagggctagagtgcaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 864 - DNA, 253 bp, Unknown
  Artificiall/Consensus sequence
tacgtatggtgcaagcgttatccggatttactgggtgtaaagggagcgcaggcggtacggcaagtctgatgtgaaatcccggggctcaaccccggtactgcattggaaactggttatcttgagtgtcggagaggtaagtggaattcctagtgtagcggtgaaatgcgtagatattaggaggaacaccagtggcgaaggcggcttactggacgataactgacgctgaggctcgaaagcgtggggagcaaacagg

SEQ ID NO: 865 - DNA, 253 bp, Unknown
  Artificiall/Consensus sequence
tacggaaggtccgggcgttatccggatttattgggtttaaagggtgcgtaggcggtttgataagttagaggtgaaatcccggggcttaactccggaactgcctctaatactgttagactagagagtagttgcggtaggcggaatgtatggtgtagcggtgaaatgcttagagatcatacagaacaccgattgcgaaggcagcttactaaaccataactgacactgaagcacgaaagcgtggggatcaaacagg

SEQ ID NO: 866 - DNA, 252 bp, Unknown
  Artificiall/Consensus sequence
tacgtatggagcgagcgttgtccggaattattgggcgtaaagcgcgcgcaggcggcttcctaagtccatcttaaaagtgcggggcttaaccccgtgaggggatggaaactggaaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacagg

SEQ ID NO: 867 - DNA, 253 bp, Unknown
  Artificiall/Consensus sequence
tacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggtcgcctggtctgtaactgacactgatgcacgaaagcgtggggagcaaatagg

SEQ ID NO: 868 - DNA, 252 bp, Unknown
  Artificiall/Consensus sequence
tacggaggatccgagcgttatccggatttattgggtttaaagggagcgtaggtggtccttcaagtcggtggttaaaggctacggctcaaccgtagtaagccgccgaaactggaggacttgagtgcaggagaggaaagtggaattcccagtgtagcggtgaaatgcgtagatattgggaggaacaccagtagcgaaggcggctttctggactgcaactgacactgaggcacgaaagcgtgggtagcaaacagg

SEQ ID NO: 869 - DNA, 253 bp, Unknown
  Artificiall/Consensus sequence
tacggaggatgcgagcgttgtccggatttactgggtgtaaagggtgcgtaggcggtttgataagttagaggtgaaataccggtgcttaacaccggaactgcttctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacagg

SEQ ID NO: 870 - DNA, 253 bp, Unknown
  Artificiall/Consensus sequence
tacgtaggtggcgagcgttatccggaatgattgggcgtaaagggtgcgtaggtggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacagg

SEQ ID NO: 871 - DNA, 252 bp, Unknown
  Artificiall/Consensus sequence
tacgtatggtgcaagcgttatccggatttattgggcgtaaagggtgcgcaggcggtttgaaaagtttaaggtgaaagcgtggggcttaaccccatacagccttagaaactgtcagactagagtacaggagagggcaatggaattccatgtgtagcggtaaaatgcgtagatatatggaggaacaccagtggcgaaggcggttgcctggcctgtaactgacgctcatgcacgaaagcgtggggagcaaatagg

SEQ ID NO: 872 - DNA, 252 bp, Unknown
  Artificiall/Consensus sequence
aacgtagggtgcaagcgttgtccggaattactgggtgtaaagggtgcgtaggcggcccgttaagtctggagtcaaagccggcagctcaactgtcgtacgctttggaaactggcgggctggagtgcagaagagggcgatggaactccatgtgtagcggtaaaatgcgtagatatatggaagaacaccagtggcgaaggcggtcgcctggtctgcaactgacgctgaagcacgaaagcgtggggagcaaatagg

SEQ ID NO: 873 - DNA, 253 bp, Unknown
  Artificiall/Consensus sequence
tacgtagggagcaagcgttatccggatttattgggtttaaagggagcgtaggcggacgcttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcttgctggactgtaactgacgctgatgctcgaaagcgtggggagcaaacagg

SEQ ID NO: 874 - DNA, 253 bp, Unknown
  Artificiall/Consensus sequence
aacgtaggtcacaagcgttgtccggaattactgggtgtaaagggtgcgtaggcggaagaataagtcagcggtgaaatgcttcagctcaactggagaattgccgatgaaactgtttttctagagtataaaagaggtatgcggaatgcgtggtgtagcggtgaaatgcatagatatcacgcagaaccccgattgcgaaggcagcatactgggctataactgacgctgaagcacgaaagcgtgggtatcgaacagg

SEQ ID NO: 875 - DNA, 253 bp, Unknown
  Artificiall/Consensus sequence
tacggaaggtccaggcgttatccggatttattgggtttaaagggagcgtaggtggtgattttagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacgctgaggctcgaaagcgtggggagcaaacagg

SEQ ID NO: 876 - DNA, 253 bp, Unknown
  Artificiall/Consensus sequence
tacgtaggtcccgagcgttgtccggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 877 - DNA, 1215 bp, Unknown
  Artificiall/Consensus sequence
atgaaacgcaggcgttttttggcggcgctgctggccgcagcggtcctttgtccgcttgccgccctggcagcgggagaaaagaatgtggacaatctgcccaccggcaacctggaagggtttgaaagcagcatcacctggttcggggaggatttcgcctacgacatcaccgacgaggaggcctgctgggagctgttgcagcggcccattacggttttggatgtaagcgagaaggaggtcgtctatccccgcgtatcgcccaatggcgaaaaggtggtcaacgagtggatgggaggcagcatcaacggatcgcttgccgccgtccacgtgctgggtgaggacgaggacggatggaccctcatcgagggcatggactactacgaccgcatcatccgcggatatgtcaagaccagcctgctcaaaacggtcacgcccaacaacaagtacggcatcatcatcgacaagctgacccagcggctgtacatgttcatcgacggaaagctctggtccagctgcgcggtgtccacaggcctgcccaacaaggaccagccctacaatgagaccgccgccggcgaatacctgattggaagctgggtgggcggctttgacagcgagggcatgtactgcgaaatgggcatccgcttcaacggcggcgaccttctgcatcaggtgccctatgtggaatttgccgacggcaccaaggatttcggcaagtatggatcgcagctgggccgcaaggccagtcacggctgcgtgcgcgtgacacgcaccgccaacgacgagggcctgtgcatcagctggctgtgggaaaacctgaaaaagaataccaaggtggttgtctgggatgacgacggacgcactctgccctatcccgacgatgatctggaagtgtactacaaccccgacggcggcaccagctaccatgctacggccacgtgccgctccgtgcgcgacaagtatctgccgctgaccgcttttacctatggcgagttggatagcggcaaatacgccagcctgaccggctgcaccaactgcattccggtcaagcgccgtgcggagatcgacgagatcaaccaggagcgcatcgacctgggcgagctgcttaagaatccggtctataccggcggcgccacgaccggcggcggtgcgcaggcggacggcagcgccgcgtcagacagcccggaggcatccaacggggtgaccatcaccatacggtaa

SEQ ID NO: 878 - DNA, 2517 bp, Unknown
  Artificiall/Consensus sequence
atgaacatcaggaaatggacgggcatcgtgcttgcggtcatgctgctgagcacggcgttcactgctggcgctgcaacgtttactcctggcgactacgaggcctccgcgcagggcttcggcggcactgtaagcgttaagctgaccgtggacgaagaagcgatcaccgcgattggaatcaccggcgagggtgaaaccccggcgctgggcggcgcggccatcgagcagatgagcgcggcgtatgtgggacaggccgacgccgagggcgtggacggcatgaccggtgcgaccatcaccagcgacgccgtcaaggccgctgtaagcagtgcccttgctcaggccaggggtgaggcgcaggaggcggcgcagatcgccttcacgccgggcacctatgagggcactgccgccggttacaacggcgacgtggtgctgagcgtcaccttcacggaggacgccatcgagtcgatcgaggtcgtctcctctgcggagacagagcatgtgggcgatgttgcctacgagattctgttcccccagatcatcgaatacacctccaccggtgtggacagcgtctccggcgcaacgtttaccagccgtgcggtctttaatgccgtcaacgcggcagcggagcaggccggctgcgatgtggcggcgctgcaggcgggagccaagcccttctcctatgaagcgcaggaccccatcgagggaacctatgatgtggttgtcgtgggcgctggcggcgccggcatcgccgcggccgctcaggctgcgcagaacggcgacaccgtgctggtcattgaaaccaatgccgaggtcggcggcaacacgctggtctccggcggccagtatcagagcgtgatgccctacctggtatgggaccccgaagatcccgacgcgaccaccggcgtgggctttgacggcaacacctacaacaaggtcaagtccgtccagggctgcatcgacgagctgaaggtcattctggactggaacgaagaagaattcgatgcggattactacaaggatcatgagtatgtggccggcgacatgaaggagctttccaagcatggcgttcatgccgattacctgcccgtcctcaaggagctgaaaagcgagattcaggcctatctggactgggcgcagccgcagctggacgcgggcgttccggaaaaccagctcacgctcttctccacgctgaacctgcatatcttccagacctattacggcggcctgcgccagagcgcggacggcagcgaatggatctatggcgatatcgacctggtcacccagttcatccaggacggtcaggagctcaagccctggctggaggaaatgggctccaccttcgtggaggatacccagcccaccctgatcggtgcgctttggtatcgtgaaaacgagttcatcggcgctgacgtcgataccgacggcgacggcgagaccgaaaattacgccgggcgctggggcacctatttcgtggctcccatgaacgagttcctctccgcgaacgaagccaatgaaatcatgctgcgcaccacggccgaaagcctcattaccgacgacaccggccgcgtgatcggcgtgaaggcaacccgctatgacggcacgcctgtcaccgcctatgccaacaaaggcgtgattcttgcgaccggcggctatgctgccaacatcgacatggtgctcgacaccaacgtctactggtccagcgaatacctgaccgaggccaccaagaccaccaaccgctcctccctcaccggcagcggcattgatatggctgtcgaagtgggcgcggctaccacgggcatgggcttcacccagctgatgccgatttcctgggtggataacggaaacctggctttcggcggcggtaactatgccgtgtatatcaatcccaccacgggcaagcgctttgtggatgagggctctgaacgcgacgtgctgtccctggccgagttcaaaaacggcatggaagtcaacggcaccaagggcgtgttcattgaaatctacaatgccgccgagctgatccccggtcccatccagcttgcggaaggcgactatgagggccgctattatacccgcaaggcgaccgagctgggcgatctgttcgctcagatcggcgtgtccgctgatcccgacgttgtgctggagaccatccgcaactacgacatggctgtgatgggccagggcgagtttgaggatgtgggcaagtcgatcgcttcccgcaccatcggcgatgtggaaaagaacgaagacggcagctacaacgtggatacctacgatctggaaaacaccacgctgcgcatccgtctgatggccccctccacgcatcataccatgggcggcgttgaggtggataccgagcgccacgtgctggataccgaaggaaacatcatccccggcctgtacgctgcgggcgaggtgaccggcggcatccatggcggcaaccgtctgggcggcaacgcgattgttgaaatcttcgtttccggcaggacggcggccaatgccgttgcggctgatgccgaataa

SEQ ID NO: 879 - DNA, 1173 bp, Unknown
  Artificiall/Consensus sequence
atggccgcctccatcctcacaggggaagagacgcgtctggaggaatgcccggaactggtggacgtggcctatatggccgatattctgcgcaccctgggctgccggatacatagcggggacggggcgctgaccattgacccgcagagcctgaaccggcatgagatgcccgatgcgctggccaagaagattcgctcctccatctttttgctggggtccattctggcgcggttccgaaaggcaaccgtcacctttcccggcggatgcgagatcggtctgcggcctatcgacctgcatctgagcgggctgaggcagctgggggtcgatgtgcgggaggagggcggcctgattcgctgcgacggccggcacatgcgcgccggtacggtgcattttgactatcccagcgttggcgccaccgagaacgtgatgatggccgcggcgctgctcaagggccgcacggtgctcagcaacgtggccagggaaccggaaattaccgatttgcagaacttcctcaatgccatgggagcgcgcatcagcggcgcgggcacgcataccgtgaccgtcgaaggcgtggaccggcttcggggcgtaagctactgccccatgccggaccgcatcgtggccggtaccttgctggctgcggcggcggccacgggtggtgacatccggctgacgaacgtgccctgccgcgacctgtacgccgtctttaccaagatgcgggagatgggctgcgagatcgatgaggaggaaagcgcggtgcggcttcgcgcgccgcagcgactcacggctttccagcagctgcagacgcagccgcatccgggttttcccacggatatgcaggcccagatgctggccctggccgcgatggcgaagggaacctcggtggtggtggagaacgtatttgagaaccgctttgcgcacgcgggcgatctcaaccgcatgggtgccaatgtgctggtaaatggccgcacggctgtggtacagggcgtggatatgctctacggcacgcatgtgaccgcccgagacctgcgcggaggggcggcgctggtgatcgcagggcttgcggcgcgcggagaaacgctggtggagcgcgccgaactgatcgaccgcggatacgaacgcctggaagagatgctgggtgcgctgggggcggagatccgccgcgacagcgtataa

SEQ ID NO: 880 - DNA, 1368 bp, Unknown
  Artificiall/Consensus sequence
atggagaaactgaaagtagcggctccgctggacccggcgtttgcgcccatctaccgggagatgcaggcctttgccgcgcgtgcggcaaagggacccgagatccgcattgccgtggagcgaaacgacggcctggtagccacgcatgacatgcgcatcctcccggagggagaggacgatgcgctgaacctgcgcatggcggagcggatggtcaagagcatgctgtgggtatacggcggtttccgcgtgaccatcgcgggaagcaaggccgtgtatgagggagtgaaggagcagtaccgcgaaggcggcgagcgcgcctttgacgcgaatttcatggcgcacgtctatgagcatgccttcgaggtgtgctatgccgccacgcctgccgaagctccgcagcgcaaggatgcctccgcgcccatcggccgccatctggacggctgccggatcggttttgacgccggcggaagcgaccgcaaggtatccgccgttatcaacggtgaaagcgtctatagcgaggaggtcgtctggttccccaaaacccagtcggacccctcgtaccatttcgacgggatcgtcagcgccatgaagaccgccgcctccaaaatgccgcgtgtggacgccatcggcgtgagcagcgcgggcgtatacatcaacaaccataccatgagcgcctcgctgttcctcaaggtcagccctgaggattatgaaaagtacgtcaaggacatctatattcgcgccgcgaaggaaatcggggacgtgcccctgaccgtgtgcaatgacggcgatgtgaccgcgctggccggggccatgagcctgggcgaggacggcattctgggcatcgccatgggcaccagcgaggccggcggctatgtggacatgaagggcaacatcaccggctggctcaatgagctggcgtttgttccctgtgatctggcgccggaggccatggtggacgagtggagcggcgacatcggctgcggcgtgaagtatttctcccaggacgcggtgatcaagctcgcgcccgccgcgggcatcgagctggaccccgccctcagccccgccgagaagctcaaggtggtgcagggcaagatggagcagggcgacgccggcgcgcgtgccatctatgagaccatcggcgtgtatctgggctatacgctggcgttctacgccctgttttatgagatcaaccatgtgctgctcatgggccgcgtgaccagcggcgagggcggagatctggtgctggccaaagcgcaggaggtgctgcgcaccgaatacccgcagctgaagatgcaggtgaacctgccagacgaaaagagccggcgcgtgggtcaaagcgtggcggccgccagcctgccccagatcggttaa

SEQ ID NO: 881 - DNA, 1752 bp, Unknown
  Artificiall/Consensus sequence
atgcgcaccatccaatttgggtccatctatcacatgccctggctggagtatcgtcatgcgctgcccgacgggcgcgtgtgcctgcgcctcaagaccggcaggggagagttttcgcgcgtggccgtgcgggttaccagcaattacgccatgcccgattattttaaaggcgcggacgagtatgaaatggcggtggcctatcgcgatgagtggcatgatttttatgaggtgatcttttccccccgggacctgcggatcaagtatctgttcgtgcttcaaagcgatgagctgacgttcaagcttgacgccacgggcctgaaggcgggggcggatgcggaggaggacgtgagccaggcgttcgcctttgcctatgtgtatccggcggctcccatgcccgaatgggcgcgggggtgcgttgggtatcagatctttccggatcgcttccgccgcgaacccgtggaaaccgatacggagcctgtagagccctggaccagcacccgcgtgcaaaaccagtaccgcttcggcggcaatctgcgcggcattctcaaggcggtcccgtatctcaaggacctgggtgtaaagatgatctataccacgcccctgttcctcagcgacagctcgcaccgttacaataccttcgactacttcaagatcgatccgctgctgggcacggaggatgacctgcgcgcgctgtgcgacgagctgcataaaaacgacatgcgcatcgtgctggatggggtgttcaaccattcggggctcaagttcgcgccctttgtggacgcgatggaaaagggcgaggcctccccttatcgcggctggttctgctttgacgacaaaatgccctatggataccacaccttcggcgactggcgctacatgcccaagctgaacctgcaaaacgaggactgcgcgcagtatttcctgtccgtgggacgctactggctcgaaaaatgccatgtggacggctggcggctggatgtgagcccggaggtgtggccggatttctggcggcagttcaaaaccatgatgcgcaaggtcaaccccgacagcctgatggtggcggaatgctgggatgacagccgcgagtggctcaccgtgggcgacatgttcgattcgaccatgcactatgtgctcagccgcaacatctggagccgcttttgccgtcatgaaatcagcacggcccagtttgactgcgccctcaatcgcgccgccatgctctatccccagcgcacgcaggaggtgctgtggacgtttctgggcagccacgacacgcagcgcatccgtacgcgtgcgggcggcgacctgcgcatggtgcacgcggcaagcttcttccagttcacctacctgggatcgcccatcatctactatggcgacgagctgggcatggagggcggcgaggacccggactgccgacgccccatgcgctgggatgatgtggaggacaaccccacccgggcgcattaccagaagctggcgcgcctgcgcgcacagctgcccgcgctgcgcacaggccggttccgcagccacgtggctctggaaaacggcctgtacgccttccggcgcgaaaccgatacacagcagctgctctgcgtcgtcaacacgggactgcaaccggtcagcgtgcggctggaactgcccgggggcatggcgggaatggcggccgtgcatgaccactacagcggccgaagcctggctgttgcggatggtggggtgcatatttcactcaaggtgggcgaaggcttgattttggagtga

SEQ ID NO: 882 - DNA, 1323 bp, Unknown
  Artificiall/Consensus sequence
atgtcaaccgtgcctttcgcgccgccgggccctctggcgcccgttctccgcgttttgcagggatcgcctttttatccttcatctttattgatgcatgaatgccgcaacagggaggaaaccgccatgccgcttggactgtccaaaaaatgcagcgccatcgccccctccgccaccctggccatggatgccagggccaaggagctgcgcagccagggtgtcaacgtgatcggctttgccgcaggagagccggattttgaaacccccgaccccatccgcgaagccatgaaggaagccatggacctggggatgacccgctacacgcccgcggcgggcacgctggaactgcgccgcgccattgccgcgcgcctgcttgaggaccacggcctggtctacggcatggatgagatcatcgtctccaacggcgccaagcactcgctttataacacctttcaggccatcctggaccccggcgacgaagtgatcgtcgataagccctgctgggtcagctacccggagatggtgcgcatggccgggggcgtccccgtatttctggactgtccggaaagtcagggattcttgccctcgatggcggatcttgaaaagctcatcaccccgcgcaccaaggctttcatcctcaacacgccctccaatcccaacggctgcatgtggtcgcgcgagcagcttcagcagctggcggatctggccgtgaagtacgatttctacatcgtggccgacgaaatctatgaaaagctggtctacagcggcgagaagcactattccatcgccaccttcggcccggagatcaaggcccgcaccattttgatcaacggtgtgagcaagtcctatgccatgaccggtttccgcatcggctacgcctgcggaccccgtgacgtcatcaagggcatggtcaactaccagagccaggccacttccgcccccaacaccgccgcgcagcatgccgccgccgtggccctcaccatgccgcaggactgcgtggaggaaatgcgcaaggcttttgagcagcggcgcgaccggctggtggagctgatcaacgccattcccggcctgagctgccgcaagccccacggcgcgttctacgtgatgatgaacattcgcggcatcaccggcaagcgctaccacggcaaggtgctgagcggaagcaccgccatagcggaagcgcttctggaacatgcacatgttgcgctggtgccgggagcggccttcctggacgagggcttctgccgtatcagctatgccacttccatggaaaacatcgaggagggacttcggcgcattgccgcctttgtaaaggagctggagtaa

SEQ ID NO: 883 - DNA, 2013 bp, Unknown
  Artificiall/Consensus sequence
atgaaccgctttgtgctcaaagccccctatccgcccagcggcgaccagcccgcggccattgaatcgctggccagaggcgttctggagggaaaacgcgaccaggtgctgctgggtgtcaccggcagcggaaagacctttaccatggcgtccgtcattgaaaaggtgcagaagcccactttggtcctggcgcataacaagacgctggcggcccagctgtgcagcgagctgcgcgccttttttccggacagcgcagtggagtatttcgtcagctattacgattactaccagcccgaagcctacatcgcctccaccgatacctacatcgaaaaggatgcctccatcaacgaggagatcgaccggctgcgccactctgccaccgccgccgtgcgtgagcgcagcgatgtgatcatcgttgccagcgtgtcgtgcatctattccatgggcgatcccagcgagtatgagggcatgatggtcagtatgcgccccggcatgcaaatcagccggaacaagctgatcgagcgcctggtggaaattcagtatacgcgcaatgactatgaatttacccgcggcagcttccgtgtgcatggcgacgtgctggagatcatccccgccaatgagcgcgagcacgccctgcgtattgaatttttcggcgacgagattgaccgcatccgcgagatcgaggtggtcagcggcaacgtgctgagcacgctggagcacgcggtggtctttcccgcaacacattatgccatggaccgcgaaaagatgaacgaaaacatcgaccagatcgagcgggatctggaggtgcgggccaaggagctggaggacgagggccagccgctctatgctatgcggcttcgccagcgcacgcgctatgatatcgaaatgatgcgccagatcggcttttgcacgggcatcgaaaactacagccgctactttgacggccgcaagcccggcgacgcgccgtattcccttctggactactttcccaaggattttctgatgttcatcgacgaaagccatgtcaccgtgccgcagatccgcgccatgtacaacggcgaccgcgcgcgcaaaaaaagcctggtcgattatggcttccgcctgcccagcgcctatgacaaccgccctctgctgtttgaggagttccgcgccaggcagaaccagaccatctatgtcagcgccacccctgccgcctatgagctggggctgagcgaaaatacggtggagcagatcatccgtcccacggggctgattgacccgctgatcgtgcttcggcccgcgacgggtcaggtggacgatctggtgggggagatccaccgtaccacggaaaaaggcggccgcgtgctggtgaccacgctgaccaagcgcatggccgaaagcctgacggattacctgaaaaacctgggcatccgcgtgcgttacctgcattccgacattcaaaccatggagcgcacccagctcattcgcgatctgcggctgggtgagttcgacgtgctggtgggcatcaacctgctgcgcgagggactggacatgccggaggtcagccttgtggcgattttggacgcggacaaggagggttttctgcgcagcgaaacctcgctcatccagaccatcggccgcgcggcgcgcaatgtggacggccgcgtcatcctctacggcgacgtgctcaccgagagcatggagcgcgccatgaacgaaaccaaccgccgccgcgccctgcaggaggcgtacaacaagctccacggcatcacgccgcagagcgtcaagagcaccgtgcaggccctcatccgcatcaccgacagcatgaaggaccacaagcccgacgacatgagcgacgaggagcttcaggaactgatgaagagcgtggaggaccagatgctctccgccgccaaggacctcgatttcgagcgcgccgccaagctgcgcgacgagctgttccgcctcaagggggaaaagcacgacgacattcaaaagccgcaggtgcgtaggcaccggcggcccaggcgcacgcgttaa

SEQ ID NO: 884 - DNA, 1674 bp, Unknown
  Artificiall/Consensus sequence
atgaaaccgctttgctatgactacctcaactgccccacgaccttctccacctatgatgatttcaacaagaaattccgcattacccgcccggagagcttcaactttgcctatgacgtggccgaccggatcgctcaggaggaacccgaccggctggccgtgctttggacggacgaaaccggtgcctgcatccgttatacctttggacagctgaaggaagaaagcgaccgcgcagccaacctgttcaagtccctgggcatccgcaagggcgacaaggtgatgctgattctccgccggcatctggaattctggcctattctcatggctctgcacaagctgggcgccgtgggcgtgcccgccacccatcttctgaccgaaaaggatgtgctctaccgcgtggacgcggcgcgcatccagatgatggtcatctcccacaaggacgaaggcgtgctcagaagcgcggaagtcgccatgcaaaagtgcgaaagcctcaagcacgtgatgattctgcgcggccagcgcgagggcttccacagctatgagcaggaaatgcccctgcaaagccccgtgtgggacaagcccacgggggatgcctatccgcacaaccatgacctcttgctgctctacttcaccagcggcaccaccggcatgcccaagatggttacgcatgaccattattatccgctgggacatatcgtgaccagcctgtactggcagcagtgcgaggacggcgggcttcacttcaccatttcggaaaccggctgggccaagagcgtgtggggcaagctctatggccagtggctgaccgggagtgcggtctttgtctacgactttgagcgcttcatcgcccgcgacatcctcaagcagatgagtacctatggcgtgaccaccttctgtgccccgcccaccatgtaccgctacatgctgcaggagaacttcgcaggctatgacctgagccacctgcatcactgtgccgtggcgggcgagccgctcaaccccgacatggctgccgagtggctcaagcgcacgggcattccgcttctggaggcctttggacagacggaactggtggtcacgctggctaccttccccttcatgaaggtatgccccggcagcatgggcaaacccagccccatctttgacgtggacctggtggacgatcaggggaactcctgcccgccgggcgtgacgggcgagatcgtcatccataccgatgacgacgcactgcccatcggcatgttctccggctactatgaggacccggagctgaccaagaccgtctgggacaacggcctctactacaccggcgacgtggcctggcgcgatgaatggggctactactggtatgtgggccgcgccgacgacgtgatcaagtccagcggctaccgcatcgggcccttcgaggtggaaagcgcgctgctggagcacccggccgtgctggaaaccgccatcaccgccgcgccggacgagcttcgcggccaggtggtcaaggccaccatcgtgctcaagcccggctgggaggcgggcgacgcgctcaggaaggaactgcaggagcatgtcaagcgcaccactgccccctacaagtatccccgtatcatcgaatttgtcagcgagctgcccaagaccatttccggcaagatccgccgtgtggagctgcggcagaaggaccagcgctaa

SEQ ID NO: 885 - DNA, 1137 bp, Unknown
  Artificiall/Consensus sequence
atgcgttttttgcatctgtccgatttgcatatcgggcgcaggctcaatggtttcagtctgctggaggaccaacggaccgtgctgggtcaggcggtgaaactggctgaagaatgcgacgcagtgctgcttgcgggcgatctctacgacaagccccagcccccggcggaggccatccgtgtcgtgagcgatttcctggtggcgctccgtggcctgggaaagcccgtctttgccgtcagtgggaatcacgacgcgcccgaacaggtggcttattgccatgagctgctgggccggtgcggagtgtttctctctccggcctttgacggggcgctgcatggccataccctgcgcgacgcgcacggggaggtgcgcgtgtggctgatgccgtttttgcgtccctccgccgtacggccatatttcgagaacgtgcgcacctttgaggacgcggtacgggcggcgctgtccaccgtggcgcgggaaccggacatgaggcatgtgctggttgcgcatcagtatgtcaccggcgccgcgacctgcgattcggaaatcctctcgctgggcgggacggatcaggtgggcgcatcgctctttgacggatttgactatgtggcgctgggccatttgcattccccgcaaaagctgtgcggcgggcgggtgcgttactgcgggtcgccgctgaagtactcactgtcggaggagcggcagcgtaaggccgcgctggtggtggacctggggccggagggactgcgcggcgtggaggagcacccctttgcccccctgcgagatctgcgcacggttcggggtgcgctcaaggaattgactgagccggaatgcttcagcgaggactacgtctatgccgagctgaccgacgaggaggcgctggcggacccggtgggggcgctgcgcatcacctatcccaacctgattggcatgcgggtgcgcaacagccgcacaaacgacggcctcgcgcaggcggaagcagaggtggaagcggcggagagacgcacgccgctggagcatttcacggccttctaccagatgcagaataacggcacgccgcccgatgagcggcggctccgcgtgatgcggcaagtgattgaggaagcggaggcgaaacggcatgaggccggtcaggcttga

SEQ ID NO: 886 - DNA, 1302 bp, Unknown
  Artificiall/Consensus sequence
tttattccatacatatttacaaagtatgaaaaaagcgttacaatacaaaatgaatctttttatcaatacggaccggaggtgccgcaagtgcccacgttgacccagctctcgtccaatctgacggaaattgtgatttatgcagccatcgcgctggttaccctgacgggtctgtgcaagtgcatttatccccttttacgaaatgccacacttctcaaccgcgcggtcatcaagctggaaaagagcactgcggcgggggagcgtcccatctggcgcgaggcacgctttttgggtcgatcgctgcgcaacgagtggcagcagtttttgcttaacgccggacagctggacatgcgtggcattccctgcgatacgcgcgaatatatcaacgaggatactgtggtggacaagccgggtcacgcccagctggcggagctcattccgggcctgctgacctctctgggtattctgggcacgttcgtcggcctgatgcagggcctcaccagcgtggatttcagcaacgcggagggaaccatccagagcattccccagttgctcagcggcatgcgtttcgcctttgccacctcggtggcgggcatctcctgctcgcttctgttcaatatgtttaaccgcatggccgcaggccgggcggtgcgggcgctggacaatttcgaggatgctttctacgagctggccatgccacgtccgctccagccggatgtgcagatgatgtgccagaagcaggacgaggaagtccgcatggcacgactggccgaaaacgtgggcaatcacgtggcggcctcgctggaaatggccattggacgcgccatggcgccgcttacgcagtcgctggatacgtttatcaagtgtgcgacgcgtgagcaggtggacggcgtgcggcgcatcgtgggccagttcgtgcagcagatgaacacatcgctcagcagccagatgacagcgctgggcgacacgatgaacgcggttaaccagggtcagctgcaaacccagaagaatctgcagaccacgctggacgccgcgcgcgccatggcgggcgacgcgcaggcgatccgggaagcgagcgcggaaatcgcccggcaaatgcaggcgttcgctcaggagatgcaaaaagaacgcgacagccgcgccgaagcgctgggcacagcggaaagcgcaggacagtcccttgccgaccagctcgatgcgctgtcggaatccttccgtcgcatgcaggtagccgcggacttgctgacggatgaaatgaacacgcttccctccgacgacgcgcaggccccggcggcggagctgtaa

SEQ ID NO: 887 - DNA, 2487 bp, Unknown
  Artificiall/Consensus sequence
atggcaattttcggacactttacccagcgggctcagcgtgccgtggcggccgcccagcaggcggcggtgctgctgcaccagccctatgtggggacggagcatattcttttgggcctgctgaaggagcccggtcccgtggtagccgatgtgctgcccgcggatgtcaactatgatacggttcttgagcgcgtgcgcacgctcctgggcgagggcaacatgcagtccggcggcatgctggagctgaccccgcgcagcaaaaagattctggaaagcagcattctggaaagccgcaagctgcaccacagctttgtgggcacggagcatttctggctggctttgctcaaggagggcgaaggcgtggccgtgagcctgctgcgcagcatgggcgtggatacgcaggcgatgcagcagaagattctggaggcgctggtcaaatcccagcccgacggcggcgaggatgtttccgcgcccgacggcgaggaaggaaaggccgaaggcagcgtgctggaaaaatacagccgcgacctgaccaaggctgcgcaggacggcgagctggacccggtgattggccgcagcacggaaattgaacgcatcatgcagatcatgagccgccgcaccaaaaacaaccccgtgctcatcggtgagccgggcgtgggcaaaagcgccgtggtggagggcctggcccagatgatcgtggccggcaaggttcccgaaacccttaccggcaagcgcatcctgtccctggacctgggcagcatgatcgccggaagcaagtaccggggcgagtttgaggagcggctcaaggataccatcaaggatgtgaagaaacaggggaacgtgattctctttatcgacgagttccacacgctggtgggcgccggcaaggccgaaggcagcatggacgccgccaacatcctcaagcccgctctcgcccgcggcgagctgcagtgcatcggcgcgaccaccttggacgaataccgcaagaacattgaaaaggacgccgcgctggagcgccgcttccagcctgtcaaggtaggcgagcccacgcccgaagaggcgctggctattctcaaaggcctgcgcgaccgctacgaggcgcatcacaaggtaaaaatcaccgacgaggcgcttcaggccgccgtcagcctgtccgaccgctatatcagcgaccgtttcctgcccgacaaggccatcgacctgatggacgaggccgcctcgcgcgtgcggctgcacagcttcaccgccccgcccgacgtcaaggagcaggaggaccgcctcaaggccctgcaaaatgaaaagaaggaagccatcgctcatcaggactttgaaaaggccgccagcctgcgggacgaggagcgaaagctccgtcaggacatcgcccagaagcgcgcggcctgggaggagcgcaaaaacaacagccacgacgtggtcaccgaggaggatatcgctcagatcgtggccagctggacgggcgtgccggtcaagaagatgacggaggacgaaagccagcgcctgctccatatggaggagctgttgcacaagcgcgtcgtgggccaggatgaggccatcagcgcagtcagccgggcccttcgccgtgcccgcgcgggcctgcaggaccccaagcggcccattggctcgttcatcttccttgggcctaccggcgtgggcaagaccgagctgtgccgcgcccttggcgaagtgatgttcgacgacgaaaacgccctgatccgcatcgacatgagcgaatacatggagaagcacagcgtcagccgcctcgtgggcagccctccgggctacgtgggctacgaggagggcggccagctcacccagaaggtgcgcaacaagccctacagcgtggtgctctttgacgaggtggagaaggcgcacccggatgtattcaacatccttctgcaaatccttgacgacggccgcctcaccgacagcaacggacgcgtggtcaacttcaaaaacaccatcatcgtcatgacctccaacgccggtgccagcaccatcacctccaagcgctcgctgggctttggcggcagcgtggaaaccacccgcgactacgaggccatgaaagagcgcgtgatggctgaggtgaaggataccttccgtccggaatttatcaaccgcatcgacgacctgatcgtgttccacgcgctggagccggacgacatccgccgcatcgcgggcctcatgctgggcagcgtatccaagaggcttgcccagcgcggcatgaagctcagctacggagacgacgtaatcgccctgctggcggaggagggctatgaccccaactatggcgcccgcccgctgcgccgcaccattcagagaagcgtggaagatgcgctgagcgaggaaatcatcgccggtaaaattgccctgggcgaccaggtgcagctgtacgtggatgataacaagcacatcgccttccgaaagctcctgcctcaaacgcctgctcagcctgcgcctacgctggaagcgtaa

SEQ ID NO: 888 - DNA, 1014 bp, Unknown
  Artificiall/Consensus sequence
ccgtccgcgcgatccgcgctgggacgcctgacggggcccgtgcatgcccatcgcctcgccgccatatccttgggcggaggtgatggaatgaactgcattgacaaagcttttttcagcctggcggacgaaatccgatcgctggatgaaaaagagctgtactatcgcatgcgcaaaagctttgacgctgtgccggagccggccaagcgggggctgatgaccttcttttcccagtacccctattggggaaagctggatatcgaccggggcgactatgaagaaatcgcgctcaagcagcaggcgctttcccggcacatggaggattttgcatggctctaccgccggttggccgattaccgttccagaaaaaccctgtacgccatcttgagcaactggtaccgctacgattttgtcaccacgtcccaggccaaggaatatctcttcagcagctatttcgacctggatctgctttcgtgtgatgaaaacgaagtgatcgttgatttgggcgcctatatcggcgatacggtgcttacctatctggagcagtacggcgaggactgctataaaaaaatatactgctatgagatcacgcccggcacctttgaacagcttcagaaaaacctggccggctaccgggatatcgacctgcgccaaaagggcataagcgacgtggaggggtttatgtcccttgcggtcaacgcggccagcacctcggccaacaccctgagcgacgagacgggcggtgaaattcccgtaaccacattggacgccgatattcaggagccggtcactttgatcaaggccgatattgaaggtcatgagcagcgggcgctgctgggagccaaaggccatatcctaaaggaccatcccaagctgctgatctcggtctaccacaacaacgaggatctgtggaagattccccgcatgatccatgactggtgcagcgattaccggttctatctccggttccagagctccgttctctatcccacggagattacgctgttcgcgctctag

SEQ ID NO: 889 - DNA, 2289 bp, Unknown
  Artificiall/Consensus sequence
atgcaaagggtctattcggtgtgttcccccaaacccacgaacgatcagcttgccctgcaggaaacggtgttccataacgccaacggctatctgggcgtgcgcggcacgctggaggaaggggcgccgcagggcatggacaccatgcgcggcgcctatgtgaacggcttctatgaaatcgtccccatgaagcaggcggaaaagctgacccatgtccgcgaggacaaggaaagcatgatcaacgtggcggatgtgcagggaatccgcttccgcctggcgggggagtggttttcacaatggacgggcacgctcgtagaatccgagcgcaggctggacatggatcgcggaatcaccgaacgccgcgtcaggtggcgctcgccggagggacgcgaaacagccctttgctttcgccgcatggcgagttttgcagagccgtcgctgttcctgattgactgtgaggttacccctctcaactatgagggcgaggtggaggtggaaagcacccacctggcactggtgaaaaactatgccaatcccaacgatccacgtctggcaggagagagcgaatgtcatcttgttcctgccgggagcctgatagaggagggagccagctatctgagcacgcgcacccgggtgagcgggctgtcgctgaccaccggcgtgaagcacgcgctggagccggccgcgcagaatgcgcagacggtctacgaccccgcggcacacgcggcggcgttccatgccagcgtgacggtcggacagggacaaacgctgcggctgcaaaaatactgcgtcttttcagatgaacggcggcatggcgatacacttgccgccgcaaggcgggccatgaccggagcttttggccgggcggacgcactctaccgcgcccagcaggaaacgctcaccgccttctgggaaagtgcggacaccaccatcctgggcgacgacgatgccaatctgtccatgcagttcaacctttaccagctgtttcagtctgccgggcgcgacgggctgtgcagcattgcggccaagggtctgtcgggcgaagggtatgaagggcactacttctgggatacggaaatgtacatgatgccgttctttaccctcaccatgccacagctcgcgcgcaagcttctggggtaccgctaccgcacgttggacgcggcacgcgaaaacgcccgcctgctgggccatcggaagggcgcgctgtacccctggcgcacgatcgccggacgggagtgcagcgggtactttctggcaggtacggcgcaataccacattgtaggggacatcgcctatgcggtgggcatgtactacaatgcgaccggcgaccgcgaatacctgatcagcgagggcgcggagttgctgctggaaacggcgcgcctgtggatggatgttgggcatgtggcggagggcaccttccgcatcaactgcgtgacaggtcctgatgaatacacctgtctggtcaacaacaactactacaccaacgcatgcgccaaaaacaacctggagctggcggtgcgcgcggcgcatctgctggaagagtggggcgcatatggcgagtgggcagcccgcctgggcgttacccatgaggagttggatgcgtttgcccatgccgcgaaaatcatgtatctgccttatgacgaaacgctgggcatcaatccgcaggatgacagctttctgcaaaagccgatatgggacctggctgcgacgccgcgggaaaatttcccactgctgctccattatcatcccctgcagctgtatcggtatcaggtatgcaaacaggcggataccgtgctggcacatgtgctttttgaaagcctggccgatgcgggggtacgggaacggtccttccggtactatgagaagattaccacgcacgactcttctctgtccaactgcatcttttgcatcgatgcctgccgcttgggtctgcgccgggaggcacgcgcctattttggcgacagcgtgaagaccgacctgctcaatacgcatggcaacagcaaggacggcatccataccgccaacatgggcggttgctacatggccgtggtcaacggctttgcgggcctgcagctgtgcgcggatggcgtgagggtcgctccgtttctgccagaagggtggacggggctcaagttttccttccagttccggggaagcagactgcgtttcgagatggagggcggagaataccgcgtgcggctgatatccgggggaccggtttcggtctttacgcaagaggatgccttttgtcttaaccatccgggcgacgaggcgaggggcaagacgcgctaa

SEQ ID NO: 890 - DNA, 1338 bp, Unknown
  Artificiall/Consensus sequence
atgcggctgaagcatcacattcttttgtatacctttttgggtgtggcggtgctcatatccatttttctcacgctggattacggcaaccgggcccagcgaagcgcccaggccctggaggacgcctatgcgcagcgcgtgctggaaacgcaggagcacttgcaggccatcgggctcaaactgggcaaagcgccggtagcgacggacgcgcgaacccaggtggagctgctcgcgggcatcagccggcaggcggacaatgtggtgagcggcctgtcggccctaccgctgagtcatatcgccatgagcgacacgctgaagttttgcaatcagctgtcggaatatgccatggtgctggcgctggcggtatccgcaggccagccgctgaccgagcagcaaaccacggagctgagcgccctggaaagccagtgcgcgctgctgctggggcagtttgctaccgcgcgggagaccatggtggccgaaagcctgcgtctgacagcccagccgggggtgttctatgccgaggcgcaggcgggtcagcgcccgctggagcaggtggccgatcccgacaacggcatggactatcccagcatgatctatgacggcgccttttctgatgcgcggcattacggcacgcccaaggccctgggcgaggaactgatcgaccagatccgggccctggaaatcgccagagccttcgtgggggaggagagggtcgaacgtgtggaggcggccccggacagcggcggtaccctggccagctacggtgtgaccctgaccctgaacgacggtgtggtgctcaatgccgaagtgacccgtcaggggggaaagatgctgtggatggtgccggagcatgctgcctttgcccccgcgctgacgctggaggaatgtgcggaagcggcgcagggctttctgctggaccgcggctatggcgagatggaggccaaccactatcaggtgtacgacggcctggcagtaatcaattttgtggccgtgcaggacggggtgctgctgtatcccgatctggtcaaggtacagatacgcatggacaccggagaagtggtaggtctggaggcaaacaactatctgatgaaccacacccggcgcacggggcttgcgcctgcgctttccgcgcaggaggcgctggagaaggtgagttcccggctggaggccggtcaggcgcggctgtgcgtgattccctaccgcgagggggagcgcctgtgctacgaggtgccgggccgctacgaggagcgcgagtaccgtgtatacatcgatgcgctgacgggcgaagaaacagaggtgctgatgatggtggacagcgttgggggacgtatggcggcctga

SEQ ID NO: 891 - DNA, 1206 bp, Unknown
  Artificiall/Consensus sequence
gtgagccagtacatcgagccggtcaaatcggcgctggtgctgtttccctttgtggcgctggtgctcacgctgccctatatgctgtttcaataccgcaggtacggggcggtgctgcttctgcgcacggcgatcgtgtattcgtttgtgctgtacctgatgtgcgcctattttctggtgatcctgcctctgccggatgtggaaacggtcagcgggctgacctccgcgcgcgtgcagctgattcccttccgggaggtggcggacctgctgcgcaacgccggcgtggacccgagtcggcctgccacgtggtaccgcctggtgtggaaccgggatttcttccagatcgtggccaatgtggccatgtttacgccgctgggaatctacctgcggtattatttcggatgcagcctgaaaaagacgctgctgttttcccttttgctcagcctgttttttgagctgacgcagcttacgggcctttacgggtattatccgaggccctatcgtctggcggatgtggacgacctgatcaccaatacgtgtggcgggctgctgggatacgcgctggccccactggcgatgcggctgctgccctcgcgtgagcagatggacgcgcgggcctaccgcaagggcgaacaggtgagcgtgacccgccgctgctttgcggcgctggtggactttgcggtgatgctggtggctctcgcggcgctgatgtggcggctgccctcggtgatgccgtccggagaagatcccgtggcgatggcggcgtggctgtttggctgctatgccgttggaattgtggggtactttgtgcttggcacatggctgggtggaggacgcacggtgggcaaggtgcttttgcacctgcgcctgacggacctgcgaagcggcgaccgtcccagactgtggcagtgcgcggtacgctatggggttttgtacctggtggtgatgcccactcccgcgtttttgctgctggccatcaccctgggaacagaggatggggagatcggcgtgtggctggtgctggcctgcatagggcttctgatgatatatatcctgttctggctgctgctggccgtgcatgtggtcacacacgacaaccagctgctgcatggcaagctgagcatgacgcacaacgtcagcacccttcgccaccggtattttgcccggtggcatggcgcccggcatgcgcatgatacccctatccagtaa

SEQ ID NO: 892 - DNA, 1551 bp, Unknown
  Artificiall/Consensus sequence
atgaccaacatcaggaaaaccattgccctgcttctgtgcctgtgcatgctgtggggaactgccgccctggccgaggatgccgctgcagcgaccgacactgccaccacggccgtcaccgagcttaacgacaccgacgtgctggccaccgtcaatggtgaggaagtgagctgggacgaggtcaaaagcctgtactccagtctggtctcccagtacggcagcgcctacgacctgacccagcaggccaatgtggacctgttccgcgccgtggcgctggaaaaccggcttacagaggtgctgatggagcagaaggccaaggaatttggcgtcgatcagctgacggatgaggaaattgccgatcttgaatcccaggccgacaccaactgggaagacgctattgcgaattatgaggcctatttctatcctgacctgaccgaggaaagcagcgaggaagaaaaggccgccgcgcgcgaagaggccatcaactattacaaggatcagggctacactcttgaaagcctgcgtgaggaatataagcgctacggcgtgctcaacaagatcgccgacgtcatggtgcaggacgccacggtgaccgatcaggaagtggaggatctgtaccagtcgctggtcgcggctgacaaggagctctacgaaaacgacatcgccgcctatgaagcctacaacagctatgtggatcagatggcgatgtatgccgccctctacggcaccagcagcaatctggaccatgcctggtacaaacccgacggcttccgcgcggtcaagcacattctcctgcccgtggactccgagctgatgaccacctataccgatctccaggcgcgttgggaagagcagcaggaggccgctcaggccgctgaggagagcgccggtgaagcggctgaaaccaccaccgacaccgctgccaccgaagcgaccgccgagcccaccgccacgcccgaacccgtgaccgaggagcaggtgaacgaagccaaggccgccatcttcaattccctggcggacaccatcgacgaaatcaaccagaagatcgccgacggcgccgactttgacgagctgatcgccacctatggcgtcaacgaggacggtaccgcctccgaccccggcatgaccaccgagccctacatgaccagcggctatgaggtgtgcagtgcctcgaccgcctatgtgcctgaatttgttgaggcagccatgagcattgacaacgtgggcggcgtctccgctccctacctgagcagctatggcgtccatatcgtcaagtatatcggcgatgtggaaggcggccccatccccatgaccgacgagcagcgcgaagccaagcggcagagcctgctgaccagcaagcaaaacgagctgtataccgctacgctggaaaactggatggcggaagccgatatcacctacaccggcttgacccccagcattgcggagcttgaggtcacgcagacccaggataccgccaccgcctctacggaggcggaagcccagacggcagaggaaaccgccgctcccgaagccacggaagcgccggccgcctga

SEQ ID NO: 893 - DNA, 1146 bp, Unknown
  Artificiall/Consensus sequence
atgaacgaatcaatggcacagacctgcgcagggcgcacggccgtggtcatccccgcctacaagccggatgaccgcctgcccccctatgtacaagcgctgaaggacgctggcatcggcagaatcgtcgtcgtggacgatggcagcggtcaggactaccaacggttctttgatcaaattccccgggacggggtgagccatgtcatcagctaccagcccaactgtggcaaaggagtggcgctcaagcgcggtatggcctggcttatggacaacagccccgatcaggacatcatcgtgacggccgacagcgatggacagcacaccgtggaggatgtgctgcgcatggcccaggacctggcgcgcgacccctccgggctgctcctgggcagccgggacttttcccaggagcatgtgcctcccaagagccggatgggcaaccgcatcacctcggtggtgttcaagctgctctacggatgctgggtgggcgatacgcagacgggcttgcgcggcttccaccgcgacctgctgcccgccatgatcgccgtgcccggtgatcgctacgagtatgaaatgaacgtgctcatcgagtgcgcagccatgaaggtgcccatgcgccccctgcccatcgaaaccgtgtatgaaaacaacaatgagggaagccatttccgcgccttccgtgacagcgcgcgcatctatcgcgtgatcttcagcggcttctttcgctttgtgggcacgtcgatggtcagctttttggtcgactatggcctctatctgttgtttaacaacctgctcaaatacttcggcacctccctggaccaggaagtcggcgtgctgttcattcgggtggtgccccatatcctgatcgccaccgtggccgcgcgcctgttgtcgggggttaccaatttctttttgaaccgcagcttcgtttttaccgataagggcaaggtgagccaggcgttcctgcgctatctgggcgtgtttttcctggtgatgctgctctccgctttgctgaccagcagcctgcatctgtggctgggctggagcgataacaccgccaagattccggtggacatcgtgctgttttttgtcagctaccacctgcaacgccgctgggtatttcaaaaaaagcccgcgaaggcgggctcaggc

SEQ ID NO: 894 - DNA, 1023 bp, Unknown
  Artificiall/Consensus sequence
atgatccgacgtaccgcctgcctgatcgcccttggaggcgaaccctatcgcaacctggccattgagaagcacctgatggacacgcttccggaggatacggccatcctctatctgtggcagaacgaccgctgcatttccatcggccggtgtcagaacccgctgtatgagtgccgggtcgacccctttttaagcgcaggcgggcatattgcccggcggctgagtggcggcggagcggtctatcaggaccggggcgccctcaatttcagctttatccttcccaaaacggcgtttgacatccaccatcagctcagcattctggggatggcggccggtgcgttcgggattcagtcgcgggccatgggccggggcgacctgtttgcagcgggccgccgcttcagcgtcaacgcatatttcaaggctggttcggcggcgctgcatcacggcacgctgtatgtggataccgctctggaccaaatggcacagtttctgtcagcaggaggcggagatcttgccgcccccaatcctccggacacggcggcacatacgatcaacctgcgcacgctgaaccccgccatcaccgtcgaagagctggagcaggctctctactgggcctttgcccgtgcctatggcgcgcaacccgcctggctggacgaacggattctggacggccgttccatcgccgcgctcacccttcggttctccgatccaaaatggatttatcccgaggcaatggcctccaccttcagcgtgtcggagcgctttccctgggggcaggtcacggtcaagctcaaggtggacggcggagtcatccgcgctgcccgtgtgtttacggatgccatggaggccccgctcttcggtctgatcgagcagtccctgaccggttcgccctatttgatcagcgccatttccggcagaatggaccagcgtctggaaatgctgagcgatccgcgtctgatccagctcgccggcgatgtcaccaatctcatctgcgggcgtattcgctcgttggaccggcagggctga

SEQ ID NO: 895 - DNA, 1638 bp, Unknown
  Artificiall/Consensus sequence
atggaagtgacgacggttttttcattgctgggcggcctggggttgtttctgtttggcatcaagacgatgggcgatggtctggaacaggcggccggcagcaagatgaagcgcctgctggaggcgctgacccgcaacaagctgacggccgtgctggtgggcctgctggtcacggcggtgattcagtcctccagcgccaccacggtgatggtggtgggttttgtcaacgcggggctgctgtccctgagcaaggccatcggggtcatcatgggcgccaatatcggcaccaccgtgacctccctgatgctgtcggtcaaactgaattttggcgtcctgtttaccgccgtaggcgcgatttgccagctggcgggcaaccggtccagcttcaagctgtttggacagatcatgatggggctgggcattttgtttgtgggcatggacgccatgaccgcggccatggaacccctgcaggagtggcagggcttccgcgacatgatggaatgggccaggaacccatttgtgggcgtgctggtgggcgcgggcgtaacggcgcttctgcagagcagctcggccagcgtgggcatcttgcaggcactggcggccacgggggcgatcagcctgcaggcgtcgctgtttatcctcttcggccagaacatcggaacctgcgtgaccgcgctgatggccagcgtgggcgccaaccgcacggccaagcgcgccgcggtggtgcatctgctctttaacatcattggcgcggccctgttcatcatcatcgcgctggcgctacccctggcttcgtggatcgagatgctggcgggggccaacctgcggttgcagatcgcctttgcgcacatcatcttcaacgtggtgaccacgctgctcttgctgccgctcagcggccttttggaaaaactggcgtacctggtggtacgcggagaggacaagcaggaggagcccatgcggctggaatacttcgacacgcgcctgttttccacgccgccggtggccgtgcagcagctgtttcgcgaggtgcagcgcatggcggatatcgtcaccgccaactaccgctttgccatgcagtattactttgcgcccaaggatctgtccgtggacgagtttgacaacaacgagcaggtgatcgactacctcaacgccgaaatcacccagaacctgattgagctcaagggcctgaacctgcgcagcgaagatatccggctggtaggttcgctgtttcatgtggtcaacgatctggagcgcatcggcgaccacagcatgaacatcgtggaaatcggttcggcgcgcaaaaaggagaagctgcgcttttccggcaaggcggagcgcgagatcgaggagctcagcggcatcgtgaccagcatgctggacaagagcatccacatcgtcaggcagcagatcaccgatgtggagatcatcggcgaggtgatcgagctggaaagccaggtggacaagctgtgcgaaacgctggcggatcaccatgtcgagcgcgtcaaaaataaaaagtgcacgccgagaaacggcatgctttatctggatatgctcaacaacctggaacgcatcgcggaccatgcggacaatctggcctcgtcggtggaaccggaccaccacgacaatcgccttctttggtag

SEQ ID NO: 896 - DNA, 1731 bp, Unknown
  Artificiall/Consensus sequence
atgctgatgaccccctggggagaacacctggacgaaaactgcatcctcaccgaatatccccgcccgcagatgcggcgggacagctacctcaacctcaacggccgctgggaatacgccatcaccgacagtgatgaatcaccccggcactgggatgggaccattctggtgcccttttcgcccgaaagcgccctgagcggcgtgggccgttcgctccagccggggcagacgctatggtaccgccgcgaggtgatcttgccgcagggcttcatcccggcggatgggcggctgctgctacatttcggcgcggtcgatcaggaggccgccgtgtattggaacggcaggctgctgggccggcacatggggggctacaacgcgtttacgctcgacgcgacggatgcgctcggcccgcgcaacagcctcgtggtgcgcgtacatgatgatacggacgcgagcttccacagccggggaaagcagaaaacccggcgcggcgggatctggtacacgccgcagagcggcatctggcagacggtgtggatggaggccgtgccccggcactatatcgagagcctgcgcatcgtgccgctgtttgaccagtcggcggtggaggtgatggttcgctgttcgcagcccctgcaatgcgaagcgaccgtggatggccgtaccgtgcccttcaccagcggcgagccggcgcgcatccccatgccggattttcgtgcctggagtccggaggacccctatctctacgatctgtccgtcactttgggcgaggaccgggtggagagctacttcggcatgcgcaagatggaggtgcgcgcggaccggggcggcgtgaagcgcctgttcctcaacggcgaaccgtattttcagagcggcctgctggatcagggatactggcccgacggcctgtataccgcccccagcgacgaagcgctcatctacgatatccagactgccaaggccatgggctttaacctgctgcgaaaacacatcaaggtcgaacccatgcgctggtactaccattgcgaccgcctgggcatgctggtatggcaggacatgccctccggtggaggaaaataccgcttctcaaccatcaccctgccgctggtgaccggcattcatcggcgtgacaatcattaccgggcgtttgcgcgcgcctcttcccagggacgcggcgagtacattgatgagctggaagagatggtcggccagctcttcaatgcgcccagcgtggtgctgtgggtgccgttcaacgaaggatggggtcagtttgacagcacgcttgtgatggagcgcctgcgcgctctggaccctacccgccccgtggaccccgccagcggctggcacgatcagggcgcgggagaactgcgcagcctgcatgtgtatttcaagcccttccgcttccggcgcgaccggcgcggccgcgcgctggcgctgagcgaatttgggggctataacctgcgtgtggatggtcattgcttcaaccagaaggactacgggtatcgccgtctgcccgatgccgccgcgctatggcgggacttttcccgcctctatgaacgcgaggtgccccccgccgtgccgaaggggctgtgcgcatcggtctatacgcagctcagcgatgtggaggatgagctcaacggcctgatgacctacgaccggcgcgtggtcaagctggatgcggacgaggtgcgggaactcaatgagcggctgaaggaagcgtcgcccagaacgtga

SEQ ID NO: 897 - DNA, 2175 bp, Unknown
  Artificiall/Consensus sequence
atgcacatgcgctttacccctgcgcaggaagccgccatccaggccggcaaccgcgaactgctggtatcggctgcggcgggcagtggaaaaacggccgtgctggtggagcgcatcgtgcgcctgattgtggagtgtggcgccagcatcgaccggatgctgatcgtcacctttacgcgcgccgccgcgggtgagatgcgcgaacgcctggaagcacgcctcaatgaggccgccgcgggcgattcgcgcctggtccgccaggctgacctggtcagcaccgcgcaaatctccacaattcatagttattgccagcaggtggtgcggcagaacttccagcgctgcggcgtagacccgcaattcatgctggcggatgagcgtacccgcgccggttactggcatgatgcaatggaagaaacgctggagtggctgtacgaggcagcccatgaggacgaagagctcgcagcgctgacgcacaaattcagcgagcgcgagatcacgctcatgatggagacactttaccggtttctgatgtcacgccccgacccgatgacctggctggaggagagcgcagccaaggagtggaatgccgattccatggacagtgagccgctggcccaggcgttctgccgggaagctgcgctgattctggaaggaatggacgccctctggcggcaggcggacgcgatgcgtgcaaatccggcgtttcccccgccctatgtgcggaccctgcaaagcgacaggggaagcctcgatgggctgcgaacggcctgtgataaagggatgagcgccctgtgcggggcgctgggaaccctgaagtttgccaccctggggcgcttcaagcccgcgaccggagacgaggaacgcctggcgggggactttaaggatctgcgtaaccggatcaaggacctggcggatgacctgaaaaagctgctgcccgcggattttgaacagggcgtggcggatatgcaggccatggggccggccacgcgtgggctggccaaagcggtgcgccgctttcacgaccgctttcaggcgcgaaagctcagcgaggcatgcatcgatttcggcgatcttgaacatatgacgttggccgtgctgcgcgatccggacctgcgcggccagcaggcacagcggttcgatgcggtgttcgtggacgagtatcaggacgtgagcgccctgcaggaggccatcctcaacgcccttaagcgcggcgagggccagacctatttttatgtgggcgatgtaaagcagagcatttaccggttccgcctggcagagccgggcctgttcctgggcaagctgcaacgcttttcgccacgggaggacgcaccatgccgccgggtggtgctgaacctgaatttccgcagccggaccggggtgctggatgcggtgaaccgcgtgttctcgcacgtgatggaccgccgtgtcacggaaattgactatgatgccgacgcaaggctgtatcccggcgtaccctccgagggagacccggcaaccgaactgcacgtgctcaacgcccaggggcggaggccgcaggatatggtcctggccgaggcggaactcatcgcgcgcgacatcctcgcaacggtgggcgagccggtccccgacgctcagggacgccccggcgcgcctctccactatcgtgacatcgccattctcctgcccgtgggcaagaacgtggccgacaaggtggagctggtgctcggccgtatgggcattcccgtgtactgcgaaggcggcggcgaccccatgacgtccgacgaggtggatcaggtgcttcagcacctgacactgctggataatctggccaatgacgtggcgctgctcagcgagctgcgcagcccgctctttgagctttcggagcgagagctggcagccatccggctgctgcgtcctcagcgggaggccagcttcctcagcgcgctgcaggcggcggcccacgaggccggcgcgcctcttgacgcgcgttgccgcgccgtgctggacgcgctggaggccgaacggttttatgcgcgcagcatgccgctggccgaatacctgtggagttttctcaagcgcagcggactttatgcacattacggcgcacagcctggcggaaagctgcggcaggcaaatctgcgcatgctctgtcaccgggccgatgcctatgagcagagccacacggacggcctgcatgga

SEQ ID NO: 898 - DNA, 1971 bp, Unknown
  Artificiall/Consensus sequence
atgcgtaaaggattcttcccacggctggccctcagcggcatccgtaaaaaccgcagcatttactatccctatattctcaccgctgtgctcaccacggccatgatgtacatcatcggctccctgcagcagatcagcaccgactattcgggcaccctggccttttccctgcagctgggtattgtggtgacctccgttttcagcgttgtgtttctgttctacaccaacagctttcttatgcgccggcgcaaaaaggagttcggcctgtataacattctgggcatggaaaagcggcacctgggccgcctcattttctgggaaacggcgatgatgctggcggtcagcctcacgattggactggccgcgggcgtgcttctggacaagctgatgcacctggtgctctcgcgcctggtaggacaggccgtctcgctcacatttgccgtatcgcccggttccatgcgctacaccgccgcgttgatcagcatcacgttcgccctgattctgctcaactccgtgcgtcaggtctacgtcgcccgtcccgtagagctcttgcgcagcgctgaggtgggcgagcgcgagcccaaggcccgctggctgctgggcctgctggggctgatttcgctgggcacgggctactggctcagtgcaaccgtcaaggacgcgggcatgatgattctgttctttttcgtggcggtgctgctggtgatcgcgggcacctacctgctgttcacctccggcagcatcacgctgctcaaggctctgcgcaaaaaccggcgttactattacaagccggaccacttcatcagcgtatccggcatgatttaccgcatgaagcaaaacgccgtaggccttgccaacgtgtgcatcctgtccaccatggtgctggtgatggtgttttcgacgctttccctgtggctgggcatggaggacaccctcaacagccgcctgcgttcggacatcgatgtgcggtccgcctccacggatgtgtccgcactggaggccgccgtggatgagacgctccggcaggcgggcgcctcacgagaggacacctggacctaccgctacctctccttctcggccctgcccacccccgagggctttgtcagcagcgtttccttcaccgaaagcgacgccctcattgccagccccgccaccttccaggtgatggtcgtggaggactataaccgcatgctgggccgaagcgagacccttgcgcccggcgaggcgctgctggaatgtacccgcggaaactatgagggcgataccctgcgcctgctggacgaaacctttgccatcaaagcgcgcatttccgacggtctgggtgcggggcaggcgctggccagcatttacgattactactgcctggtggtggacagcatggacaccctgcgccgtctggacagtgaacaacaggcggcctatggggatcgcgcctccgccatccgcacttccatgagctttgcgctccttcctgcctcaccgcagctatcggagcaggtggccgcgcttctgcgcagccaggcggatgcggacggcttcacaagcgtggccgagcgcacggagcttcgtgaaaacctcatgacgctgtatggcggcctgctgtttgtggggctgttcctgggactcctgttcaccatggccatgatcctcatcatctactacaaacagatcaccgaaggctatgaggaccgggagcgctaccgcatcatgcgcaaggtgggcctgagccgccgggagatccgccgctccatctcctcgcagattctgatcgtctttttcctgcccctggcggcggcagggctgcacgtagccttcgcctttcccggcatcgtcaccatgtttcgcgcactcagcatgaccaacgtcacgctgatcgccggctgtgcactgggcagctttgcgggcttcgcagcgctctatggcgctgtgtacctgctaacggcccgcgtgtactaccgcatcgtcagcgaatga

SEQ ID NO: 899 - DNA, 1380 bp, Unknown
  Artificiall/Consensus sequence
atgaagcattggaacatcagtttgcctcggacccccgcgctggcgctggcccggcagatgctggaaggctgtctgaggacctatgacgtgcccatggagggcgcggaggacgcctgccgcatcaccggcgctgtggtgccggacgcggccctgccgccggagggctaccgcatgcgcatctgcatggagggatcgttgcagtctgttgaaatcacgggggcaacggacgtatccgtgctctatggcgtatcggatttcgtcaatctcgtagtgccaaaggcagagcaggcccatacgtggatgaagccctattacttccgcaatccctttgaagaggggtttgagaacatggactgcgtgcacgcgcctcaggtgcgccgacgcggcctgtggacatggggttatgtcatttacgattaccggcgctacctggccaacatggcccgcctgaagctgaacgaaatcgtcatctggaacgattacgcaccccttaacgccgctgaggtggtggcctgcgcgcacgacttgggcatccgggtcatctggggatatgcctggggatgggacaccaaaattgatgttcgcctttccgacgaaaccctcctcgcccgcctggcagacgaggccgtcgagcgctttgaacgtgaatatgcggcccttccgggggatggcatctacttccagagctttaccgaaaccgccgagcaggagctggacggccgctccatcgccgatgtggtggtcccgtgggtcaatggcatttgtgcccgcatccttgaaaagaggccaaacctggaattgcagttcggcctgcatgccacctcggtggcgcaaaagctggaccgaattgctcaaattgacccgcgggtacggattgtgtgggaggattgcggcgcgtttccctacgcctatctggccgagaacgtggcccatgcccgggagaccgaggattttacccgcaagttttcgcacctgcgcgagcatggcgctacaggcgtggtgaccaagggcatgatttgcctggactggaccgacttcgtacaccgggcggggcccgaacgcatcggcgaatgcagcgccggggaaatcgccgcacgcctccccatcgcgcgcagggtcatgcgccttacgcagagctactggatgcaaaacggggctcacctgcaaagcattgtaaacctgcttttgcagggggacccggaatgccagatcctcgcgctgatggaggatggtctgtttgaaacgtcgatctggcttccgacggcactgtttgccgccaccctctgggatagccggactccctttcctcaactgctcacggaaaccgcgcagcggcccgatgtggtctttgccaacgcaccacaggctgatacggtatga

SEQ ID NO: 900 - DNA, 2124 bp, Unknown
  Artificiall/Consensus sequence
atggcgacgactgcacaaaaactggtgatcgtggaatcgcccgcgaaggccaagacgattgaaaaatttttgggcaagggttatcacgtggaggcctcgcagggccatgtgcgcgatctgcccaaatctcagctgggtgtggacgcggatcatgattttgaaatgaaatacatcaccatccggggccggggcaacatcctggcgcggatcaaaaaggaagccaaaaacgcgtcccgcgtctatctggcaaccgaccctgaccgcgagggagaagccatctcctggcacctggcgcacaccctgaatctggaccccaccaagccctgccgcatcgagtttcacgaaatcaccaagaaggcggtcaaggatgcgctggagcacccgcggcccatcgacatggcgcgcgtggacgcgcagcaggcgcgccgcgccctggaccggctggtgggctacaagatcagcccgcttctgtgggcgaaggtgaaaaagggcctgtctgccggccgcgtgcagagcgtcgctacgcggttggtggtggagcgtgagcaggaaatcgaagcgtttattcccgaggagttctgggatgtgaacgcgcgctttgaagcccagaacgccaaggggaaaaagatgacctgcgaggcccgtctggtctcccttgacggggaaaaggctcagatcggaaacgaaaaggacgcgctcgcggccaaggagcgcattctcaaaaccgctttcaaggtccagtccgtcaaaatgggcgaaaagctcaaaagggcgcagccgcccttcaccacctccagtctgcagcaggaggccagccgcaagctcaatttctcgaccgccaaaaccatgcaggtggtgcagcagctctatgagggcatcgatctgggcaaggcaggcacggtgggtctggtcacctacatccgcaccgacagcgtgcgcgtgtcggccgaggccgtggaggctgcgcgcggatttatctgcgcccagtatggtgaggagtactgccctgagacgcccaaccagtacaagggacgcaaaaacgcgcaggacgcccacgaggccatccgtcccacctacatggagcatacgcccgacagcgtcaagccctttttgagccgggaacagcacaacctctaccgcctcatctatgcccgcttcctggccagccagatgaagcccgctgtattccagaccatgacggcggatatcgtgggcgatggggtggacatgcgctactacggcgagcatatgattttcagcggctaccgtgctgtctatgtcgagggcacggatgatgagcaggagacccctgaaagcatcctgccggtgctcaaagaaggcagcgatatggcctttgtcgaggtggacgcggtgcagcatttcacccagccgcccgcccgttataccgaggccagcctggtgaaaaccctggaggaaaagggcattggccgccccagcacctatgcgcccaccatcaccaccatcatttcgcgcggctatgtcacccgggagaaaaagcgcctgtatcctaccgaactgggacgcatggtcaccagcatgatgacggaatacttcggcccgatcgtggatacgcagtttaccgcctcgctggaggataagctggatgccgtggaagagggcaaaaccgagtggcggcagatcctgcgcgatttttatccgccctttgaaaagatgcttggcgtggctgaggaacagattgagaaggttgaggtcaaggatgaggtcagcaacgtgccctgcgaaaaatgtggcgcgatgatggtctataaaatggggcgcttcggaaaattcctggcctgtcccaattttccggcctgccgcaacgccaagcccatcgtccattacattgacgcgccctgccccaagtgcggcgcgcggctgatggaaaagaccagcaagaagaaccgcaggttctacggctgcgaaaactatccggattgtgattttgtcagctgggaaaagcccatcgtggaccgctgtcccaaatgcggcagctatatggtggaaaagcccggcaagcggggtgaggtggtgcacctgtgcgccaacgaaacctgccgctacaaaacatccgtccccaagcccgaggaggatgaggactga

SEQ ID NO: 901 - DNA, 1620 bp, Unknown
  Artificiall/Consensus sequence
atgaatctggcaacgccgctccttcgctggctcacgctgctttctccggtgtgctgctgcctgtttgccgcacgcggaatcctgcatttttttcagctggaaagctatcagtttccgggatattttcgttcgctcaagcgcaaccgggttcacagcctgctgccgggtctgtgtgtaacggtgaccgtgctggtcctgctgtacgggtttgatgtgctggcgctgcgcggagaagcccggtggaccgggattcttgcggcagtgctgcttctgcccctgtcggcaggtgctggcctggtgattggcagagcgttttcgccgcgccgcgccaaaaagaaatttgtgattaccggccgggtcaaacggctgtatgtggtcttttttttggtgatgacgggcatcagcgcgctgtgtgccgctacgccctgggcggttctgcctgcgctgtggccgctggcgctgccgctggtggtggccctgagcggccttttggcctggccgattgaaaaggcgatcagcgaatgctatttccgcgacgcgcgccggaagctgctttccaatcccagactggtgcgcatcggcattacgggcagctatggcaaaacgtcggtcaaacacattctgggcgccatcctgagcgaaaaatatcccacacttattacgcctgccagcttcaatacgcccatgggcgtgacccgtgccatccgggagaagctcacgccctcccatcaggtgtttgtgggggaaatgggcgcgcggcatgtgggggacatcaaggagatgtgccggctggtacatcccaccatcggcatcattacctcggtgggaccgcagcacctggaaaccttcaaaaccattgaacgcgttgcatccaccaagtacgagctgatcgaggccctgccagcggaggggtcccacgcctatttctatgacgacggcgcctatgtacggaagatgtacgaccgtacgcagaagcccaagacgctttgcggccgggaccccgccacctgtgattgctggtgtgacgaggtgagcgtatccgcggagggcagccgattcatgctgcatatccgcggagcaggcagcgtagagtgtcatacccggctgctgggcgagcataacatccagaatattcttctggccgcggctgtcgcctccgatctggggctcacgctgcgccagatcgcccatggcgtggagaaactggctcccatcaaacaccgtctggagctgctcagccatcccggcaacttcaccatcatcaacgacgccttcaattccaatcccgtgggcgcaaaggccgcgctggaggtgctcagggcctttcctgcgcgccgcatcatcatcacccccggcatggtggagctgggcgagcgcgaagcggaatacaaccgcgaatttggccgggagatggcggcctgtgtggatatcgccatcatcgtgggcaaaaaccgcgccctgcccatcattgaggggctgaaggaggccgggttcccggaagggaatattcatcgcgtggacagcctggatgattccacccgcctgcttcacagcctggtccgtcccacggatacggttctgtatgaaaacgaccttcccgatcactatcaggaagcctga

SEQ ID NO: 902 - DNA, 1548 bp, Unknown
  Artificiall/Consensus sequence
atgcaaaaaaccatgacggcccttatcatcatggacggtttcggcatcaaccccgctcatgagggcaatgcgatctatcagcagggcacgcccaggctggacgcgctcatggcccgctatccgcacaccaaactgggtgcaagcggtatggacgtgggcctgcctgatggccagatgggcaacagcgaggttggccacctcaacatcggtgcgggccgtatcgtctatcaggagctgacccgtatcaccaaggacattcaggacgggacgttctttgaaaaggcgccgctgattcatgccatggacacggccaaggaaaccggaaagagcgttcatctgatgggcctggtcagcgatggcggcgtgcatagccacattacgcatctgtatgccctcttggagatgtgcaagcgccgcggcgtggagaaggtctatgtgcattgcttcctggatgggcgcgatgtgccgcccaccagcggcatcgactatgtgcgcgagcttcaggccaagatggacgagatcggcgtgggcaagatcgccacggtgatgggccgttactgggcgatggaccgcgacaacctgtgggatcgcgtgcagaaggcctatgatgccatggtgctgggccagggccaggcgacggcggaaactgccgtgcaggccgtggagcagagctatgccaaggaggagacggacgagttcgtcaagccgaccgttgtgctggaaaacggtcagcccgtggccacgatcggcgagggggacagcgtgatcttctttaacttccgccccgaccgtgcccgccagctcacccgcaccttcattcagcctgacttcaacggcttcccgcgcggaaagggctatttccatgtcaactttgtcagcatgacgcagtatgacgagacctttaccggtctggaggtagtcaatccgcccgaaacgctgaagaacaccctgggcgagtacctctccaagctgggcaagacgcagctgcgcattgcggaaacccagaagtacgcccatgttaccttcttctttaacggcggcgtggaaaagcccaacgagggcgaggaccgcgtgctgattccctcctccaaggtggctacctttgacatgaagcccgagatgtccgcctacgagatcacggacaaggcgattgagctcatcaatgaaaagaagtacgacgtgatgattctcaacttcgccaactgcgacatggtgggccataccggcgtgatggaggcggccatgaaggctgtcgccgccgtggacgagtgcgtggaccgcgtggtcaaggccgttctggacaacggcgggcgtgctttcgtcacggccgatcacggcaacgcggaccagatggtcgaccccgaaacgggagagcccttcaccgctcacaccaccaaccccgtgcccttcattgcgatcggaccggaaatggtgggcaagaagctgcgcgaaggcggtcgcctggccgatatcgcgcccacgatgctggacagcatggggattcccgtacctgccgagatgacgggtaaatcgctcatcgtgaaatga

SEQ ID NO: 903 - DNA, 2622 bp, Unknown
  Artificiall/Consensus sequence
atgaccaatcaacagtttacggagaaaagccgcgaggcgctggccgccgcgcagcagttaaccattgaataccagaatcaggaggttacccaggagcatctggcttacgcgcttctttcggacgcgcaggggctgatcccgcagcttttgaccaagatgggcaagcggccgcaggagatcgcttcccgcctggagacgatgattgctcgcctgcccaaggtgacgggcggcggacgggaacccgacaaaatctatatttccaatgatgtggaaaaggcattggtcgcggcgcgtgacctcgcgcagcgaatgaaggatgaatatctgagcgttgagcaccttttcctgggtctgttggagaagcctacgcgcgccatggctgacctgtggcgtgggtatgcgatcgacgaaaagagctttttgcccgccttgcagagcgtgcgcggcaatgcgcgcgtcagcagtgagaacccggaggaaacctatgacgcgctggccaagtatggccaggatctgactgcggaggcccgcaatcagaagctggaccccgtaattggccgtgacaacgaaattcgcagcgttatccgcattcttacccgtaagaccaagaataaccctgtgctgatcggtgagcccggcgtgggcaaaacggccattgccgagggactggcccagcgcattgtgcgcggcgacgtgcctgattccctgaaagaccgcacggtattctgcctggatatgggcagcctgatcgctggcgcgaagtaccgtggcgaatttgaagagcgtctcaaggcggtgctggccgagatcaaaaagagcgaaggtaagattctgctcttcatcgacgagcttcataccattgtgggcgctggcaagaccgaaggctccatggacgcgggcaacctgctcaagcccatgctggcccgcggtgagcttcacctcatcggtgcgaccacactggacgaataccgcaaatacatcgaaaaggatgccgctttggagcgtcgtttccagcccgtgctggtgaccgaacccaccgtggccgataccatctccatcctgcgtggtcttaaggagcgttatgaagtgttccacggcgtaaaaatcaccgacggtgcgctgatcgccgcggctacgctgtccaaccgttacattaccgaccgtttcctgcccgataaggccatcgacctggtggatgaggcctgcgccatgatccgcacggagattgactcgatgcctgccgagctggacgaggtcaggcgccggatcatgcagctggaaattgagcaggccgcactcaaaaaggaagaggacgaggccagccaccgccgtctgggaatcctggagaaagaacttgctcagcagcgtgaaactttcaatgccatgaaggcccgttgggagaacgaaaagaccgctattcagaaggtgcagaagctgcgcgagcagatcgagcaggtgaacgccgacatccagaaggccgagcacgcctatgatctgggcaaagcggccgagctgaaatatggcaagctgcccagcctcaagagcgagctggccaaggaggaggagatcgccgagcatgagcgtggagacgaaagcctgctgcgcgacaaagtgaccgaggacgagatcgcccgtattgtcagccgctggaccggcattcccgtgaccaagctcaaggaaggcgaacgcgagaagctgcttcagctccctcaggagctgcaccgccgcgtgatcggacaggacgaggccgtacagaaggtttctgaagccatcctgcgcagccgtgccggtatatcggatgaaacccgccccattggctccttcctgttcctgggcccgacaggcgtaggcaagacggagctggccaaggcgctggcccaaagcctgttcgacgatgagaagaacatggtgcgtatcgatatgagcgagtacatggagaaattctccgtcagccgtctggtcggcgcacctccgggatacgtgggttatgaggaaggcggccagctcactgaggccgtgcggcgcaaaccctattgcgtcgtgcttctggacgaggtggaaaaggcgcatcccgatgtgttcaatattctgcttcaggtgctggatgacggccgcatcaccgacagccagggccgcacggtggatttcaagaacaccatcatcatcatgacctccaacctcggcagccagtatctgctggatggtatcgaaaacgggcagattacccagagcgcgcgcgacagcgtgatgcagctgcttcgtacccagttccgtccggagttcctcaaccgtatcgacgacatcgtgttctataagcccctggaaaaggacgagatcgctcagatcgttcgtctgctggcgggtcatctggccagccgtctgcatgagaagaacatcgatctggtgctttccgacgcggcggtgaacgccatcgcggaggcggggttcgatccggtctatggtgcgcgtccgctcaagcgctatatgcagagccatctggaaaccatgctggcccgtaagatcgtcgccggcgacgtgctgcccgggcagaccgtccgggtggacgtggacgcaaacggcgagcttacagtctcggcggaaaacatggccatgcagccgtaa

SEQ ID NO: 904 - DNA, 1194 bp, Unknown
  Artificiall/Consensus sequence
atgaaggacagaagcattcgcacattcacccgtctggccgccctgacggtggccctgttgctgttggtatcctgcgccgcggcagaagcggtcgataccaaaaccgcggacccctacatcgagctgagcacgcagtatcccgccatgaccgtaaaggcgggcgacagcctgacctttgccctgagcctggacaactacagcggcgcttcgcaggaccttaccctatcggtggaggaaatcccggagggctgggagggctccttcagtgcgagcagcaaccaggtgagcgtggtccatgtgaaaaatgagcagaccgatgactccgtgaccttcgcggtggatgtgccgctggatgccgccgacggggattacaccatccggctgaaggcgcagggccagaacatcgcggacacgatggaccttgccctgaccgtgagcgccgaagaaatcggcgagagcagcttcacggcggaatatccttctcaggagggcgacgcggacacggccttcaccttcagcgccactttgatcaacaacacgctttccagccagacctactcctttacggccaacgcccccacgggctggcaggtgagcttcctgccgtcgggcgagaccaccaaggtagccgcactggacgttgaggcgcgcaccacgcaggcggtggacatctccgtgacgccgcccgaaaacatcgaggcgggcacctatgagattccctgcaccgccacctcggtcaatgaaaccatgaccatcgacctgtcggtcaccatcaccggttcttatgcgatgtccctttcgactcccagcggacggctgagtctggacgcctacgccaatcaggaaagcgccgtgcagctgagcctgaccaacaccggcaacagcgacctgaccaacgtcaacctcacctccagcgcgcccagcggctggaatgtgcgcttctccacggaaaccatcgacgtgatcgagccgggcgccacggtggaaaccaccgcttacatcacccccggcgaagaggccatgtccggcgattacgtgaccaccctcaccgccagcagcagcgatgccagcgacagcgccgagttccgcatcaccgtcaagaccgaaaccaagtggggtctgacgggcatcggcatcatcgtggtgctggcagtggtgattatcctggtcatgcggaaatacgggaggcgctga

SEQ ID NO: 905 - DNA, 921 bp, Unknown
  Artificiall/Consensus sequence
atggcgcagagccacgtatccatcgccgcggcagggaagcggcgcaggcgaagcgcgcgcaggctgatgcggcgcgtgcgtagggccaggcccgtaagctgcctgattttgacgctgatcgcggtcatcatgctcattcccatcgtattcacgtttttatactcctttttccccaagagtgagatatcgtcctatctggcccagcgcggcagctatgaccagagccggtggatggacatcctcttttcgcccgcgcaggtcagcctgaggcagtactacaccattttgattgaagagccgcagtatctgcaattgttctgcaacagcgtgctgtatgccggagccattctggtggggcaggcgttggtgattccacttacggcctatgccctcagccgcttccagttccgcgggcgcgacgcgctgttctttctggtgctggtgctgatggtgctgcccttccaggtaaccatggcgcccagcgtgatgacccttcgggccctggggctgctggatacgatttgggcggtgattttgcccatgatcttttcgcccttttatctgtttttggtgcgccagttcatgatcggcatccccggcgaaatcatcgaggccggccagatggacggcgcgggcacgctgcgctgctttgtgcatgtgatgctgccggtgtgccgccccatcctgtgtgcggcggcggcgctgagctttgccgacagctggaacatggttgagcagccgctcatttacctgaccaatcagagcatgcagccgctgtcggtcatgttcaaccagatcaacaccgattctaccggcgtagcgtttgcgggcgcggcgctgtaccttctgcccatgctgctgatctacatctacttccaggacgatatcctcctgggcgtgcagctaagcgagctgaaataa

SEQ ID NO: 906 - DNA, 2844 bp, Unknown
  Artificiall/Consensus sequence
atggcaaagagcaaaaaagccgtcgcacaatatgaatcgggtacgctggcggcgttcgcggtggcgggcatcctgctcatcgcgctgggcgtggtatcgctcctggcggtggtgggcgggctgaagggcacgcttttctccatggtgaagcgcgtcatgcagggcctgggcggcggactttgcctgggcgtgagcgtgatgctgatctgggcgggggtgctggtggcattttcctccggccgcagtatgcccaagcggggatttttgctctttacgctgctgtttttttctgttctgggcatcatcgatctggtcagccgcgtaggacaggacacgcttcccgcctacctggtcaagtataacaatcaggccgctctccccacaacggaagcgtcgggatactggaacatgatttgtgctgccttcaacgtgtgcggctccagcggagcatttggcggcgcgctgggcatggtgctgggctggccggcctggacctttctgggcacggtgctcggcacggtggcgctgggcgcggtctgtgcggcctgtgtgctgctggtttcccgttttgacatgatacagatggtggaaagcgtgcgcgacggctggcaggcacgaaggcagaatattcagcagcagcgcgcccagcgcgaataccaggagcagctggaggaccagcgccttaaggagcaggaggacgatcgccgcatgctttcgcccgctttccgccgccggggggagacgggagcccctgcacaggaagcgccggtctatccgccctatggcagcatgcttatgcagccgccgcccatgccccagggagggatgccggtctatccctatggcatgccgccggtatatcctcagccgcccgcgcagccggaaatttatgatgaattgatcattccggagggacggcagcttccctggcgcaaggccgagggaaagggcaaaaaagagaagaaagaaaagcagtatcagacccgcatgacctttactcccagtgaaatgggagcagataccacggaaaccccactgcctgatacgctgattatgtccgcgtccaagcgcaaggccatggaccgcatcgaggaaatccgccgccgcaaggcggagatcgccggcagcgtgggggaggacgggaatacggcgccgtatgccgaagtgccgccgcagatggcgcccacccctatcgtaccggtcgcgcctgcgcaggcccagcccaatccgcccgctgcgcaggagcctgcggcagctccgcaggcgtcacaaaccgtgccgcagccatcccaggcagagcccacagaggaccgcaatgcggcctataagcgccctgccggccagcccaggcctgagccgcctgccaatgagccccgtcctgtgcagcatacgccctatgcctatccgtccatcgacctgctgaacgcgcagcagcggcacgccactacggatacccgtgcccaggacacggcagatgccacccggctggaaaagacgctggagagcttcggcattccagcgcgcgtgcagcgcgtgacccatggtcccgccgtcacccgcttcgagctggggctggtatcaagcggcgtcaacgtcaagcgtatcatgagcattgccgacaatatcgctctggacatggcggccaacggcggggtgcgcatcgagattcccattcccggcaccaacctctttggcgtggaaattcccaacaaggaaattcagagcgtgtcgctggctgaggtgctcttaagccccgaaatgcaatccgccaagtcacccctggccgtggcgctgggccgcgacatcgcgggacgcgccgtcatctgcgatctggccaagatgccgcatctgctcatcgccggtcaaacgggcagcggcaaatccgtctgcatcaatgccatcatcaattccatcctgttccgctcctcgccggaagaggtgcgcatgatcatgatcgaccccaaggtggtcgagctgcaatgctacaatgtcgtgccacacctgcttatccccgtggtgagcgacccgcacaaggccgccggcgcgctgcaatgggcggtggccgaaatgctggaccgctatcacaagatgcagtccaagaacgtgcgcgagctctccgcctataacgccaagctcggccccggcgaggaaaagcttccccgcatcgtcatcattattgacgagctggccgacctcatgctcgcctgcaagaaagaagtggaagagagcatcatccgcattgcgcagctcgcgcgcgcggcaggcatccacatggttgtggccacgcagcgtcccaccgtggacgtcatcaccggcctcatcaaggccaacgtgccctcgcgcatcgcctttgcggtatcctccagcatcgacagccgtaccatcctggaccagaacggcgcggaaaagctgctgggccggggcgacatgttctacttccccacgggggccagcgcgcccatccgcgtgcagggctgcttcctgagcgacgcggagacggagcgcgtggtgggttatatcgcccagcattcgcatgtggactttgaccccaatgtaattgaggccatggagagcgacgacggcgcgggcggccccctgacggacaatgacgaagaaagcggcgcggatgaccgcctgctggaagccatcgacatggtgattaatgatggacaggccagcatcagcatgctccagcgccgcatgaagatcggctacgcccgtgcgggccgtctgatcgacgacatggctgcgcgcggcatcgtgagcaagtccgtaggcagcaagccccgcgaggtgctcatcagccgcgaggaattcgagaagatcaaggatacgctggtgtag

SEQ ID NO: 907 - DNA, 1062 bp, Unknown
  Artificiall/Consensus sequence
ttgatcgcattgtatattttgctagctatcgtgctgctgggcgtgctgattacggtccatgagtttggccatttcgcggctgcccgcctgtgcgggattcccgtaaaggagtattccatcggctttggtcccaagctcgttcagtggaaaagcaaaaagcacgaaaccgtgttttccatccggcctatccccctgggcggctactgcatgttctatggcgataccgacgacgaccccaacggcgaaaagaaagacgatccccgcaactataacaatgcccccgtatggaagcgcatgatctccgtggcggcgggcccgctgatgaacttcgtgctggcctttgtggtggctgtcggcctaatggcggcttacggcgtgacgattgccacgccattcgtatccagcgtgaccgaaggttcacctgctgccgaaagcggcctgatggcaggcgatgtatttgtcagcgtgggcgggcaggatatgaccggacgcaccgtgaccgatgtgagcgacgccatcggcagcctgggcgcagggtcggccatcgacatcaccgttttgcgggatggtgagcaaaagaccctcaccatcactccgcgttatgacgaaaccgaggaacgctggctgatcggcatcatgattcagcagggatatgaaccccttcccgcagggcaggtgattcccgccgcatgggacacctgcgtggacgcctccaccgccatggcctcggcgctgggcaagctcttcaccaccggcgaggggctcaatgaaaccagcggtccggtgggcgtggtgcagctggtagccgagcagacccggcagggcggcatggaaatcttcctgtacctgacgctgatgatctccatcaacgtggggctggtgaacctgattcccattccgggactggacggatcgcgcctggtgttcatgctgattgaggctgtgcgccgcaagcccgttgaccagaagatcgaggcgatgattcatctgggcggctatgtgttcttgctcgggtttatggcgtttttcacctttaaggacgtggtgcgcatcttccagtga

SEQ ID NO: 908 - DNA, 1455 bp, Unknown
  Artificiall/Consensus sequence
atgagcaaggcatatgaaatggtcatcggcctggaaacgcatgtggagctgcgcacgaggagcaaggtattctgcgcctgcccgaacgtattcggcacggagcccaacacgcatgtatgccccgtgtgcatgggcctgccgggggcgctgccggtgttcaacgcgcaggtgctgcgctatgcggccatggccggcatggcgctgggctgccatgtgcaccaccgcagccgcttcgaccgcaagaattacttctatcctgacctgcccaaggcgtatcagatcagccagttttaccgcccgctgtgcgaggggggagcgctgaccatccagaccagccagggagaaaaacgcgtgggcatcacccgcatccatatcgaggaggacgcaggcaagcttctgcatgacgaggcaaacggcacggcgctggacatgaaccgctgcggcgtcccgctgatcgagatcgtatccgagccggatatccgctccgctgaggaagcggtggcctacctgcgcaagctgcgggccattctcacctatacgggcgtaagcgactgccgcatgaatgagggcagcatgcgctgcgatgtgaacctgagcgtgcgcaggcccggcgaacccttcggcgtgcgcaccgagatgaagaacctcaactccttccagagcgtggagcgtgccattgaagccgagtaccggcggcaggtggaggcgctggaaacgggggagggcgtggtgcaggaaacccgccgctacgatcagaagaccggcaagaccacctccatgcgccgcaaggaaaacagcgctgattaccgctattttcccgaccccgacctgccggaaatctacctcagcgatgctgaaatggccgaaattcgcgcagccatccccgcgctgccggatgagcgccgcatgcgctatatgcagcagtacggcctgaccgcctatgcggccgagcagctgaccgccgagcgctggctggccgagtacttcgagcgggccgccggcctggcggaaagccccgtggcactgtgcaacctcattctgggcgaggtctttgcgcagatcacgctgcgggataccgcgcataccggggagcgcggcccggaggcgctgcccatcgccccggagcacctggcggcgctcagcgacatgatcggcacgggcaaggtcaacagctccaccggcaaaaaaatcctggctgcgcttttcgaccgcgatcaggaccccgtcgcctatgcgcaggcccacgacctgttcaccctgaccgatcccgcggtgctggaagcagccgcgcgggagacgctggagaagaacccggacatggtgaaaacctatctgtccggcaaaaccaccgtggaaaaggccctcatgggcaaggccatggccctcacgcgcggcaaggccgacccggaggccttgcgccgaaagctgctggaactgctgggaaagcagggataa

SEQ ID NO: 909 - DNA, 1347 bp, Unknown
  Artificiall/Consensus sequence
atgagcaccgtacacaattttcccggcggaatccatccgcacgagggaagaggcggaaaggcggctaccgccgggctgtccatcgtggaagcgccgcagccgtcgcgcgtggccatccccttgcagcagcatatcggagcaccctgcaagccgttggtaaccaaaggggatgccgtcaaaaccggccagatgatcggcgagccggtaggcgcgatgagcgcagcagtacatgcctccatctcgggtcatgtcgtcgattgccagccctgtattctggcaaacggcacccagcagatgtgcgtcatcatcgataatgattttaaggacgagtgggtgccgctgactcccgtggccaaccctgaatccatgaccgtacaggagctttccgatctggcgcggcgcatgggtatcgttggtctgggcggcgctacgttccccacggcggtgaagctcaatatacccgctggcaaaaaggtggataccctggtgctcaacggcgcggagtgcgagccgtatctgtcggccgatcaccggctgatgctggagcatgcggatcagatcatctccggcgcgcgcatcatccagaaggtgctgggcattgaacgggtgatgatcggcatcgaggacaataagcccgacgccgtggaagccatgcgcaaggcctgcgaaaaatatgccgagttcagcgttacggcgttgaaaaccaagtacccccagggcggtgaaaagcagctcgtatatgcgctgacgggccgtacggtcaaaatgggcggcctgccgctggatgtcggcgctgtggtgtgcaatgtaggcacctgtcacgcgctgtgccgcgccgcttacgagggccggccgatcgtggaccgggtggttacggtgggaggctgcgtacaaaatcccgccaactatctggtgcgcatcggcacgccggtggaatggctgctggatacctccaagggcctgttgccggaaaccaagatgctgatctacggcggccccatgatgggcatggccatcagccgtgaggatatccctgttacgaagggctgcagcggtattgtggcgctggacaagctgggcgcgctggctgacgagagtccctgcattcgctgcgcgcgctgcatgaacgcctgcccgatgcatctggctccggcggctatcgaccgcgctgtgcgcaaggacctgtttgaagccgcagaaaaactcaatgccctcaactgcatcgagtgcggcgcctgcaccttctcctgcccggccaagcgcaacctgacccagagttgtcgcgtggcaaagcgcgtcatcacacaacggcgtaaggaagccgctgcgaagaaaggagcccattga

SEQ ID NO: 910 - DNA, 1137 bp, Unknown
  Artificiall/Consensus sequence
atgcaaagagtcaaacccaaaatgagccggcggaaggcgtttctggtcctgtttctgatcctggcaggggtgggcctgctggtgtggggcggcatttcgctgttttccgtgcgggtggtcaccaatgtgacggcctcgctgctgccctgcccctacagcgataccatcatgcctttcggacagaacgtgctgtattacgacggcgtgagcattcactgcatgagcgatacggggtcggtccgctggtcgttccagatcggcgcggacgcgggatatgactgcaacgattccgtcgtggtggcctgggcgggcagcacgatctatatcctggaccagaacggcaactcgtcctacaatgacaacctgggcgaggaaatccagttcgcacgggtgggcacgcagtacgtggcggctgtgatcggcgaaaccaccagcccccgcctggtggtcaaggaccataccggcgcgcacatggacgaggaggccgacgccttcgacacgctgattcttttggacgtgggcttctacggcaagaacggcgaatacatgtggacgctggcgctggacgtgttcggcacggcggccaatacgattctcaacacctttgaggtgggcaagatgaacacgggcgaggtgtctttgggagagcctatcgcctatgccgtggtgtatgaaaacagcctgctgcgcgtgatcaacacccgcaagatgctcaccttcaacgaccgcggcacggaggatacctcggccagcgtgctggtgtacggctggcggcttctggacgcagaggtgcccgagcgcggcaacgcgctgatgctctttgcacccacctcccagacggacagcattttcgacatccgcgagctgcgcctgatctccggcagcacggacaagcgctacagcctgcccgatacctgtatcggcgcggcggtgtggaacagaacggtctatgccctcagcgccaccacgctctaccgcgccggtatcaacgacagccgctttaccacctatgaactgcccatggaaagccaggctacgcgcctggtgggcacgctcaccaacggccgcgccatcgtggcctgcggggacgaggtctacgtcatcacgcttccccaggcggtgaacacattcagatga

SEQ ID NO: 911 - DNA, 2265 bp, Unknown
  Artificiall/Consensus sequence
cagtcggccgtggggctgatgaacggcgggcaattcgacgaggcgcgggcggctttcagcgcgatgggcgattacggtgacgcgaaggagcagctggccgcgtgcgattatcaggaggccctttccctgctggagacgggcggtgtggatgcgcttgtgcaggcggaggcggactttgccgccctgggcgattatcaggacagcgcggaaaggctcaagcaggccacctatgcgctgggacaggcctatctggaagagggcagctatgaactggccgccgaccgtttcctctccctgggcgattatcaggacagcgcggagaaggtcaagcaggccacttaccagcaggcacaggcgctttacgacagcggcaactatgccgtagcacgcgtgctgttccagggcctggcggactacagcgatgccgccgaccgcgcccaggcctgcacgtatcaggagggcaaagccctctacgatgcgggcgactatgcgggggccgcagcggcgcttgctccgctgggtgaatacgaggacgcggtgcagctggtgaatcagtccaactacgccctggcggaggagaagctggcccagggactgggcgaggaagcgggccgcctgtttctggcggccggggattattccgacgcagccgcccgcggaaacgactgcatctatcaggcggcgctggccgccaaggaagccggcgactacgacaaggccaccgagctgtttaccctgattatcggttatctggacagcgaagggcagattcaggactgcctctatcagcaggcggcggcgctgagggacggcggagactacgccggcgccatcgccctgttggagatgggcggcacgccccgcagcgaggacgcgcagcagctctattacgaatgcaactatgagctggccatggacgccatcgaggcggaggatctggagcgcgctcagaccctgctggaaaacgtggacaactacaaggacagcgaaaaacagctcaacgccgttcgctacgaactggccgaagccgccctcgcggcggaaaactatgcggacgcgcgcatcctttataacgcgctgggctcctataaggacagcgaaaccaagcttaagcagtgcagctacgccattgccagcgcggcgctcgcggcgggggactatgccacggcaatctccggcttcgaggccctgggaaattaccaggacagcccagccatgtttgaggaggcggcctatcagcaggcccttgcgttaaaggcggcgggagatacccagggcgcggcggaggtgctggcagaactgcccgacagcgaccgcgccaaggccgagctgatctccatccagctggatcatggcgccgaactggaggcggcgggtgattacgcggcggcggcagaggtgtacgcggccattgaggacagcgaggaggcacaggagcgctacaacgcctgcctgtacacccaggccgagcagctgcgcgacgcgggcgatctgaccgccgcgggtgcggccttcgaggccctgggcgattaccgcgacgccgctgaacagagcgagtcctgctacgaaacctactttggcaacgttgcgcagaccgctcgtgatgccatggagcagcaggactatcccgcggtgatcgccgccctggaggggttctccatggatgacctcacaggcagttacgccgatctgccggaaatctacaatgaggcctgctatcagtacgcggagcagctgtaccgtgagggcaagccctatgaagccctgccctattaccagcgcgtgggcgactaccgcgatacggctgaaagcaagctggaacggcgagcctatctgattctgggcgaatggacctccaccaccggcaagaccgccaccttccgtacggatggcacctgcgacctgatgggtgagacgctccatttctatgtgagcaacttcagcctctacaccggcgagaccgaggacgatatgacgatcacgcacaagctcagcagcattgacaaaacctccatgagcctgcgcgacatccgcgatggacaggatgtggtgtataaattctcccgcgtgggggaatggactttgccagaggaaaccgctgcgcctgaaacgacgcctgccccgcctgcagaggcgggcgcggaggttacgcccgcgccggaagatgaggacggctcggaaaccgcttccgtcccggaaggggaatcaggcgaggaggtaacgactccgcccgctacggaggccgtgaatgacgcggacgaataa

SEQ ID NO: 912 - DNA, 1083 bp, Unknown
  Artificiall/Consensus sequence
atggccgagatcagcctgtgtatgattgtccgggacgaacgcgaaacgcttgcccgctgcttggacagcgtaaaggaggcggtggatgaaatcatcattgtggataccggctcaaaggatgagacgcgggagattgcccggcgctatacgccgcatgtgtacgacttttcctggaaggatgatttttccgccgcacgtaacgaatcgtttgcgcatgcaacccgtgattttctcatgtggctggatgctgacgacgtggtggagaacgcggaggctctggtgcgtttcaagcgggacgtgctggatggccttgacgtggcgatggctccctatcatgtggcctttgacgcgcaggggaatcctacctttacttattatcgggagcgaattttgcgcgcgggaatgggctttcgctgggagggagccgtgcatgaggccattgctccgcgggggcgaatcggctatgcggattttgtggtgcggcacaaaaagctgcgcccgggcaagccggggcgcaacctgcgcatctatgaaaagctgcggaaggagggacacccgttcaatccgcgtgagcgcttttattatggccgtgagctggcgtcggccggccgcatggaggaggcggcgcgccagctggacagcgtgattgaggacgaagcggcctggattgaaaaccgaattgaggcctgcgcaggactggcggactgcctggatcgtctgggggacacatcgggcgcgatgcgcgcattatgccgtagcctggccctggaccggccccgcgccatgattgcctgcgcaatggggagaaggtttcttgaagccggcaacctgcatgccgcccggttctggtatgaggcggcgctgtcggcgaaggagaacgaaaagtcgggtgcgtttatccagcgggaccacagcggacggattccgttgctgcagctatgcgtgattcatgaccggctgggggaacgggaggtggcatgcgcctacaacgagcaggccgcgctgctgtgtccggacgacgaagcggtgcgacagaaccggcgttattttgagcgcctgggcattcgcaaaaaaggagagtag

SEQ ID NO: 913 - DNA, 1119 bp, Unknown
  Artificiall/Consensus sequence
atggaaaaatccaaggtttattttaccaattttcgcgccaaacccgaccggaacgttcttcagaagctgcaccatctcatcgaggcggccggtatgaccagcatgccgctggacggcaagttcaccgccatcaaaatgcactttggcgagccgggcaacctggctttcctgcgtcccaactatgccaaggttgtggtggatacgctcaaggatatgggcgctcgccccttcctgacggactgcaacactctgtacaccggcatgcgccgcaatgcgctggatcatttgaccgccgcctttgaaaacggctttggccctcttcaaaccggctgccatgtcatcatcgccgatggccttctgggcaatgaccatgtttccgtacccatcgacggggaatactgcaaggaggcgctcattggccgcgcggccatggacgcggatgccatcatcagcctgacccacttcaaatgtcacgaaggcacgggcataggcggcgcactgaagaatttgggcatgggccttggctccacggcaggcaagcgcgccatgcactgtgacggcaagcccgtggtggaccacgacaaatgcatcggatgcggcatgtgcgcccgtcaatgtgctcatggagccatcagtttcagcggagaaaaaggccaccggcgtgccaccatcgaccacgacaagtgcgtgggctgcggccgctgcgtaggcgcatgccgcgaccggggcgccatccaggggccggacagctccaacgacgtgctcaactgcaagattgccgaatatgcctgggccgtcatcaaagaccgccccaatttccacatctcgctggtaatggacgtatcgccctattgcgactgccacccggaaaacgatacgcccatcattgcagacgtggggatgtttgccagcttcgaccccgtggcgctggacgtggcctgcgcggatgcttgcaaccgcatggagccgctgcccggcaccttcctgaccgaccgtaagaaccgcaccggcgacatcttcaacgatacgcacccctataccaactggcgttccggcgtggaacatgccgccaagctaggcgtaggctcgctggagtacgagctgatcgaggtgcgttga

SEQ ID NO: 914 - DNA, 1338 bp, Unknown
  Artificiall/Consensus sequence
ccttccctgtcaacaccttttttcgaattttttgacttcttttttagaatcttgtatttcccgaaccttttgatttataatcatttccacgtccaggtattaccccggatgttctcccctccgaaaatgccgaacgttcgtggtcgtctattgccgaagcgttttgcatcaaaaccaaattgcttttttgcccaaatcaggctatactacctgttgaaaaacgcatatactgaggaagtggacgagatgaagctgggcattgtgggactcccaaacgtaggcaagagcacgctgttcaacgccattacacgcgcgggtgcgcaggcggccaactatcctttctgcaccatcgagcccaacaccggcgtggtacccgtgccggacaagcggcttgacgagctggcgaggatgtatcagcccaagaaggtcacgccggcgacggtggaatttgtggacattgcaggcctggtgaagggtgccagccgcggcgaggggctgggcaacaaattcctttctcatattcgcgaagtggatgccatcgttcacgtggtgcgctgctttgaggacgaaaacatcatccacgtcgatggcagcattgatcccaggcgcgatattgaggtcatcgatctggagctgattctggcggacctggagaccgtggaacggcgcacggagaaggcgcgccatctgctgaagaacggggacaagctgagggcattggaagcagatgtaggcgagcggctgaaggctcatctggaagccggcaagcccgcgcgcacctttgccatgaccgatgaggagcgcgagatcgtatccggctggttcctgctcaccgacaaaccggtcatctacgccgccaacatcgcggacagcgaaatcggtcagccagattcggcccacgtcaaggctgttcgggagattgcacaggctgagggatcgcaggtctttaccatcagcgcgcaaatagaggaagaaatcgctcagatggagccggaggaaaaagacgccttcctgaccgagctgggcctggggcagagcggtttggaccgactcattgccgcgtgctacacgcttttgggcctgatctccttcctcacggccggtgcggacgagtgccgggcatggaccatcaagcggggtaccaaggcgccacaggctgcgggcaagattcacacggactttgaacgcggcttcatccgggccgaggtggtggccttcgatgatctgaaggcccagggcggcatggccgcctgccgtgagaagggtctggtgcgcagtgaaggcaaggactacgtcatgcgcgacggcgacgtggtgctgttccgcttcaacgtataa

SEQ ID NO: 915 - DNA, 1179 bp, Unknown
  Artificiall/Consensus sequence
ttgaaaggatttttgccgatgagcctgtatcgacgcgtgatcgctctttgcacatgcctgctcctgctggcagcagctttttccgcgctggcggaggaaacggaccccgtcatgactgctgaggaggccgaagccgccggtatcgaggtggagggtattgcgacggaggatgaggatgaaacggccgttgccgacgcggaggatcagccggcgagcatcgagggtctgacgccgctgtacaccaccaagatcaagccctttgtagcctcgggcaaggccattcgcatgcgcgccctgcaggacggcgaaagcgacgtggtctgcgtgattgacgcaggcgaaacgatcacggtctatgcggtgtatccctcctacgtgctggcggagtataacggctatgtaggctatatcattcgcacctgggtggatgagaatatgacgacgctggacccggagaatacccctccgtacggcgtggtgacgtccaaatatgtggctacgctcaccgaaacggccaacatctacgccgaaccgtcgctcagcgctgagatcaacgatatccatcccggcgcaggcagcaaaatcgccattctggacttcgtggacggttttgccaaggtgctggtgtggcgcagctatgggtacatcgacgcgcgcgtgctgaccgacctggtgatggtggcccagggcgacgagcccatgagcgatgagacccccatcgcggcgttttgcagcttctttgagtacaatacgggcgctgaggggaacgatggccgctgcaaaaacatcgtgcgcagctgcgaatccatgacccgcctgatgcagcccggcgaaagcctggattttaacgcgcaggtcggcccctataaaaagaacaatgggtacttcccggcccccgtgctcatcgacggcggaacccagatcggctacggcggcggtacctgccagagcagcagcacgctgtacaatgccattcggcaggtgccgggcatcacggtgctgatgcgccggccgcatggaccgggctgtgcgaggtatctgcccatgcatcaggatgcggcggtgggaaatgactcgctgaatctggtgttccgaaacgattgcgaatatcccatctacgtgctggcggaaagtaccggtgagggtaccctgtgcatccagatcttccgggcggactga

SEQ ID NO: 916 - DNA, 1611 bp, Unknown
  Artificiall/Consensus sequence
ttgagcgccgagtatgtattggaaatgaaaaacatcaccaagcgctatggcgagaacactgtcctgagcgacgtttcgctgtctgtgcgtccgggcgaaatccatgcgctgctgggcgaaaacggcgcgggaaagagcacgctgatgaacgtgctgtttggcatgcccgtgattcataccacgggcggcttcgagggccaggtgcttttggagggcgagccggcgaacgtgacctcgccgcatgacgccatggtgaagggcatcggcatggtacaccaggaattcatgcttttgccgggctttaccgtcacggagaatatcaagctcaaccgtgaaatcacgcatcccaatcttattagccgcatctttggaaaaaatctggaaaccttggacatgaaggccatggctgccgacgcccgcaaggcgctggacagcgtgggaatgagcatcgacgagtacacgctggtcgagggcatgcctgtgggctatatgcagtttgttgaaattgcccgcgaaattgataagaccggcgtaaagctgcttgtgtttgacgagcccacggcggtgctgaccgagagcgaggccacgcagctggtctccgtgatgaaaaagattgctgcgaacggcatcgccatcatctttatcacccaccgtctggacgaggtgatggccgccgctgattcgatcacgatactgcgcgatggcaagctggccgccacgcgcgaaaaagagcagaccagcgttgtggaacttgcggagctgatgatcggccgcaagggagagagcatggtgcaggccgcgccccgcacgcccccgcaggacagggtggccatgagcatccgcgacctgcatgtggatatgccgggcgaggaggtgcgcggcgtatctctggaggtgtatgagggcgagatcctgggaatcggcggactggccggccagggcaagctgggcattcccaacggcgtgatgagcctgtacgacacgcggggcagcgtgaccctgtttggggaagaactcaagctgggcaacgccggagacgccctgcgcgccggcatcgccatggtgtccgaggaccgcaagggcgtgggcctgcttctggaccagtccattgaggacaacatcgtctttaacgccatgcagatcaagggtgagtatctgcacaggctgggcctgttcaccctcaagaacagcagcgccgtgcgcaaaaccgccgagcgcatgattcacgacctggatatccgctgcttcgggcccatgcagcacacgggcacgctgtccggcggcaaccagcagaaggtgtgcatcgcacgcgcgctggtgatgggtccccggttcctgttcgtcagcgaaccgacccgcggcatcgacatcggcgccaagaagctggtgctggagacgctcgtgcgcctcaaccgggagcagggcatgaccatcgtgatcgtctccagcgagcttcaggagctcaagagcatctcagaccgcatcgccattatcagcgagggcaggctggtggacattctttctcccgacgccagcgatgcggacttcggcctggccatgtccggcatcaagcccgacgaccaacttgagaaaggagatggcgcgcaatga

SEQ ID NO: 917 - DNA, 1470 bp, Unknown
  Artificiall/Consensus sequence
atgggtgcgcttatatgcctgctgctttcgatgctgattgcgctgtgccctgcggcgctcccgctccatgctgtcgccgaagaggaaaacgtcatctactatatcgaaccggagctccccagcgatgtggagccctacgatccggagcatccggaggacctttacgaggaccagctctacgccaagtcggccatcctcatcgaagcatcctccggcgaggtgatttttgaaaagaatgcggatgccaccatgtatcccgcttctaccaccaagatcatgaccgtgcttttgggcatcatgatgggcgatatgaaccagaccgtctacctgtcgcagaccgctgccgacatcggcgacgacagctcggacatgggcctggacgtgggggagagcatcaatttcaaggacctgctctacggcaccatggtgcgctccgccaacgagggcgccaacctcatcgccgaaacgctctacggcagcgtgccggcctttgccgaagtcatgaacgaggccgccgccatgtacggctgcaccggcacgcattttgccaacgccaatggcctgcacgaccccaaccactataccaccgcgcgcgatatggccaagatcgcccaggccgccatgcagaacgagaccttccgcgacatcgccaaaacctatacctatcacctgccggccagcaatctgcacagcgcgcgcgtgctcacctccagttcccgtgcatttttcaaccccagcctggaggaaaacgacgcctactacccctatgccatcggcatcaagaccggctttaccaacgcggcaggccactgctttgtaggcgcggccgagcgggacggggtggagctgatctccgtggtgttctacaccacggcggacggccgctggaccgatacggtcaagctgatggaatacggcttttcccagttcgtgagcatgacgcccgcggaactgtatgccgaaaaccccatcatggtggaaacctccggcttctccctggacgatgagggctatggccggctggagctcaatgtgcaggcccgcagcgggtcgcgcgaggtgagcatcgtggccaccaaagccgagatggaaagcatggccagaaacctccggcagaccgtgctgatcgagtacacgcgcgattttgccgcccccattcaggcgggtgaagtcatgggcaccatgacctattaccccaccgacggcggcagccccgtcacctatgacctggtggcctcgcgtaccatcgcgcgccgtgaaaacgcgcctctttcgctggaggagatcgtggagcaggtctacgccgatcccaaccccttcccgccgttgtcggcggagctggtggtcatgatctttttgccggtaggcggcgtgtttgtggccattcggattttgatgcgcgtgttccgccgcacgggccggcaccgcaaggggcgcgtgcccaggccgcgcaaccgcttctatcgctga

SEQ ID NO: 918 - DNA, 1116 bp, Unknown
  Artificiall/Consensus sequence
ttgtatcgcgccgcccaggcggcgttttggagaggagcagcggacgtgtacatcgagaagcgttatatcaagaaaattgcgagggtttttgaggcattatccatctccctgcggctggtggatgcctccggcgcctgcctggtgccagaagacggggagtccgccgcccttcccgcgggcgtgctcgcgcaggggttgaatcatcacgccggccggttcttttaccgtgttctggatgtgcatccgcccctgtacctggtggctcccgagggtgcgcccggcgtggaagatgtgctctgcgtagccgacgccatgatcatgagtctcctcaaaagcagtctttccatcgccagccataccgacgtgtaccgccgcgcactcaaacaggagctttccggggccgacctgatttcccgtgcgagcgagcaccagattcccctggagatggatcgctgcgtggtgctgttccagattgagcagacggagcgctccagcgccttctctctgctgggtgagctggtgccgctgagcgataccgacgtgctggtggagatgaaccgccacctggtggcgctcatcaaggacatgaacggcatcgacgggatggacgatctgtaccagtttgctcaggccgtgcaggaaaccctgatggaggaggccgtgcagaccgccatcgtgggcattggtgaggaaaagcatacgctggcccagcttggggaaagctatgccgaggccaagcgggccatggaggtggggagcatcttccaccccggcgaatccatccacatgttccggcggctgatgctggaacgtttcctgatgaacgtgccgcgcgaggaaagcatgctctatcacagcctgctgtttaaccgcaaaaccgcgaagctgttcaatgaggagatgcttcaaaccatcgagatgttcttccgcaaggacctgaacctctccgatacagcccggcagctctttatccaccgcaatacgctggtctaccgactggataaggttcagcggcaaaccgggctggacctgcgccattttgacgacgcggttaccttcaaaatcctctatgagctgaaaaaatgcgggcaggaaaagcccaggcagatttattga

SEQ ID NO: 919 - DNA, 3807 bp, Unknown
  Artificiall/Consensus sequence
ccggccccgcgcacggcacatgccgctccccgcgcaaccgcgcccaaaaagcctgccgcacccaagggcggccctgtgctcaagggtcgcgccgtgggcgatgtgcccgtcccgatcggtgagctggccgaggacagcggtatcgtggtcatcgagggcaccgtgaccggcgtgaacgatcccaaggaactcaagggtggcgaaacggtgctggcctccttcgccgtctatgacgatacctccaccatctactgcaaggccttttacaactaccgcatgcgccgtgccgcgcgcggcgaaacgcccgatccccccaccaaggaggagagggcgcgggtgatggagcagattggtcagatcaaaaacggcatgcgcgtgcgcctcaggggagactgccgcatggacccgtttttgaacgaattgtccgtaagcgtgcgcgacatgcagcagatgcccaaaatcgagcgcatggataccgccgccgaaaagcgcatcgaactgcacatgcacaccaccatgtccaccatggatgccaccgcggacgccggcgtgctcattgcacaggcggccaaatggggccaccccgccgtggccatcaccgaccacggcagcgcgcaggccttccccgcggccttcggcgcggccaagaagcagggcatcaagctcattcccggcgtggaggggtatctgtgcgacctggtccccatcgtaaccgacgcggacgaccgccccatcgacggccccatcgtggtgctggactttgaaaccacggggctttcgcacgccatggaccgcatcatcgaagtgggcgccgtcaagctggaaaacgggcagatcgtgggcgagctgagcctcctgtgcgaccccggcgtgcccctcaagcccaagatcagcgaaatcaccggcattacggacctgatgctccgcggcaaggaaagccccgccgagggcgtgagaaagctcctggacttcatcggggactgccccgtggccgcgcacaatgcgccctttgacatgggcatgcttcaggccgagtgcaagcgcatgggcgtgagcttccacgcgccggtgctggatacgctcaccttctcgcgcaagctctatccacagcaaaagagccacaagctcggcgcggtatgccggctgctcggcgtgtcgctcaaaaacgcgcaccgggccgtgcacgacgcggcggccacggccaagtgccttgcgcgcatgtttgacgcggccaaggaaaagggcgctgcgaccctcaaggacatcgacgccgtcatcagcggcgataccatcgggcaaagctaccatatcattttgctctgcaccagccagaaaggcatgcagaacctcaatcacctcatttccgacagcaaccttcgctacttctaccgccatccctgcatgccccggcacctcatcaatcagtaccgcgaggggctcattctgggcagcgcgtgcgaggcgggcgagctgtttcaggccatcgtcaacgaccggccgcaggaggagatcgaacgcatcgccagctggtacgactatctggagattcagcccatcggcaacaacggcttcatgatccgcaacggcaccgcccgcgacgaggagcacctgcgggaattcaaccgcaggatcgtcgcgctgggtgaaaagctgaacaagcccgtggtcgccaccggggacgtgcatttcctcaaccccgaggacgccatctaccgcaccattttgcaggcgggcctcggctatgacgactgcgacaaccaaccgccgctctacttcaaaaccaccgacgaaatgctggaagaattcagctacctgggcaaggaaaaggcgcatgaggtcgtgatcgacgcgccgcgcaggattgccgatcaggtgggggaacttcgcctgttccccaagcatccggagggcaaggacaccttccagccctactgggaggaggccgcgggggacatcgaaagccgcgcctggggccgcgccaaggagctttatggggaccccctgcccgagattatccagaagcggctggaaaaggagctgggctccatcatcggctatggcttctccaccctgtattccatcgcgcagaagctggtcagcaagtcgctttcggatggctacctggtaggcagccgcggcagcgtggggtccagcttcgtggccaccatgtgcggcatcaccgaggtcaatcctctgccgccgcactaccgctgcgatcactgccacaagatgttcctgaccccgccggagctggccagcgtgggcgtggacctgccggacaagaattgcgaaatctgcggccacaagctggccaaggacggctttgacatccccttcgaggtattcctgggcttcaagggcgacaaggtgcccgacatcgacctcaacttctccggcgaataccagccgcgcgcccatgcctacattgaggagctcttcggcaagggctacgtctaccgcgccggcaccatctccggcctcgcggaaaagacagcctacggctttgccgccaagtacctggaggagcgcggcatccatgcgggccgcgcccacaaggaacggctggcggcgggctgcgtgggcgtcaagcgcactacgggccagcaccccggcggcatcgtggtgctgcccaaggaatatgacatctgccagtttacggccatccagcatcccgccgacgacgtggaaggcaccaccatcaccacgcactacgacttcaactccatgcacgacattctggtcaagctcgactgtctgggccacgacgatccgaccatgatgcaccggctggaggagctcaccggcgtcaacttccgtgaaatcccgctggacgaccgcaaggtgatgagcctgttttccagccccgaggccctgggcgtcacccaggagcagatcatgtgggaaaccggcacgctgggcatcccggagttcggcacgagcttcgtgcgcggcatgctcatggagacgcggcccaccaccatggaggagctcatccgcatctccggcctctcgcacggaacggacgtgtggctgggcaacgcgcaggacatcatcaattccggtacggccaagctggctcagtgcttctgtacccgcgacgacatcatgaacttcctgatctccaagggcatgcaggagaagatgagcttcgacatcatggaaagcgtgcgcaagggccgcgggctcaaacccgaatgggaggaggccatgcgcgagcacgacgtgccccagtgggccatcgacagctgccacaagatcaagtacatgttcccgcgcggacacgccgtagcctatgtgaccatgggcctgcgcgtggcgtggtacaaggtgtaccgtccgcaggcatactacgcggcctacttcaccattcgcggcgatggatttgacgcggggcgcatgctgctcagcccggaaaccctgcgcgaccgcctcaccgatttccaaaaccgcgaggaaaagatgagcgtgcgcgagaagcaggaggaaaacgcctatcacatgctgctggagatgcagatgcgcggcattcacatgctgcccgtggacctgtacaagagcgacccaaagcgctttttgatcgaggatggcaacctgcgctgtcccttcacggccatcaacggctttggcgaatcggccgtggagggcatcatcgcctcgcgcgacccaaaccgtccctacatcagcatcgaggatttgcaaaaccgtgcgcacatcggccagagcatcgtggagatgctgcgaggccagggcgcgctggaagggctgccggaaaccagtcaggtggatctgttttccctgctgggatga

SEQ ID NO: 920 - DNA, 1581 bp, Unknown
  Artificiall/Consensus sequence
atgatgacggataaaagcatggattttttggaaaagcagggctccagcgccgccaaagcgctggaggtgctccgggaggaactgcccctccagcgttttgtgggcgaaagcctgagccaggccgtggtggagggcgaggtagcgctgccaggcggcctgcgcgaggaaaccaccgtgcttagcgccgaagccatggcggtgctggaccgcagcgcggcggaggccgatcgcgtgactgccgaaggcaaggtggtctttcatgtgctctacacccagggcgaccccacgcatgtaagcgcgctggaggcctcggccgaattcagccatccggtggagctggctggcgcgcagtcggggatgaacgcacccgtcagcctgatggtggagcatgtggaggccggcgctcagggcggacgtctgcatctgatggcgattttgcgggtacaggtgcgtgttttctcggacgagcccatggaggtggtcacgggcattcgcggggtcgatggcctgatgctgcgcaccgaaacgctcagcggctgtcagaccgtggcgcggggggaacaggacgtacttgtgcgcgacgaatgtgacctgggcgcggtcttgcagatcaccgatacgctgtatgccacggccattgccactgtccaggacgtgatgggcggcgaggagcgggctacgctgtcgggcaacattttgctggaagtggtgcaccgcagcgccatgccctcgcgtccgctggtggtcacacgccacaccattccctttgaggagacggtatccctcacgggcgacgagggggattcgctctgcgcgggcgcggtggtcaaggatgtggccgtgctctcccaggaagggcaggaggagggcagccgcacgcttcgggcggaggtgctgctgggattgaacgcgcaggcggcgaggcagagggacctgtgcctgctgctggacgcctataccacccagggcgactgcctgtcgctggagaagcaggaagtccggcgggcgctggcgcacaagcaggtgcataccgccgaaagcggcaagctcacgctcctgctggacggccagacacccgtgcgcacgcccctgcgcgcggcgcttcggcccgtggtgacggacatgacccaggcgggcggcaagctcagcgtggaaggcatgatggaagtgacccttctgtacatgaccgacgatacggaaacgccccagacctatcagacggaggaacccttccgcatgtgcttcgcgtgcgaggtgagcctgccggaaagcctggtgctgaccaccagcaacatcgacgtcaacggcatcaccagcgatcgcgtcgaggtgaaatacatcctgcatctggactgccatgatgtacagctggcaagcgaagcactggtgacgcaggtggagcaggagcccgccgaggaagccgaaccgggcatcctgatgtatttcagccagccgggcgaaagcctgtgggatatcgccaagcgctatcgtgtcagctgtgacagcctcaagcgcatgaaccccgatctggaggaagacggaagcactcaggcgcagcgcgtgatcttgtggcgaaaataa

SEQ ID NO: 921 - DNA, 1593 bp, Unknown
  Artificiall/Consensus sequence
gtgaaaggcatgaaaaaagcgtggaaagcgctggcggcgtttctgcttgcgctgatgctgccgctcggcggcgcgtgtgcgagtatcgcgggcctggatgaaacgcttgcaggctatttggatacggacggcgatctgcgctacagctttgccctgcaggtggggacgctcctgccctacggcgaggaaacgctgacgatgatgaacggcgtgctggagcatatccgcgtggccgcgtccgagacggacgcaggggccgaaagcacgcttgctctttgcgtggacggcgagagcgtgatggacctcaaccagcacaaggcgggggagagcacctcgctgaccacctcgctcctgcccaaccgcacgctggtcagcggcggatctccgctggacctgttgatggggacggaaaatggcgaagcggaatttgacgcgctgctggccattcagcaggtcgagggctgctaccagacgctgaccgacgccattttgccctacgcggagcagaagaaggccaactacaagatcaaggatatcgccacctcgcgctggagccgcatcgcgcggctgaccaccgagcagagcacggagctggcgccgttgattgcgcaggtgctgggctgcggcatggacgcggccttccgtgccgaactggagaaaatgacctattccaagggcttcatcgtgggtctgtaccagtccgaggaaaacggcgaggacctggccgtctatatcaagggcaccgtcaccatgggggacggcaccacgcggcagctgtcgtatcagtgggcttttacgggcgacgcggcggagcgcatcgacacctataaatttgagctgacccagggcaagggcgacgcggaaaaccgcacgatctccgctacctaccggcgcggggaggcggaaggcgccttctccgtaaagggcgagtggtccgccgccatcaagcggggcacctccaccgtgaccaccacggtggagcacgacctcaccggcgcttccgggtccggcgatcgcacgctggagggtacggtcataaccgcggtcaagacggcggccgacggggagaccgaaaccgtcaccaccacgctgacccccgcggtgaagctgtcctccgcgcaggagggggagatcctcacgggaacggtggcgctggaggagatgaccggcaagaacgtgaccaaggcgctcacctttacctttgacgaggagcccgtgcaggtgacggaccagccggaggaaagcgtcgacatggcgtccgccgcagaggacggcgagccggtctacgatcctatgccccagagcagcctgagccagaatgaggagcccgtggacggtgtggattcggattatctggtggggcagccgcccatcggttaccagatctacgaagtgccggataccatgcagacctatgatctggacaccgcgcaggcggaccagctggaagcgctgcggggcgagctgtatcagaacctggccggacggctgctcaccgcgctggccaagctgcctgcggaggacgccgcgctgcttgcggacaacctgtccgaggaggactacgcggctttcctggagctggcgcaaccttga

SEQ ID NO: 922 - DNA, 1716 bp, Unknown
  Artificiall/Consensus sequence
atgaaagtagtcattgtcggcggcgttgcaggaggagcaagcgccgcggcgcgtctccggaggttggatgaatccgctcagattattgtgtttgagcggtctggatatgtatcttatgccaactgcggactgccttattacatcggcggtgttattgaaaatcgcgatctgcttactttgcagacccccaagagcttcaaaagccgttttaatattgatgtgcacgtccatcacgaggtcgtcgccattcatcgggaccgcaaggctgtcacggtacgaaatctggagacgggcgcggaatttgaggaaacctatgacaagctgatactttctccgggggcgaggcctattcgtccgcccatgcccgggttggagtccaagcgtctgtttacgcttcgcacagtggaggatactctgcagatccgcgattttgtagagaaagaaaagccgcggcgcgccgtgctggcgggtggtggattcatcgggcttgaattggcggaaaatctttgcgaaatgggcgttgaggtcacgatcgtccagatgctggaccagctgctgacaccccttgacaaggatatggcatcctttgttcatgcgcggttccgtgcaaaaggggtgcacctgatgctcaaaacagctgtaagcggctttgaagagcgcgaaggatgcatcctgacacatgtagatgggggagagcccctctgttcagaaatggctattctggccattggcgtatcgccagattccagcctggcacgcgaagccgggctagcgctcggcgcacgcggagccatttctgtggatgaacacatgcgcacatccgaccccgatatctatgccgtaggcgacgctgtgcaggtgcgaaacgctgtgaccggttctctgggactggtatcgctcgccggaccggccaacaaacaggggcgtattgccgccgaccatctctgcggactggatagcgcgtatcacggagcttatgcttcctctgtcatcaaggtgtttgacatgacggccgccgcaaccggaatcaatgaacacgcggctaaggaagcgggcctctcttacgaaaagattgttctttccccagaaaaccacgcctcctactatcctggcggacgtgccatgaccatcaaacttctctatgagaaggaatcgctgcgtattctgggcgctcagattgtaggttttgatggcgtggataagcgcatcgacgtcctcgcaaccgccatgcaggccggaatgaaagcccccgaactggcgtgtttggatctggcctatgcgccgccttactcctcagccaaggacccggtaaacatggccggttttattgcagaaaacatcgaaacaggcaaggtgaagcagttccattacgaggatctggccgatctgcgtagccgtcccggcgttacgctgctggatacgcgaaccgtgggggagtatgccgcggggcatgctgagggctttatcaatattccgttggacagcctgagagaccggcttgccgagctggatgcacatcagcccgtttatgtcatgtgtcaaagcggcctgcgcagctatctggcctgtcgtatccttagccagcatggatatgagtgctataacttctccggcggttatcgcctgtatcgcgccattgtagaaaacgcttttaacgagcaggccaacacacggtactgtcaagagttatgcgcaaaatcggtttgcagactccgg

SEQ ID NO: 923 - DNA, 1197 bp, Unknown
  Artificiall/Consensus sequence
atgaagattttggtcgtttgccagcactactggccggaaaactttcgcgtcacggagatctgcgaggcattggctgcgcggggacaccaggtaaccgcgcttgtgggtctgcccaattatcccagcggcgtggtccccgccgaataccgtcactttcggaacagacgtcagatgcgcaacggcgtggaaatccgccgctgctttgaaatcggacgcaggccgggcaagctggggctggcggtgaattacgtcagctacatgacctccgcgacggtcaaggcgctgctgctggggcgggattatgacgtgatttatgcctattccacctcaccggtgctcatgagcctgcctgccgcagtgcttcgctgcttcacctccaaaaaactgatgatatatgtgctggatatctggcccgcctgcctggccgccatgaatgtgggcgaggatgcgctcctctatcgcttcatgaagcgtgtcagccgctgggtctaccgccgggccgatatgctgatctattcatccaagcgttttcagggctatctgcgcgacgtgcacggtattgaggtgccggatgggcagtacatgcctcaatttgccgatgatgtatttcgcgcgccccttccaccaggacctgcgtcggatgggattaacctggtctttgcaggcaatatcggcaaggtgcaggcggtggaggtactgattcgttcggcggcgctgctcagggacctgcccatccgctggcacatcgtgggcgatggttccaacgaggccgcctgccgtgagctggctgccaagcttgcactgggggagaccgtcgtgttttacgggcgcaggcctcttgaggacatgcccgccttttatgccatggcggatgccatgctggtgagtatgcgcgacgatatcagcgtcaacgacacgctgcccggcaaggtgcaaagctacatggctgcgggcaaacccgtgttgggaagcatcgccggagaaacagcctatgtgatcgagcaggctggatgcggcttttgcgctccgcccgacgacccggaagcctttgcgcaggtagtgcggcgtttcttgtcctgtgaggaccgcgaggccatggggaagcgcgggcgggcgtattatgacgcccacttcaccaaacgcgaccatatggacaggctggaagcgctgctcacttcgcttgcgggagggaaatag

SEQ ID NO: 924 - DNA, 1746 bp, Unknown
  Artificiall/Consensus sequence
atgaaaacctcaacgctcatccgccggttcctgccctattttaaaaagtaccggggcatgctgtttctggatctggtgtgcgcggcgctgaccaccgtgtgcgacctggtgctgcccctcatcgtgcgcgatgtgaccgacctggccgccaataacctctccgctcttacggtgagctttgtgctcagggtgggtggcatctacgtgcttttgcgcatcgtggacgcgctggccaatttctacatggcctcccgcgggcacatcatgggcaccttcattgagcgcgacatgcgaaacgacctcttcgcccatctgcaaacgctgggctttgcctattacagcaacgccaaggtgggccagatcatggcccgcatcaccagcgacctgtttgaggtgacggagttcgcccatcactgcccggaggaatttttcatcgcgggtatcaaaatcgtcatccccttcatcattctgatgggggccagccccgcgctcacgctcatcatctttgccatgctgccgctgatgatagcgtgcacgcgctttttcaacaagcgcatgcgcgccgtctaccgcgaaagccgccaccaggtgggcgagatcaacgcccaggtggaggacagcctgctgggcattcgcgtggtcaagagctttgccaacgagccggtcgaaatggaaaagtttcatcacggcaacgacgagtttgtgcgcatcaaccgccgcaaatacctctatatggccggcttcaacaccactacgcgcgtcttcgacggactgatgtacattgtggtggtggtcgtgggggcgctgttcatcattcaggggtccatcaccgcggcggattacatggcctatctgctctatgtcaataccctgctgacctccatccgccgcatcgtggatttcatggagcaatttcagcgcggcataaccggcatcgagcgcttctgcgaaatcatggatgaaacacccgatatccaggacgcgcccgacgccgtggaactgacccatgtgcgcggcgacgtaaccttcgaccacgtcagcttccattacagcgacaacgacaaaaacgtgctggccgacatcaacttccacgtcaacgccggcgagcgggtggcgctggtcggccccagcggcggcggcaaaaccacgctgtgcaacctgattccccgcttttataatgtttccggcggacgcattctcatcgacgggcaggacatcacccacctgacccagcacagcctgcgcgaaaacatcggcatggtgcagcaggatgtctacctgttctccggcaccatctttgacaacattgcctacggcatgcccggcgccacccccgaaaaggtgagggaggccgcgcggctggccggggcggacgaattcatcacccggctgcccgaagggtatgataccttcgtgggcgagcggggtatcaagctctcgggcgggcagaagcagcgcatctccatcgcgcgtgtatttttgaaaaatccgcccatcctgattctggacgaggccaccagcgccctggacaatgaaagcgagcgcctggtgcaagaatccctggaaaagctgtccgagggacgcaccacctttaccatcgctcaccggcttaccaccatccgcaacgccaccatcatctgggtgctgacggagaacggcatcgtggaaaagggcacgcatcaggagctgctcgagctgggtggcatctacgcccatctttaccaaatgtatacggaggtggcctga

SEQ ID NO: 925 - DNA, 1365 bp, Unknown
  Artificiall/Consensus sequence
atgcgaatcctggtggttggtgacggcaaagtaggtcatacgctggcggaacatctcgcgcgagaggggcatgacgtggtcattgtggaccgcagcgaggaagtcctccagcgcagcgaggatacgctggatgtgctgtgcgtgcgcggcaatggggccaacgccgccactttggtggacgcgggggcggacaaggcagatatcatcattgccgccaccgccagcgacgaaaccaacatgctttgctgcctggtggccaaaaagctgggaaccaagtactccatcgcccgcatccgtgaccctgaatacaacgacagcctgacgcttctgcagcgcgagatgggcatcgacatgccggtcaatcccgagcgtgccaccgcgctggaaatcagccggctgctgcgctttccctttgcaagcaacatcgaatcctttgccaaggggcgggtggagatggtggagttccgcgcgcaggagcacgatgtggtggtgggccacgcgctcaaggaccttccgcgcaaactcaacggcctgccccaggtgctttatgccgcggtggagcgcgagggaaatgtggtgattcccaacggtgattttatcatccgcgccggtgaccgggtgcatgtggccgccgatatggtaaccattacctcctacttccgctacctgggcaaaaactccctgcgtgtgaaaaacgtgatgctgctgggcggcggccgcatcagctactatctggccaagatgatcgttcccatgggcattcacgtgtcgatgattgaaatcaacgaaaaaaaggccaatgacctcagcgaatccctgcctgatgtcaatgtgatctatggcgacggcaccgatcaggagctgctggagcaggagggccttcagcagatggacgccttcgtggccctgtgcgaccgggacgaggaaaacctgatgaccggtcttttcgccgtcaaggaaggcgtgcccaaggtgattgtgaagaacaaccgcgtggcctatgccgatatcatcagcgccatgggtctggacagcattatcagccccaaggccatcacctgcgccaacattctgcgctatgtgcgcggcaggggcaacgcctacggcaccaagctggaacgcctctaccgcctggtcaatggcaaggcggaggcgctggaattcatccccaagggtacggacccctatatcggcattccgctgcgcaagctcaacattcgccgcggcacgctggtagcggtcattgtcaggcagggcaaggtgatcgtgcctttcggcaacgaccacatcgaagccggcgaccgtgtggtggtgattgcctgtgaaagcggcatcagcgatttgaacgaggttatccgcaaatga

SEQ ID NO: 926 - DNA, 3051 bp, Unknown
  Artificiall/Consensus sequence
atgagctttgagtaccgtcgtttgaaggaccctgcctactttgcggaaaaccggcttgccgcgcactccgaccacatcgtctatgcccggatggaagagctgctgcgtggagagagcagcctgtattgtccgctggacggtctgtggaagttcttttgcgcccgcaacgagaatcagatcattcccggctttgagggcagcgactatgactgccatccgtgggcggatattcccgtgcccgcgcacattcagttggagggctacggcgcgtcccagtatgtcaacgtgcagtacccctgggatggtgtagaggacgtgcccctcggcgacgtgccgcaggagcataacccggtggcctgctacgtccggtattttttcctgcccgaagccatgcgcggccagcgtgtgctggtgcgctttgagggggcggaaagctgcgtggccgtatggctgaatggccattatgtgggctttgcggcggattccttctctcccgccgagtttgaactgacaccctatttggctgagggcgagaacaagctcgcctgccgtgtgtatcgctggaacatcggcagctggctggaggatcaggatttcttccgtttctccggcctgttccgcagcgtttccctggtttgccttcccaaggcgcatgtgtgggacatccggattcaaacgctgctggacgatgcgtataccgacgcaaccctggtgctggatacgtcgctcctgctgggtcagggtgcggaaggcgcaaccctgcacgcggcgctgatggatgggaaagccgtactcgcgacggcgcagggcggtggcgaaacgcaacacttcgagctttccgtccaccagccgcagctttggagcagcgaatctccccggctgtacgaccttctcatgaccgtatgcgaggaggacggcagcgtggtggaggtggtccgggagcgcgtgggctttcgccgttttgaaatgaaaaacggtgtgatgtgcctcaatggccaacgcatcgtcttaaagggagtgaaccggcacgatttctgtgccgaaacaggccgtgccgtacggcgggataccatccgccgcgacctgctcaccatgaagcgcaataacatcaacgccgtccgtaccagccactatcccaaccagcgcgccctctacgccctgtgcgatgaactgggcctgtacgtgatggacgaaaccaacctggaaacgcatggcgtgtgggaaacgatcatcaggggcaagcattctgtgtcctacgcccttccgggggaccgtatggaatatctgccccggctgacggaccgcgtggattccctctatgagcgggacaagaaccatccctgcgtgctgttctggagctgtggaaacgaggccttcggcggcagggtcatctacgagctgagccgccatctgcgcgcgctcgattccacccgtctcgtgcattacgagggcatttccaacgacccccgctatcctgaaactagtgatatggtcagccggatgtatgcgcccgtttcggaaatccgcgcctatctggccaaacaccgcgatcggccgtttattctgtgcgaatattcgcatgcaatgggcaattccaacggcgccatgcacaaatacaccgaatatgcctacgaggagcccctttatcagggcggatttgtatgggatttcatcgatcagagccttctccacaaggaccgctacggtcaggcggcctatggctatggcggcgactttgacgaccgcccgtgcgattacaacttttcgggcaacggcatcgtttacggggacggaaccgaaagccccaagatgcaggagatcaagtacaactatcaaagcatcgtagcccgcgtgagcgcaacacgggccgtcatcaccaaccgaagcctcttcactccgacctcggcctttgcctgtgtggcgacgcttgcgcgggacggcattgtgatcgacacggcagcgctgcgcatcaacgtccccccgatgaagagtcaaagctgccatctgcccttcaaaaaacagacagaacccggagaatatgccgtcaccctgtccttccgtctcaaggaggatacgccctgggcttccagcggacacgaggttgcctttgctcaggggatttacaaggtgaagggaagcgcggcaactccggtttgccggccgctccgcgtcatccgcggcgatttcaacaccggggtggaaggcaacggtttccgcgttttgttcagcgacctctccggagggctggtctcctatgtgtatggcggtaaggagatgctcaaatccattccatgtcccaacttctggcgtgctcccaccgataacgaccgcggcaacggcatgccccaacggtacgcgcaatggaaaatcgcctcgctgtacgcctctgtcaagggcacgccccagctggccaggaaaaatgcgcatcccgcgcccagggaaaacggggatggttctgtgtccatcgactatacttacgcgctggctaccgtccccgccgcgcagtgctccttgcgctatacggtatacccctgtggaaccgtgcgcgttgccctgagctacgaccccgtatccggcctgggagacatgccggaattcggcgtaatgatgaagctggacgcggattatcatcggatgcgctactatggtcttggtccggaagaaaactacagcgaccgttgtcggggggcacggctgggaatttttgaaacaacggcgcaggacaatctggcccgttatctcgtaccgcaggagtgcggcgcgcgcaccggcgtgcgctgggcggaagtcatggacgatcgcggccggggcttgcgcttccaggcggacggggatatgaccttttctgcgctgccctatactccgcatgagttggaaaacgctgcacacgcttacgagcttccgccggttcactacacggtggtgcgctgcgccatgcagcagatgggggttggcggggatgacagctggggcgcgcgcacccatgaggaatacctcatcgatatatcccgccggcgtttcttcactttctgcttccgtggaattgtctaa

SEQ ID NO: 927 - DNA, 753 bp, Unknown
  Artificiall/Consensus sequence
atgaaaaaaaccattcaaattctgctgtttgttctgctggccggggtgtttctctacagtgcctggcggctgggcagctattacctgactgcgttccagcaggaaaagaccgtgggctccctgcgcggtcagctgaacgaggaggacccttatgccgtgaacgaggacggcattttggtgcgctacgcggatttgtacgctgaaaaccacgacatggtgggctggctgaccatttcagatacccccatcgactatccggtgatgcagcgcaaggacgacgccgaatactacctgcaccgggatttcaacggcgagtacgcctccgccggatgtctgtttctggagaagaactgtgatgcggaaaagccgtcggataacctgattatttatggtcaccacatgaaaaacggaaatatgttcggcaaactccagaactacgaggacgagaaattttaccgcgcccataaagcgattgtcttcgacacggttcgggaacatcgggagtatcaggtgctctccgtgttccgggggcaggcttacgccgctgacgataccgagcacttccactactatgacttcaccgaggcccgggaccaggaggactttgaggactatgtggagcagatcacccgccggtcccagtatcagaccggcgttacggcagagtacggcgacgagttgctgacgctgtccacctgcgcctatcacaaggaggaaggtcgttttgtcgtggtggcaaagcgagtgacataa

SEQ ID NO: 928 - DNA, 687 bp, Unknown
  Artificiall/Consensus sequence
ttggagtctgtatccgcttttttagagaattttgatttgactcagctgctggacctgctgattcaagtggttgcagcgttactctgtgtcagctttcatgagatggggcatgggtatgctgcctggttgctgggggattccacggccaaaacccggggcagggtgtccatgaatccgctgcggcatattgaccccttgggattgctcttgttgattacagcgggattcggttgggcaaaaccagttcctgtggatatgcggcattttcgccggcccaaattggggatggcactgacggcgttggcgggtcctgtcagcaacttcctcatggggtttgtggccctggccatagccagcgccctgtatcattttgccctgccgcagttgatgactacttggctgtactacctgttcctgctgctgattcgtgttgcgattctgagtgtgggcctggggatctttaatctgatccctattccaccgctggatgggtctaaagtggtgttctccctgcttccggatcatatttactataccattttgcgctatgagcgctatctgatggttctgctgtttgcactggtgttcctgaacctgctggatacgccgttgtccattttgttggacggaggactccggggcctgtgccggctcaccgggttcccgatggatgtgattggactgtga

SEQ ID NO: 929 - DNA, 714 bp, Unknown
  Artificiall/Consensus sequence
atggattgtcagattgcaaaagcgattaaattggatagtcagccagtagctgtaatcaaaacggacactatccctgaacatgcacttcagttcaaggaaggcaagtggggctgcgttgtcgcattgctggcctctgctgcccagggacggattacagcttgcagccgcaaaacaacatgttgccccggcggaaatgtgggcctgggatttcagccgttcccatcaggaattgagtacttcctctctgttggaggaaaggggcctcgggaaggcgaattttataaggaaacgccggaacttgcgaaggcatacataacgtctgtaccggaaattaccgcaaaagaagccgttgtattcaaaccgctcaacctgctggagaaagctgaaaagccggaagcaatcgtgttcctggtcaatgcggatcagttgtctgcccttgtgacactggccaactatgaccgccccacccaggataatgtccggatcaaatttggcgcgggctgcagccaagcccttctctatcccatgagcgatcaggaggcgggaaacggcatttgcaccatcggtctgaccgatccttccgcccggaagtgcattgacaaagctctgctttcattcagcattccctatcacagatttctggaaatggagtccaaggtttccggtagctttctgacgaaagacacctggcttcgcctttccgagcggatttaa

SEQ ID NO: 930 - DNA, 408 bp, Unknown
  Artificiall/Consensus sequence
atgaagaaaccctcttggattgacgaattcaaaaccttcctcatgcgaggcaatgtcattgatctggccgtaggcgtggtcatcggcgccgcctttaccgccatcgtcacggcagtggtgaacgacattatcaaccccatcataaccctgatcagcggaaaaggcaccgagggcatcgccgccgtcaaagtggggatcttccccatcggcgacctgatcagcgccgtcatcaacttcctcctgatctccttcatcgtattctggatggtgaaggtaatcagcggcttcctggctcgggccaagaagaaggaagaggaagtgaccgaggaggaggcccccgagccctctgcggaggaagcactgctcaccgaaattcgggacctgctgaaggagcagaaccagaagtaa

SEQ ID NO: 931 - DNA, 783 bp, Unknown
  Artificiall/Consensus sequence
atggcaaaacagcgcaaaagcaggcgccgtcccagccggcgggcagggcgttttttaggactttacatttttttgtccatcattttgattactgttgtcatcgtggccggctgtgttgtcttttttaaagtaaatcagtttgaggtgaaggggaacaaccgatatgccgcagaggaaattgtggaggcatctggcattgacacgggggataatctgtgtctggtaaaaaagacggacgcagccggtaaagtgctttccaggctctcctatgtgcgctcggtaaacatccggcggaagctgccggacaccattgtgattacagtggtggagacggatgccgtagctgcggttaaaacggaggacagctggtggctgatgaatgcagagggaaagctgctggaggagttgaaggacgctggagattacattgaaatcaccggcctgcctctggtggcccccaaagcgggggaaacggttgctgtggaggcggattaccgcctgatgcgcagaagtctgatcgaactcctgactgccatgcagggaagagacctgctgaaaaaggtccgtagcatccagtgcagcgatgaggctcagctggtcatgaattacaacggtcagttaaaggtgaaaatgcggacggatgcagactacgattaccaggtcaagatgctggaagcggtgctggaaaaatacgtgaatgtcaattggacaaaaaaagacaaagggaccctggatatgacatatgaggacggtcatccgcatctgaccaaagacagcaagtga

SEQ ID NO: 932 - DNA, 618 bp, Unknown
  Artificiall/Consensus sequence
gtgctgcaaatccccctagctgggctggcctttaccgcctactgccgctccattgagaagcgggagccccttcccgtgctggtgggggcagtggtgtatgccttctccggctttgtgatttttaccgccgccaagcacatctattttatcaccttcctggtcatctacctgcccctgatcctggccggctgcgagcgctggctccggaaacggaagtggggcctgtttgtggggatgattttcctggccatgacgggagggtactactacgcctttatcaacaccctgctcatggcgatttacctgctgatccgggagatctgcctgtaccggacccaggtgaagcggattctgaccgacctgctccagctggtgggcctctacctgtgggggcttgccctggccatggcggcgtttctgcccacggtgctggacttcctgtcctccagccgcagcgatgtggccgagtcggcgtttacactgttctacccggccgagcactatctgaggatgttcctgtgcatggtgggcagcagccccagcggcacctactgggtgcggctgggccttgccggggtggtgtttgccgcagcggtgctcctgttcctgcgctggcgg

SEQ ID NO: 933 - DNA, 1053 bp, Unknown
  Artificiall/Consensus sequence
ttgattgattttggcgatctgacgcgaactgaatgggaagagatttatggtcgctgtcaggggattatggattgtccgaaggactacatggatgcctgccgggggaaaatccaggcgaatctgttttttgagccgtccactcgtaccaagttttccttccaaaccgctatgctgcggctgggtgggagtgtattcgggtttgacgatcccaacagttcctctaccgccaaaggcgagtctctgaaagataccatcaaaatggtgtccgcttatgccgatgtgatcgtaatgcgcaaccccaaagagggggcggccaaagcggcgtctctgtactctgaggtgccggtcatcaatgcgggggacggtggacacatgcaccccactcagacgctggcagatctgacaaccatccagcgttttcgcggcgggattgacggtgtttccgttgggatctgcggcgatttgaaaaacggacggacggtccactcactgattaaggctttagccaaatttgaaggggtgcgtttttttctcatctcccctcgggaactggcgattcccggttatatgcgtacctttatgcaggagcaccagctctggttcactgaagtgaccggtttggagccggttatcccccgtttggatgtgctgtatatgacgcgtatccagcgggagcgctttattgaccccctcgcctatgaacgaaacaagggaatttatgtgctcaccaggcggaaactggaccgggcaaagcctgagctgatggtgctgcatcccttgccgcgggtggatgaaattgccctggatgtggatgacgatcctcgggccctgtattttgaacaggcacggtgcggcatgtatgcgcggatggcgctgctgatggatctggcctgccaggatcaccgaagaccggagccagtggaaattggtagcgatcctgtgtgcaaaaatcccaactgcatcacccagacggaacgctatctgccgccgctggtaaagcaaaacggagacggcgtttgctgtgcttattgtgatagtctgctctacggatga

SEQ ID NO: 934 - DNA, 1341 bp, Unknown
  Artificiall/Consensus sequence
atgttagattattcgtccttgatggatcaaaaacgatccatcaaggacttttttgttgcccaaaaggaggggccctctatgataagaccgaatttagatcaggtaaaagaactggctgccgggggcagttacggcgttgtgcctatcagcacagagattctgtctgacatcaaaacacccattgcggtactgcggattctcaaaaacatttccggtcactgctatctgctggaatcggtggcggaccgggagaaatggggacggtacacctttctgggatttgatccccgactggagcttacctgccaggacggacggatgaaagtggggatgctgtcctttgagagccgtgatccggggaagtacatccggcaggtactggaacagtacaggagcccccgctttgactacctgccctccttcaccgggggcctggtggggtatttctcctatgactatctgaagtatgcggagccctccctccgcctggatggggaggacacggagaattttaaggacgtggatctgatgctctttgacaaggtaattgcctttgacaacttccagcagaaaattatcctgattgtcaacatggagctcacagacctggaggagaactataacaaggcggtgctggagctggaacatctgaaggagctcatccggaccggagtgccctgtaaagaccagcctggccacctgtccggagagattacgccactgtttgacaaagagcgctactgcgccatggtagagcgcgccaagtaccatatccgggagggggacatctttcagatcgtcctgtccaaccgtttggaggcgcctttcacaggtagcctgctgaatgcgtatcgggtgctgcggaccctgaatccatccccctatatgttctacttctcatcctcggacatggaggtggcgggggcctcgccggaaacgctggtcaagctggaaaacggggtgctccacaccttccccctggccggaacccgtccccgagggagaagcgacgcggaggaccgggccttggaggcagagctgctggccgacccgaaagaattggcggaacacaatatgctggtggatctgggacgcaacgatattgggaaaatcagccggtttggcacggtagaggtggaacagtatcactgtatcgagcggttttcccacgtaatgcacatcgggtccactgtgcggggggagattcggagtgactgtgacgctctggatgcggtggatgcgattctgccggcggggaccctctcgggcgcacccaagattcgggcctgccagcttatcaatgatctggagaacaataagcggggaatttacggcggcgcc

SEQ ID NO: 935 - DNA, 1116 bp, Unknown
  Artificiall/Consensus sequence
atggagatgtttttggaggtagttaagatgaagaaatacaaagttggcgtggtaggctgtactggcatggtcggtcagcggtttatcacattgctggaaaatcacccctggtttcagctgaccgctatcgcagccagcgcccgcagcgccggtaaaacttatgaagaggctgtcagcaagcgctggaagatggacactcccattcccgcggaagcaaagaatctggtgatcttcgatatcgatgcccagctggacgaattcgtcaacgaaatcgacttcactttctgtgcagtcgatatggataaagacgccacacgtgctctggaagagcgaatcgcccagaaagagtgcccggttgtatccaacaactccgctcaccgctttacgcccgacgttcccatggtcgtgcccgagatcaatcccgatcacatcaaggtcatcgaataccagaaacagcgtctgggtacccagcgcggtttcatcgctgtaaaatccaactgctcgctccagagctatgtccctgctctgcatccgctgcgtgaaaaattcggcgtaagcaaagcactggtctgcacctaccaggcgatttccggtgccggtaaaaactttgaaacctggcccgaaatggtggacaacgtgatcccctatattggcggagaagaggaaaaatcggagcaggagcctatgaagatgtggggtaaaattgagaacggcgttatcgttcccgccaccactcccagcatcaccgcccagtgcctccgcgttcccgtttccaacggtcatatggcagccgtatttatgtccctggagcagaaaacctctgtagaggagatcaaagagatttggcaaacctacaagggccgcgctcaggaactggaacttccctccgctccgaagcagttcctccactactttgaggatcccagctatccccagactcgcctgcagcgtgatctggaaggcggtatggcaatttctctgggccgtctccgtcccgacacccagtatgactacaaatttgtaggcctgtcccacaacaccctccgcggcgcggccggcggcagcgtactgctggcagaatttttagtggcagaaggttatattccctacaaataa

SEQ ID NO: 936 - DNA, 1185 bp, Unknown
  Artificiall/Consensus sequence
atgaaaaaacggggtttttacctcctgctgactgttgccgtctgcgtgggcgcgatcctgagcagttgttcagtgcgccagtcaggtgatatatccaccaagggaggttcgtctaccattacatcttccgccggaaccaaaaaggttgccggcaaccggctcgtggggatctccatgcccacggaggagaatgaccggtgggtcagggatgccgccaccatgcagtccatcctggaggatcagggctatgtggtggagctggcctacgccgggaacgacagcgacgtacagattgagcaggtggaggccatgctggacgatgactgcggcacaatcatcgtggcctcggtggacagcgatgccctgtccactgccctggccggctgcgacacctccagcactacagtgatcgcctacagcgtgctggtgcccgactgcgacacggtggactacttcatcggcatcgacagctataccaacggccagattcaggccaagtacctggtgaaaaagctggggctgaaggacaccaagcagagctttaacctggaaatcttccaccagtccggcaacggcagcgccctgtacgccttcctgggggccatggacgtgctgaagccctatctggacaacagcaccctggtgatcccctccggcgataccacggaagaggaatgcggcgtggccgacgccgacggggcggcggaccggctgagccatctgctggagactacctacgccgacggcaagcccctggacgctatcctctgcaccgacgacaccatcagcgtgggcgtggcccagggcctggccgacagctactccggttcggtattcccgatgatctctggctgcaactgcaatccggagagcatccagctgctgatgggcggccagctggccatcacctcggtggaggtcaccggcagcatggctcagcaggcggcaaagatggccgatcaggccatgagcggcaagactgtagaccagtccgaggaaaatccctacgatgtgcccgcctacctctacgagcccgccaaggtgaccttgaaaaactatgagaagcagctctttgacagcgggctcttcgtcaagcacaagaacggcaccgtcaccgccgccaagcccgccaaggcagacaagagtcccgacgccaagggcgccagctccgccgacgcctcctga

SEQ ID NO: 937 - DNA, 519 bp, Unknown
  Artificiall/Consensus sequence
attgcggcgacaggcgtcacccccatcgttccgaagaagattccgggtgttgagaatgccaatgttgtcctgggccaggatgtgctgaccggggcggccaataccggcgaccgctgtgtggttgtaggcggcggcctggtgggcgtagaggttgccaatcacctggcgtccctcctcaaggatgtgacggtggttgaaatgagagagggaattgccatggacgagtcccccgcaccgcgcaaggacctgctgagagacctggccaacaatggggcaaaggcctatacagagacttccgtgcaggagattaccgatcattccgtgatcgtgtccggcaggcacaacgaggaaattccggcagattctgtggttctcgccatcggccgtgtttccaacacagcccttgcggatgcccttgcggcagagggcgttgacgtgagagtgatcggcgatgcaaagcagccggcgctggcaggcgcggcaatcagagaaggctatctgctgggccgtcacctgtaa

SEQ ID NO: 938 - DNA, 1269 bp, Unknown
  Artificiall/Consensus sequence
ttgctgctgaccccgtttcaggttgcttttttcgggaaaaaaacttataatagcgtgaatgcaaaaacagtgggagggccaatcatggctgatgcgaaaaagaaaccgaagaaaaaggctcctccggttctcacgccagaggaactgcgcgccagtgcgcaaaaacaggtcgccggggccgtgttggcgctggatttccgagatcaggccaactactatcagaaagcggcagcacttttgcaatccattcccgatgacgacgccagcgccgccttagccagggaatacctgcaccaggcagaagaaatctccgtcagcggctatcaaaccgcctacgaacaggccgttgcctgtaaagaacatgcctgcaaagcagatgatttttatcaggccgccaatgcgttccgtaagattgaggaatatcaggatgcatccaaactggcggatgagtgtgagaaacgctacgcagcgctctcccaccggaaacgccccgcactggtcattgcactgctcgtcctggtgctgctggcgacggctgcaatcggcgtccagacctcctttggaaaatatgaactgggccgaatggccctgatcacctcccactactccggagcactgtcaattttcagccgcttggaggactatcgggacagcgaaaccctggccgaagagagccgctaccagctggcgcagcagcatatggaatccaagcgctatcagaaggccatcccccattttcagaagctgggccactataaggacagtgaagcccagcaggccttcgccgagcaacaggtattgggcagcgccagcccgggtgataccgtccccttcggcagcgcagagtggattgtgctcaacgtcgaagagggatgcgcgctgttgctccaaaatgagccgacagaacaggcccagggctttcacaaccagctggctgacgtcacctggaaggactgcaacgcaagagcctggctgaacgccgcctatctgtcagagaccttctcccagccagagcgcgcgatccttgtttcagaccaggcggagcagctcaatgaccccgtattcctgctgagcgttgcggaggcagagcgatacggcagctttcttgaggataccgattacaactggtggctgcgcacctccggagacgcgcccaaaactgccgccttcgtctccccttctaatcaagtcatggattatggttatcccgtagacaataccggaattcgactccggcccgccgtctgggtggactgctctatttcttaa

SEQ ID NO: 939 - DNA, 459 bp, Unknown
  Artificiall/Consensus sequence
tcctcggaagcgtccagtgcggacagctccgccgagggcacggataccaaggagtacaactggtacctgtccggagacgtggacgtgacaaaggaggcctatctgaccgccctgcggacggaaattgactccatcgccttctccaggctctacgatttccagcccagcgccaaggcgttaaagcgctgcggcctcagcgaccccgccgccgccctgacggtggagtacctggacagtgaggaggagcgccagaccgtaaccctgctcctgggggccagttacaccgacgaggcgggaaccgagtaccgctacgccatgctccaggggagcgaggatgaggtgtacctggttacggcggacagcgtccggcagacgttggctgcggcggagcacgggtacgcccaggcgtctgcggactataacgatgaggcgtcggaatccacacagacgacagaataa

SEQ ID NO: 940 - DNA, 1344 bp, Unknown
  Artificiall/Consensus sequence
atggacagagccttttgcagagagaaggaacaaagaacaacaaacgaagaggagctcgatatgtccatattagatgtgtttgcgctgctgggcggcgtgggcctgttcctgtacggcatgatgcagatgtccgatgggctgaaaaatgccgcaggcgatcatctgcgtattattttggaaaaggcgactcggaaccgggttgtctctgttttggtaggcgttctggtcacactgatgattcagagctcctccgcgactgacgtaatggtgatcggctttgtcaactccgggctgatgaacctgtcccaagccctgggcgtgattatgggggccaacatcggcaccaccgtaacggctcagctcaccgcattcaacctcagcgcttacgcaccggtgatcctgtttgtgggcgcggtgatgtacctgtttatgaaaaaagcccaggtgcggtatgtcggatcggtgattatggggttcgggatgctgtttgagggcattgccctgatgaaggcggccattgtgcccatgtcggagacgccggaatttgtggccatgctccggggcatttccaatcctgcggccgccctgctctttggcctggcctttaccgccctggtccagagctcttcctcgtctatcgcaatttttcagacctttgccatccagggcatcctggactaccagaccacggtatatctgatcatcggcgccgccgtgggttcggtgacacccaacctgctggcctccctgaccaccaaccggaacggcaagcgcagtgcgcttctgaacctgatcttcaacctgatccgggcctgtattctgatgttgctgatcacggtatttcctcgggtactcacgctgatccaaagccttgctcctggggacatcggacggcagattgcccacacccataccctgtttgccatctttgccgttctggtggagctgcctctgtccaatctgattgtgcgtctgtcccgaaagatgcttcctgtgctcccctctgaaacccagaaggcagagcaccagcgcctggtctatatgacccagctggacaccattccagtggcggtggctctgagccaggccaagctggagatcgtccgcatggggaaatttgccgagcgcaatctgcgcactgccattgactgcgtcctggagcgggatgaggaaaagcgccggcaggttctggagaccgaggcggtggtggattacctggacggccagattacccaggccctgatcaacatgcgttaccaccatatgacggacaaggagctcaacaggctctcccgaatgctgctggtggtctcggacatcgagcgcatcagtgaccacgctgag

SEQ ID NO: 941 - DNA, 678 bp, Unknown
  Artificiall/Consensus sequence
atgaaaaaacagatcaaacaacatcagaagcgggagcgcaagctccaaaaacagcgcttaaaggaactgcggggccggcgattggggctgtacatccacattcctttttgcaggcaaaagtgtgactactgtgatttttactctttgccggggaatggggaccggatggaagattatataaaggccctgaccctccatttggaggaggtggccccgcggacagagggctttgctgtggatacggtctatgttggcggcggaactcccagcgtcctgggggaggagcggctgaaacggctgctgaaaacggtggataagcgctaccaattggagctccactgcgagaccacggtagaggtaaatccggagagcgtgacgccccggctgctgaaaaccctgcacaaagggggcgtcaaccggatctccatgggaatccagtcctgccacgacgaggaactggccctcatcaaccggccccacacctttgcccaggcccaggaggcggtggggatgatccggggagcgggctttaaaaacctaaatctggacctgatcttcggcctgcccagtcagaccatggaccgatggcaggagtcggtggaggcggtgctggccctggagccggagcacctgtccctgtacggactgaccctggaggagggcacccccctgtggcag

SEQ ID NO: 942 - DNA, 852 bp, Unknown
  Artificiall/Consensus sequence
atgctcgagctgacgcggacactctgcggcctctccggcgtatccagccgggaagaggatgtgcggagctatctggccaacgccctccggccccatgtgacgcacatggagacggacgccatgggcaatctgattgccttcaaagcggggcggaagcgcaccggcagcaagttgctgctggacgcccacatggacgaggtggggatcatggtttccggctacactgccgacggttgcctgcgcttttcctttgtgggcggcgtggaccggcgggtggtcatcgggaaacgggtttatatcggaaaagaacgcattttgggcgtttttggcatgaaaccggttcacttgtccacgaaagaggagcgaaaatccgttccgaagctggagtccctctacattgacatcggagccaaggatgaggcggaagcccgggccagggtaaagctgggagaggtcggcgtgttcgacccggagacgttgttgtttggcgacgggttcctcaaggccaaagccattgacgaccgggcgggctgtgccgcgctactgaaactggcccgggaggagctgcccatggactgcacctttgtgttttccacccaggaagaggtgggaacccggggggcctttgccagttctttttccgtgaagccggagattgctctggtgctggaggccactacggcggcggacctgccgggtactcccagcggaaagcgggtgtgcgtcccggggaatggcgttgtgatcccctatatggacggcggtacgatttacgaccggcggctctttgaacagctgcgggcgctggccgaagaacatcaaatcccctggcagaccaaggaatacctgtcc

SEQ ID NO: 943 - DNA, 1122 bp, Unknown
  Artificiall/Consensus sequence
accgtccaggaaaacctggtgggcatccgggtggtaaaatcctacgtccgggaggagtttgaaaagaccaagttcaaggcctccaacgacgcctttacccaagccggtatgaacgtgagcctgcgcatcatcctcatgcagcccatgatgatgatcggtatctccgccgccaccgtgttgattctctacctgggcggccagaccgtccttcagggcgatctggaaatcggcctgctctcctccctgctcaactacgtgctgatggtgctgatgagcgtgatgatggtggggatgtgtctgctcatgtacacccgggccaaggcctgcgctcagcgtatctttgaggtgatcgacaccacctctgatattcaggacggctctgtccccgctctgcccgagaaaaccggccgggtggagttccgggacgtctcctttaagtacagcacttccggctccggtgacgacgtactcacccacatcagcttcaccgcccagcccggccaggtggtggccatcatcggcggcaccggcgagggcaaatccaccctggtcaacctgatcccccggttctacgacgtaaccggcggcgagatcctggtggacggcgtcaacgtaaaagactatcctctggatgaactccggggccgcatcggcatggtgctccagagcaacgtgctcttctcgggcaccatccgggagaacctgctgtggggcgacgaaaacgccaccgaggaacagatgatccaagcggccaaggacgcccaggcctatgacttcatcatgtccttccccgacggctttgacactcgcctggaacagggcggcgtcaacgtctccggcgggcagaaacagcggctgtgcatcgcccgtgccatgctgaagaaaccctccatcctgattctggatgactccacctccgccgtggactccgccaccgaggccctgattcgggagtccttccataccaacctgaaggacaccaccgtctttatcatcgcccagcgcatcagttcggtccaggacgccgatcagatcgttatcctggacgacggtatcatcgccggcgccggttcccataatcagctgatggcagagaacaaaatctaccaggaaatctaccac

SEQ ID NO: 944 - DNA, 1422 bp, Unknown
  Artificiall/Consensus sequence
atgatcctggcaggccccctcctgttggttctttcaattgcgacgttgtccggtatttttggcacagtgggcgcccaggcgattggcgtctcgctctggatgattttctggtggattacacgtcccgtgcatatcacgattaccgcgctgattcccgcaattgccaatgcatttttgaacatggtccccatggccgacatcatctcgcagtattccagtgagagcattgttctggtctttgcatctggcctgattatccagccttgggcttccattggcctggaccgccggattgcgctgaaggtcctctctgtggtcgggccttccatgaagtcccaggtgattgtctggctgttcgcaaccattattttctccacggttctgcctaacatcgcagtcgttaccctgttctgccccatcgcagttgcaatgctgaaggcggccggacacgaggacatcacccgttctgatgcggccctgcccatcatgctggcgatttcctggggcgtcagcctcggcggcggcggcacccccatcggcggcgctatgaaccaggttgcgatcaccgctctgcaggagttcaccggcaaggagttcatgtattctgactggctcatccgcatcctgccctacaccgttatcgccggcatcgtaatgtacttcggtatgatgctgctgcccatgaatcggaagattaagcgcctggagggaaccaaggagttcttcaaggaaagctacgccgagcttggccccatgaagtgggaagaaaagttctgcctgggtgcattcgttctggcactgctcctggccttcacccggacctggtacgcagcgctcctgcccggcctggcgcccgcttattccatgctgaccctgggcttcatctgcttctttgtgatgaccaagagaaacggaaaatctgtcgcgctgctcacttgggaagaggcgcagcatggcatgatgtggggcatgatgctcctcttcgccagcggtatggccatgggcaagctgctcaacggctccggtgcaagtgcctgtctggcagatatgatctctgccctgaatttggatggcggccttaccaccatcattattctggtcgtcttcacccggctcatttccgaggtgaccaacggcactaccgcagcggcaatctgctgccccatcgtcttcagctttaccagcaagctggggctgaaccccatcccttactggtttatcaccactatggcatacaacgccgagttccttctccccatcagcgttcgcgctgtccccgtcggctacggcctggatgcaaagaagatgctcaagggtggtattcccatgaccattatgaacatggttgtcattattatctttggctatgtttgcatgaagtttgtccccgctttcggcaatctgccctacctcttctcataa

SEQ ID NO: 945 - DNA, 1083 bp, Unknown
  Artificiall/Consensus sequence
atgagtcattttcgaagcaccacccacgcccgattagctagaatcgcccttcggattgccctcacattagccctggcattcggccttgtactgttattcgcaaattccgaaaaggcaaaaacggtttacgagatcacattggatgacacaacctataccgttgaaagttattccgatgaaatggatgatgtgttggacgaagccggtctggaactgtccgctagcgattgtatcgacaccgccgaaaatcaaaaaaaggacacggtggaagtttctatcacccacaaacagtatgttacagttacctgtgacggcgccgccgtatccgtcctcaccgacgagggggaaacggtctctgacgtgctaggtcagttgaacatcaagttgggcaaaaacgatttgatttcagaggatctgaacacacaggtaagcagtggcgattccatcgtaatcaaccgtgtcaaaatcacttataagaaaaaaacaaagcagattccctacagctccaagcgggttgcaagcctggagatggcacgcggtacggaagcggtcacccagaagggtgtaaagggcaaaaccgtctacacctacgagctcaagtccattgacggcggcaagcctaccgctaccctggtcaacaccaagaccaaggagcccgtcacccaggtcacctcttacggaacccgcgttcctgcaccgtctctcagctctctcagccagtctcgcgattacattaccaatatcgacgacgaaaaagggaccatcacaacggtttccggcaacacttattcggtcaagaagaagctggcctgctctgcaactgcttatacggctcatgccggcagtctgactgctaccggccgtaaagccggcgttggcgtcatcgcggtggatcccagagtgatcccctacggaactcggatgtatattcaaacctcgtctggctccgtgctctacggcatcgctgttgcaggggattgcggcggcgcagtcaagggcaacattgttgatctgtatttcaactcttactcggagtgctgttcctttggacggcgcaactgtaccgtttatattctcaactaa

SEQ ID NO: 946 - DNA, 699 bp, Unknown
  Artificiall/Consensus sequence
atggacgagaatatgacaacgctgcaaaaatgggtggacgagagcagcagcatcgtcttttttggcggcgcagggatgtctacggagagcggcgtccccgatttccgcagcaaggacggcctgtacaaccagtgctatgacgacccaccggaaaccattatctcacacagctatttcagctgttacccggagaagttctatcagttttaccgggagaagatgattgctttggatgcagagcccaacgtagggcacctgaagctggcagagctggaacaggcggggaaactcaaggcggtgctgactcaaaatatcgacgggctgcatcagaaggcaggcagcagggaggtactggagctccacggcagcgtccatcggaactactgcatgaagtgcgggaagttctatccggtggagaccattgtgaacggcgacggcattccctggtgcagctgcggcggtatgattaagccggacgtggtgctgtacgaggaggccctggacaacgacgttatgtaccgggcggtggaatacatccgcaaggcggatatgatgattgtggcgggcagctctctggtggtttatccggctgcgggtctgatcaactattataaagggaaacgcctggtgctcatcaaccggtccgctactccctttgacagccaggccgatctggtgatccacaacaccatcggtaag

SEQ ID NO: 947 - DNA, 1620 bp, Unknown
  Artificiall/Consensus sequence
atgaagctcaaacgtaaaaaaacaggcgttttgattttgtcgatatttgccgtcattctggctgctgttgttgccacgctggcggtactgcatatttttgatgtttttgggaatcgcggcacctttttgaaggggacaaccatcagtagagtagacgtctctgagctgactgtcagagaggcggaagaacgggtgcagcaagccattgaccactatcagctgactgtgacctttgcggagggaacggagcactataccgcagaggaattggggttgggcatggatggcatcagcgccttgaaggagctgatgcgggagcagcacaaagctgtggctgacgcctctgactccggatcggcgtccgggcaggagctggagctgacggcgaaggacctgcttcggtgcgagaacgagacgtggaaagagggcgtggcgcagctgccggagctgagcgcctgtgcggaccggagcagccaggatgctcgtctggtctatgacgcggaaaaggcggagtttaccattgagcgggagatagtgggcggcgtcattgagtcagcggagctgatcgcggccattgaatcccaggcgtgccagctgaaaacagagctgaatgccgtgaccagcggcctttatgacggcaaatcggtgcggaccgccgacagtgcggagatgcagtccgccttggcccaggcggagaacaagctgaacctttcgctgacctatacttatgatgtaacacgtgcagacatccatggggaggaacgcatcgacaaaaacctgctgtcccaatggctctacgtagaaaaggacggtgtaacggtgtcggtcaacggggaccggcttcaggagtacgtcacaaggatgcacaacgcctactcggtgaaggaggcggggctctctcagtttgtcacttcgatcggcacctatgtagcggtaaatgcaccggcggcagatgagaccgtggatacggatgccctgtacaacgacatcgaacgctgcattgaacgcctttacagcggaaagagagaagcgccctatgactccaccagcgccggcgttgccggcacgacccatttgggaggcacctatgtggagattgacctggatcaccagcatctttatctgtatgttgataagaaactgatcacagagggggacatctgttccggctgtgtggccgacggaaacgcgacgccggagggcctctatacgatcaagagcaaggaccacgaccgctatctgcggggagagggctactgcgactgggtcagttacttcatgccatttaacggaggcgtagggcttcatgacgctacctggcggggcgaaggggactacggcggggaggtctatctggaggaaggttcccacggctgtatcaacatgccgctggagctagccaaaacaattgatgaaaatgtggaagtcggaacatatgtcatcctctacggcggacagcccaatccagcgcagaacagtcaggcgatttatgggacctcccattatacgaaaacactggggagcgacagcttttccttggacgcctatacgacaggcgatggcgcgctgtcctatgcctccagcgataccagcgttgtcacggttgaccaggaaggcggg

SEQ ID NO: 948 - DNA, 1086 bp, Unknown
  Artificiall/Consensus sequence
gggatgatgcggctgccggtagtgaacagcgatgatgctgtggtagatgaagttgctgcggccgaaatgattgactatgcctatcagaacggcatcaattactttgacaccgcctggggctatcacaatgggaattcggagctagtagcaggcaagtgcctctccaggtaccccagagagagctactacctggcgaccaagtttccgggctacgaccctgccaacatgaataaggtggaggagatttttgaagcgcagctggagaaatgccagacgccctatttcgacttctacctgtttcacaatgtgtatgagggcaatatcgacgactatctgaacccgaagtttgggattatggactacttgctgaagcagaaggccaatggacgcatttgtcatctgggtttttccgcccatggatcggtggaagtgatcagacggtttctggacgcctatggcgagcagatggaattctgtcagttgcagttaaactacatggactggcattttcagggcgccgaggagaaggtaaagctgatttgggaagcggggatccccatttgggttatggagcctctgcgcggcggcaggctggcgaaggcaaccgatgcggttacagcgaagctccaggaaatgcgcccggatgagagcattcccgcatgggcattccgtttcctccaggcgattcccggcgtgaccatggttctttccggcatgtccgatctgggccagctcaaagcgaacgtgtcaacttggcagacagacagtcctctggacaaagcggaatttgatatgctgatcgagcttgcggatgaggaaacgcgcaagggcgggcttccctgcacggcctgtcattactgcaccagccactgtcctcaaaatctgccgattcctgatctgatcgccctgtacaatgaacataagatcaccggcggcgggtttatcgcgcccatggctgtggccagcatgccgaaggagcagcacccctccaactgtatcgggtgccaaagctgtgaaaccgtttgcccgcagagaattaaaatttccgaaatgatggcggactttacagaaatgctgaagggttaa

SEQ ID NO: 949 - DNA, 1377 bp, Unknown
  Artificiall/Consensus sequence
atgtttcagggactttttcagagcgctgaggacgaactgaccagacagcgtgccacagatgtggaggatatcaagcgaaaactgctggagattcttttgggaatggaacaacttgacctaaagcatctcccggatcatacggttctagtggtcagcgatctcgctccatccgtgacagccgagatggatcacgacagcgtcatcggtgtcgttacggaaaacggcggtatgacttcacactcggccattctctcaagggcgttggagattccggcggttctcagtgtccctgatgcgctctctaaaatcaaagatggacagaaactcattgttgacggcacaaacggcactgttattgtggatccgtccgcagaaacaacggtaaaatatcagacgtgccgcgatgactacatacgggaaaaggaacttctgaaggcatttcaggggaaagccaccgttacaagagacggagatccccgccaggttttctgtaacatcggaaatccgaaagacgcggaaagcgctgcggaacatgacggtgagggcataggccttttccgaacggaatttctctttatggatcgtgatgcgcgcccggatgaagagacgcagtatgcggcttaccggcaggtttgccagacgctgaagggcaaaaccgtcatcatccgcactttggatgtgggaggagacaaggacattccgtacatccatatggagaaagaagagaatccatttcttggttatcgcgccgtgcgctactgtctgagcaatcaggaagcctataagatacagcttagggcgttgattcgagcgggagcagacaccggtggaaatctccggattatgattccgatggtgaccactgccaccgagattcagactgtacgtaggttggcagaggagatttgtcgtgaaaccagacttcccatgcctgagatcgggactatgatcgaaacgccggcggcctttattatggcggatgttctggccaaatacagtgatttttttagtatcggcaccaatgatttgacccaatacattatggcggctgacagaggtaacagtagtgtggcatatctttacaaagcttacgacccggctgtgctgcgtgcccttcgggctgtcatcacagctggtgtaagtgccggcataccggtcggcatgtgcggcgaagcggccgcagatccactcctgattccgctgctcatcggatttgggatggaggagttttcggtttctcccgccgccgtccttaaaacgcgccgtgaaatcagtcggtggacagtgacagaggcgaaaaagattgcagatcatgtattgactttggagacggcagacgaagtcgagcgatatattgccggggtaggaaagcgataa

SEQ ID NO: 950 - DNA, 1329 bp, Unknown
  Artificiall/Consensus sequence
atgacctacacaagagaggacattgtccgtattgtgcaagaggaggatgtcaagtttatccgaatgcagtttgtggacatcttcggccagctgaaaaacgtggccatcacagccggtcagctggagaaggccttagataaccggatcatgatcgacggcagctctatcgagggctttgtgcgggtcaacgaatcggatcagtccctgcggccggacctgggcagctttgccatctatccctggcggcccagccacggcagggtggcccggctgctctgcgatgtgtacaatccggacggcacaccttttatcggcgacccccggctggtattgcgcaaggtgatcgccagagcgcggaaccggggccttacattaaatgtagggccggagtgtgagttcttcctgttccagaccgacggcgagggtctccccctggtgaagaccaatgacgaggccggctactttgatctgggccccctggaccacggggagtccacccgccgggaggtctgcctgaatctggaggagatggggtttgtggtggaggcatcccaccacgaggtggctccgggccagcacgagatcgacatcaagtacggcgaagccatggatgctgcggacaatattatgacctttaagctggcggtgaaaactctggcccagcgcaacggcctccatgccaccttcatgcccaagcccctgtctggcaagagcggttccgggatgcatatcaatatgtccttgttcaaaggcgaaaagaacctcttctatgacgccggcggggaacacggcctgtcccgggaggcctatggctttatcgccggtattatggagcacatcaaggccatcactgctatcaccaacccgctggtcaactcctataaacggctggggcccggctatgaggccccctgctactgcgcctggtccgccaacaaccgcagcgctctgattcggattccgttggttcgggggcgtaccactcgtgtagagctgcgcagcccagacccctcctgcaatccctatctggccctggctgtgtgcctggcagcgggactggacggcctggagcggggcctgactccgccgccggagatcaatgacgacctgtttgccatctccgatgaggagtgccgggccagaggcatcgactgtctgcccgccaccctgtgggaggcgctggaggagctgaaaaaggatcagtatattctggacgtgctggggccccacgtctctaaggcctatatcagcggcaaggagaaagagtgggaggaataccgcactcaggtttccgaatgggagcgcaggaagtatctgggaaactactaa

SEQ ID NO: 951 - DNA, 2415 bp, Unknown
  Artificiall/Consensus sequence
gttaccacccgcggctactccatccagtgccgtgtcactaccgaggatcccaccaacaactttgcaccggacaccggtaagatcacggcttatcgttccagcggtggtttcggtattcgtctggacgcgggcaacacctatgtaggcgcggaaatcaccccctactacgacagcctgctggtgaagatcactgcattcgacaacacctttgagggggtctgccgtaaggctctgcgcgccctgagtgagacccgaatccgtggtgtcaagaccaatatctccttcgtcactaatattctgactaacccggtgttccaggccggtcagtgctataccaagttcattgacgatacaccggagctgttctccatcacgccctcccagaaccgggctaacaagatgctggagtacatcggcaatatcgtagtcaacgatcccactgccggcaagaagctgtatgagaccccccgcttccccgaagtggcgcctggcgatcccaagcctggcctgaagcagttcctggaccagaatggccctgtggccctgagcaagtgggtgatggatcagaagaagctgctggttaccgacacgaccctgcgtgacgcccatcagagcctgttggccactcgtgtccgtacccgcgacatggttaagggtgccagcgcaacggccaagatcctcagcgattgcttctccctggagatgtggggcggcgctaccttcgacgtggcatatcgcttcctgcatgagtctccctgggagcgtctggactggctgcgtaaggaaatccccaatattcccttccagatgctgctccgcggcgccaataccgtgggctacaccaactaccccgacaatgtggttcgtgaattcgtccgtctgtccgcagagggcggcattgacgtgttccgtattttcgactccctgaactggctgcccggcatggaaatcgctatcgacgaggcactgaagcagaacaagttcgtggaaggtaccatctgctacaccggcgatgtatctgacctgtcccgcgataagtacacgatgaagtactatgtggatctggcgaagcagctgcagaatctgggctgtcactctgtggccatcaaggatatgtccggcctgctgaagccctatgcggcaaagatcctggtctctggcctgaaggatgcgctggatattccgattcacctgcatacccacaacactaccggcaaccaggttgccacctgcctgatggctgccgaagctggcgtggatattgtggatttggcaatttcctccatgagctctctgaccagtcagccctcgctgaacgcagtggttgccgccctggaaggccaggagcgtgataccggtctgaatatgatggatctccagaagctgaccgattactgggcagacgttagggaacggtacgtggagttcgagtccgacctgaagactccggtgaccgacatttatcgctatgagattcctggcggccagtacaccaacctgaagccccaggtggagagtctcaatctgggccaccgtttcctggaagttaaggagatgtacaagaaggtcaacgacatgctgggcgacctggtcaaggtgaccccgtcctccaagatggtgggcgacctggcgatcttcatggtgcagaacgacctgactcccgagaacattgtggaaaagggcgcagatctgagctatcccgactccgtcgtcagctacttcaagggcatgatgggccagcccgcatggggcttcccggaagacttgcagaagatcgtgctgaagggcgaggagcccatcacctgccgtcccggcgcactgctgccacctgcggacttcgaggaagtgaaaaagcacctgagccccatctgcggctatgagccctctgagcgtgatatcatttcctggtgcatctacccgaaggtcctggaagacttcttcaagacccgtgcagaacacggctacattacccgtctgggcagccatgtttacttccatggcctggcagtgggtgagaccaaccgggtgaacattgaagaaggtaagacgctggtgatcaagtacctgggtctgggcgatgtgaacgaagacggtacccgcgtggttcagttcgagctgaacggtatgcgccgtgaagtcaatgttccggataagagcgccaaggctgctgtacatacagtggaaatggcaaagcctgatgacaagagccaggtgggtgcttctattcccggcgcagtcagcaaggttcaggtaaagaagggcgacaaggtaaaggaaaatgacgtcctgattatcatcgaggccatgaagatggagaccagtgtcgttgcccgtatggaaggcgtggtggacgagatcaaggttgaagcgggtgacaatgttgtcgccggtcagctgatgatgacgctgaaataa

SEQ ID NO: 952 - DNA, 672 bp, Unknown
  Artificiall/Consensus sequence
agcatcgtcgacgagacctgcaacctggcagagtgcgcaccgaccctgatcatgtcccactccctggagaacaacactctgtgcatcggcgaaaaggaagttttcgttgttgacgccatctttgatgacttcatcgaagcaatgaaggccaccggcatggtccgtatgctgaccgacgaagaggcagccaaggtcaccgctaccgctctgcagcccaacgaaaaggaaatcagcggctattcccccgtcaagaagttcgtcggcaagaacgccaacgtcattctggaggcagctggcgtcgcatgtgaaggcgatccccgtaccgctgttatgatcgttgacaacgaccatcccttcgtgcagaccgagcagctgatgcccattctgcccgtcgtccgctgcaaggacttcgaggaagccatggaacgcgctgtcgccgctgagcacggcaaccgccacgccgcttccatctggtctgaggacatcaagcgcgtcactgccttcggcaaggccgtcaagaccaccgcttatgtacagtgcgccatgaccatgaccgctgtgcccggctctcccaccatcgctactcccaccggcgaaggccccaccggtccctggaccttcctgcgcaagagaagactgtcccagggcggcggccgcggttacatcgcctaa

SEQ ID NO: 953 - DNA, 1164 bp, Unknown
  Artificiall/Consensus sequence
atgaatgaaaaaatgacaaaggtagaagcactgattgcccgctccaaggcagcacaggcacagttcgctttcgcaacccaggagcaggccgacgcagcggcacgtgccatttgcaaagtggtctatgacaactgtgagaccctgggccctatggccgctgaagaatcccgtatgggcagcgtccaggataaaattgcaaagtgccgcaataagtcctctcagatctggtacagcctgaagggcaagaagtcctgtgatattatcaacagaattgaagaacgccgcatgatcgaagtggcaaagccggtaggtgtagtcgccagcattatcccctctaccaatccggtggtcacccccatgagcaatggcgcgtttgcactcaagtgccgctgctccgttatctttgccccccatccccgtgctgtgaagtgcaccaagctgctggtagagctgttccgtgctgagctggcgaagctgggtctgccggaagatctgattctgggcctggaagaggtctccaacgaagtgactgccgaactgatgagcgcggccgacatgatcgtcgctaccggcggcatggggatgggcaaggccgcatactcctccggcaagcccgccatcggcgtgggccagggcaatgtacagtgcattgtggacgaagacgctgatctggcagatgccgccggcaagatcatcaccggtcgttccttcgacaacggcctgatctgcctgggcgaacagaccgtgttcgtacccgaaggaaagtatgacgcatttgtcgacgaaatggtgaagcagggcgcttactatgtggatgatcccgccgacctgaacacgctgcgggagggcttgttccccgagggcggcgcattcagccgcgtcgtggtcggcatgtatgcagaccaggtcgcgaaggaactgggtctgcctgcccccgaaggcacacgggtgatcctggcaaaggccagcgcaacaggcgccggcgatgttctgtgccgtgaaaagctgtgcccggttctctccgtgatgccctataagacctttaaggaaggcgtggccatgatggtcgagaacctggagcacgaaggcaagggccacagcatctgcgtccactccaacactcccgaaaacgtggaatacgccgccattcagtgcgcagtctcc

SEQ ID NO: 954 - DNA, 768 bp, Unknown
  Artificiall/Consensus sequence
gtgcccgggcagctgggaggaaatctgaagccggactatgtgattcccttcaagctggaaaagaaagaggctgttgctgcactgacccggcactacaagggaaaactatttttgccgaagtcctttaaaaatcaaaaccacattgaggagattcagggggtttatgtacccttctggctctttgacggggagacggatgccgacattacctttgacgccacccgaatccatagccaccgggagggagatgaggaggtcacaatcacagaacactatcgggtgcgtcggaagggaacggtgtgctttgagaaggttccggtggacggatcctccaagatgccggatgcccacatggatgccattgagccctttgactattcagagctgaagccgttttcgaccgcctatctccccggttatttggcggataaatatgatgtggatgcggaagcgtgtgcccagcgggcagatgagcggattcgaaccagcacagaggaggcgcttgccgccagtgtgatcggctatgccagcgtgacaccggaacaggttgatattcgattgcagcgcggccaggtcaaatacgcccttctgccggtttggatgctccacaccggctggcagggaaaacagttcctctttgccatgaacggacagacggggaaattgatcggagacctgccggtgtccaaaggcagggtagctgcctgggcagccggtgtgttctgtgtggcggcggcagttctgacgggactgcagctcctgctgtga

SEQ ID NO: 955 - DNA, 1113 bp, Unknown
  Artificiall/Consensus sequence
atgctggcagtgcttctgtcggcggggctgctggccgtgagcaccggctgcggcgccctgctggagcgggactacacccaggtaaccgaccatgtggatcagacggcggacaccggcgacgccaccgccctccgggcggagggctacgctgacctggtcagcagcgcccagtactttgtgaccatgggggccgccaccggcacggtccacctgtaccagtacacgggggacattgagcaggcggtgaacaacgcctgtgacgccattctgtacagcgacccggtgggggcctatgccctccgggacgtgacatgcgagtacacccacattgtgtcctattacgagtgcgtgttcacctaccgctaccgccggactatggaccagattgccgccatccagccggtcaacggcaaggcggccttccggcgggaggtggcggcggcgctgaccgggtttgccggccagctggtgctgaaaagcagcagctattacgattcggcggaaacggtccagcgggagatctgggaggtctattacgacacgccggaggcggcgctggcccccccgaagatcaccgtacagctctaccccaaccggggagccgcccgggtggtggagatcaacctggactggggtctggcccggacggtgctggaagagcaggccgaggaggtctccgccgcagctgcccgcattgtgggagaggacagcggcaccgatgtcaccaacgcctggctcctctatacccggctgcgcagcggtctggactggagcccggagggggagagcagtgtatatcatgccctggtagagggaaccgccaacagcgaaggggtggccatggcctaccggctgctctgtgatcgggccgggatcacctgtcaggtggtccgggggacccggaagagtcaggtccactgctggaatctgatcaccattgacggcgtcagctggcacctggacgtgacggccggggagaaccgcggttccttcctccacaccgatgaggagatggcccaggcgtgtagctggtcccgggaggactacccggtctgcaacggggaaaccgcagtcgtcgagccggctgcggcggacagcagtgaggccggttga

SEQ ID NO: 956 - DNA, 891 bp, Unknown
  Artificiall/Consensus sequence
atggacatccgcatactcaagtatttcctgatggctgccagggaggaaaatatcaccaaggcggcccagctcttgcacattacacagccaacgctgtcccgccagttgaagcagttagaggaggaactaggcgtgaaactgttccagcggggaaggcacagcatctatctgaccaacgaagggatgctctttcggcgcagggcacaggagttggtaaatcttgcggaaaaagcaaaaggtgaactgtttcctcaggaggaggaaatgaccggtgaggtgtccatcggatgcggagaactgctgagtatggaagaactttctgaaattatcactgctttcagtaagaggcattcgctggtcaaattccatctgcgcagcggttataacgatgacatcaaagagtggatcgagcagggcatcttggatatggggctgctgatcgaaccggtggatattggaaagtatgagtttgtgcggatgaagcagcgggaggaatggggagttctcgtccgagaggactcaccgtttgctgcgcaggatgccattcgcccgggagacttggttggaataccggtggtgacaacgatggatagccctgttcacaaagaacttgccaattggtctagtgattacgcaaaagagatggattccgtcatgacatacaatctcctgtacaatgcggcggtgattgcccgaaagaggattggaccggtgatatgtctgaagcttgcctgccattacgatgatttggtcttcattccgctatctccgacactcaagctcagttccgttctggcatggaaggagcatcagacgttctccaatacggtcagtgcgtttatccagtttgcaaagaaatacgaaaaaagcatttctaataatgaaaactag

SEQ ID NO: 957 - DNA, 1158 bp, Unknown
  Artificiall/Consensus sequence
atgaaacgtatgttgactgggttgctggccctgtgtttgctctggcaggggattcccactgcctttgctgccggcaaggaggccaagagctccggcgtagcggtttccgccaagagcgttatcttggtggagcgggagaccggcaccgtgctgtatcagcaggcggagcacgagaagctggagcctgcctcagtgaccaaggtaatgaccatgctgctggtggcggaggccattgacgggggacagatttccatggatgaccaggtgacctgctccgcttacgccgcctccatggggggcagccaggtgtacctggaggagggggaacagatgtccgtccacgaccttctcaaggcggtggcggtggcctcgggcaatgacgccgccgtggctctggcggagtttgtgtccggcagtgagtccgcctttgtggataagatgaaccagcgggcggcggagctggggatgaaggatactcacttctgcaactgcaacggcctgcccgcaaagggccacgtgaccagcgcctatgacatcgctctgatgagctgccagctgctgaagcacgacctgatccgggagtacaccggcacctggatggacaccatacgggacggagagttccagctggccaacaccaacaagctgatttactactacgacggtgccaccggcctgaaaaccggctccacctccagcgctgggttctgtatctccgcctcagccctccgggacgatatggagctggtggcggtggtcctgggcagctccacttccaaggagcggtttgacagcgccaaggccctgctgaactatggctttggcgcctacgccctggcggacgtgacccccaaagaggccctgcccgcgctgccggtgaagatgggggaggcggacacggtgcaggtgggactgtcggaggtcggcaagctgctggtgaagaaggatcagctgagcagcgttaccacagaggtagagctgaaggagagcctccaggcgccggtggccaagggcgccgaggtgggccagctggtgatctcggtggacggcaaggaggcgcgccggatcgccctggtgacccaggctgaggtgcctcgcctgaccttctccggcatcttcagcgggatgctggagcgcatggccacggggcacgcttag

SEQ ID NO: 958 - DNA, 1110 bp, Unknown
  Artificiall/Consensus sequence
cacggctacttcaccctcgttggatgctatctgctgatgatgttttacaccaccgtcgccggttggatgctgcattacttttatctgactgccgttggaaagtttgaggggctggggtctaccgaaatcaccaattccttttcggaaatgctgggacaacctggcatcatgacattctggatggtgtttgtggtcgcgcttgggattgtggtctgtgtcaaggggctgcaaaatggtctggaacgcatcaccaaagtgatgatgatcgccctccttctgattatggtggttttagcggtcaacagctttaccatgcccggcgcaaaggaggggctctccttctaccttctgccggacttcgcccggatgcgggagatcggcgtcatcagcactttggtcggcgccatgaaccaggccttctttaccctgagtctcggcatcggcgccatggcgatcttcggcagctatatcggaaagcagcactctctgctgggagaatctgcgcgagtcgtactcctggatacctttgtggccatcacagcaggtctgattattttccccgcctgctttacctatcacgttgaccagacctccggtcccagcctgatttttattaccctccccaatatctttgccaatatgcccatgggcagagtgtggggcagcctgttcttcctgtttatgtctttcgccgccctgtccaccgtatttgcagtatttgaaaacatcatttgctgtggcatggaactgaccgggtgcagcaggaaaaagtcctctctgttcaactttgtactcattaccctgctctctctcccctgcgtactggggtacaatctctggagctgggacgggtttgccgtattcggcggggcgatactggacctggaggacttcctggtcagcaacctcttccttcccctcggttccctgatctatctgctattctgcgtcacccggtacggctggggctggaaaaactttaaggcagaggcaaacaccggcaacggattgaaaatgcacgattggatgcgggtatacctcacctaccttcttcccctgattgtgctgtttatctttgccttcggcatttacgataagttctttgcctga

SEQ ID NO: 959 - DNA, 1221 bp, Unknown
  Artificiall/Consensus sequence
atgtcttttaggaacgcttatcaagcatggctggacagtgcagctctgtccccggaggaaaaggaagagctgcggggaattgccaacgatccgaaggagattgaaagtcgattctttgaccagctctcctttggcaccgccggtctccgcggcaccatgtgtaccggactccatcagatgaatatccatgttatccgccacacgacccaggcctttgcggaagtcgtcaaggcggaagggactgctgcctgccagcagggcgttgccatctgctttgactgccggaatcactctgccgagttcgccagagaggccgcctgcgtgatggcggccaacgatattcaggtccgcctgtttgagtccatgcggccgacaccggagctttcctttgcggttcggaagtatggctgtaaggcgggaatcaacgtcacagcttctcacaatcccaaggagtacaacggctacaaagtatactgggaggacggagcccagcttccgcccaagcatgcggatgccattgcggcaaaaatgaaggagctggacgtatttgcttcggtgcgccggatggactacgaagcggcactcgccgtcggcaaaatcacgttgctgggtgcggagacggatgaggcgtttttggctgaggtcatggggctggtcaatgaccgggcctgcgttgcccgggttgccgaccgcttctccctggtctatacccccttccacggcaccggatatcagctgatcccggaggcgctcaaacgcttgggcatgaagcatgtcctctgtgttcccgagcagatggttatcgacggtgacttcccgactgtagcctcccccaacccggaaaatgccgagagctttgccctggcagtggagctggccaaggcccacagctgtgatctgatcgtgggcagcgacccggatgcggatcgagtgggggtcatggtccgcaacgcaacggggacctatgaagtgctctccggcaaccagacaggggttcttttgctggactacctcattggcgccaaaaagcgggccggaaccctgccggacaatgcctacgccaataccaccattgtcaccactcagatggtggataaaatctgtgccgtcaacggcatccatactgcccgcacctttaccggcttcaagttcctggcggagaaaaaggatgcgctggagaagaacggtgcaggtaaggtcttcttctcctttgaggagtcc

SEQ ID NO: 960 - DNA, 621 bp, Unknown
  Artificiall/Consensus sequence
atgagagtagtcagtctgatcgaaaataccggaaaacggatggatttacaaacggaacatggactgagtttgtatatcgaaactgcggggcataaggtgctcttcgacaccggagcaacggaccgctttctggaaaacgcggagaagctgggggttgatcttacagcggttgataccctggtgctctcccacggccactatgatcacacggggggcgtcaaggtttttttagagcgcaaccagcaggcgaaggtttatatccgagaaagcgcgtttgcgccgttttatcacagcgaagagagtgaacatcgttttatcgggattcaaagtatagaaaaaagcaacccacgcctgaccttaacaaaaggcaatgtggaaattgaccgggagctgacgctgtttacccatgtgcagggacgcaggtgctttccggaaaccaatcggaagctaaagtactttgacggccagatctatcgtcaggatgatttccgccatgaacagaatctggcgatcacggaagcgggaaaacgtgtgatcatttcagggtgctctcacaacggaattgtcaatattctggatgcgtatcaggaactgtttcatcagatgccggatgttgtgatc

SEQ ID NO: 961 - DNA, 1455 bp, Unknown
  Artificiall/Consensus sequence
atgatcgaaaataaggtaaaggcgcaggtatacgacagtgatatgccatcctctgagctggacagcctcattctgacatcggcagaacgcaaaaaggggatttttcgcctgatcattttctccgcaattgggctttttgtattttttggttccgttccctaccaggggtcttctacagttgtgttcagtgttgtctataatttcttccttaatctgtttggcaacgcgatctactggattctgactgcgattgtcgccttgaatttcggtatgcatgtttactttaagtacctgaaaaaggggcaatcaacagccgcttttgcggatgcgtatcgcaatgacaaaatcattcacactgtgctgtatgcccttggcctggtgtatctggttgtctatgccatgcatatgacgattccggatttcaatggaccggagatcattgtcagtgatatgaccggcggcgatgtcatcccgcccgtggtaaagggcgtgctgggtattatcctggcgggagctgttttcatgccgttcctgctgaactatggtgccctggagatcattggcgccattctggaaccgctgatgcgcccgctctttaaggtgcccggaaaagctgcattagatgccgtaacctcctttgtcagttcctcttcgctgggtgtcttgattaccaatcgtctgtggaagaaaaacttgtacacagagcgtgaaatggtgacaattatgacctgcttctctgcggtcagcattggatttgcctatttagtcattgaaactgcggacctggcaaatcagtttgtcaagctctatgcgatcagttttttgatggtatttattatcgaaaccattgttatgcgaatcccgccgatttcccgaaaaagtgatgtatactacaatggagaagttcaaacagagagccagcgcaaggaaggcctgaaattgaacggtaaaacggttgtaaccggtgttaatcgcgccgtacggcgtgccgctatcgcaaaagggattggcgtagatgtcaaattcagcttgaaggacagtgtggtaattctgccgcaggtgctgacgatgctctcggccgttggcgtatccgcgatgattttggcagagtatacgccgatctttacctggctgggttacctgttccagcctattctgagcctatgccaggtaccggaagttgcggcagttgctccgtctatgccagttggcattgcggaaatgctgctgccggttttggttatgaacggtcagaacgtggtgctcagtgaagcggccagagcatttgtggtcttggtctccatggttcagatcatcttcttctcagagactgccacggttatgatggcaactaagtctccgattaagctgtgggagattgtcgtatgcttcctagagagaacaatcattgcaattccgctggcctctattgcgattcatctgtttttcatgtaa

SEQ ID NO: 962 - DNA, 678 bp, Unknown
  Artificiall/Consensus sequence
ccgccggccagcagaaagcagaaggcgctgacgatagtgctcctttgtgtgattctgctggcgacaagcgtaattctgttggacctgaagctccgacctgcgattgtggaaattgcgggtgcggagctggaagcgattatcagcgatgaagtcaaccgggtatgtgcggaggatgcgctggatggagaggtggcctacagcgatctgattacctttcaatatgatgaggaaggcacgctgatcggactgacgaccaatatggcggaattgaacgcactgaaggcgacgattaccagcggcattggaaacaggctggagaatctggggcagacgcagatttcagttccgctggggacggtgtccggcgtggcgctgttttctggtgtagggccgatgattccggtggaaattctcaatgtcaaccggatcaacagccggtttgacagcagctttgaggcggccggcatcaaccagacaagacatcggattgagatgttgatcacagtagatgtggtgctgctgctgccgggaggcagctgtcaggagagctgtaccaatcagattacggtggcggaatcggtgctgatgggagatgtccccacgaactacagctatttcagccagtttgactcagccagcgatgcctccgccgcttaccacgactatggcacagagtaa

SEQ ID NO: 963 - DNA, 522 bp, Unknown
  Artificiall/Consensus sequence
aagctgtgtgagaagctggagacggaagtccgcaggatggatctgggatcggtgattgcagctcagggcgctgccgcaatcaaggagaaggtatccggtacgatgctggccatgtttgtccatgaccgttcgatcacaggcatggcggagtccatccgcagcggcgtggaccggtatctggaggaaaatctccacgaggcgctgctgcccaaagtgcaggcggagctggacttgctggccgggaaaagtccggaggacctttgccgggggatttcggcggatcaggaattgctgcgcaaggtggtggatcgggcttacggcgctgtggtgacctccaaagcggaccaggtgttgggagcgattcatgtgtctgacatcgtggagcagaaaatcaacgggatgaatgtggaggaaatcgagcgcctagtcctgtctgtgatgaaaaacgaactgcgaatgattgtcaatttgggggcgctgatcggctttgtgctgggcatcatcaacgtattcgtcggctga

SEQ ID NO: 964 - DNA, 1197 bp, Unknown
  Artificiall/Consensus sequence
atgtccgcatccccctaccgggtgaccctggaccgcgacaagtggaagggggaaagcgccttctgcaaggaacaggggacggcggagcagttcggcagccagattcagagccccgacggggctatgcgggcgtatcagctctttgtgccgctgattctggtggccgtagtgctctttgccttgatctcctcctgtgggcgactgcatccggagcggtttttgtggtgcctatcggtgattctcaccgcagccgcccccatgtccggtatgctggcattcagccagcccttcctgcgcctgacccggcggctgaacaactccgtggccctggcggggtgggacggcgtgctctccatggaggagggggagacctacctgctggtccgggatgacgatctgttcccggtgggcagcgtgaaatcccagggtattaagacgttccagggggttcctctggagagagtgaccagctgcgccgcctccatgatccggctctcgggcagcggactgaccaagctgttcagcgacctggtccaggtccagggtggatttttccggcgggtggactccatgagctaccacgaagccggtggcctggtggccaccatccggggggaccaggtgatgatcggcaccgccggttttatgacggtgatgcacattcccctgaagcagggcgagtatgtcaaggaggccattttctgtgccatcaacgggcagctccaaggcattttcgccctgaagtacgaccaatcccgggctgttcgccccgccttccaggcgttgctccaggcgggggtaaagccggtgctggccacccgggactttaacatcaccccggcaatgctccaccgacgcttcaagctgccggtgaacaagatggagtatcccaacgtgcggcggcgccatgagctgtccgaatccggtcagagtcacaaccgagtgttgggggccctgatccgccgggacggactgggaccctatgccgatgccatcatcggcgcccggcggctgcgcaaggtggtacggctgaacaccatcctggccctggtggcctcggcggtgggggcagtgctgaccttctatctgacctttatcgcggcgtatctgtccctgagcgccttgaacatgatgttgttcctgctgctctggctggtacccaacctgctgatttcggcggcagtggacaaattctag

SEQ ID NO: 965 - DNA, 831 bp, Unknown
  Artificiall/Consensus sequence
cggtttaccgagacctttgggacccttcgtgagaccggcgtgggcctgtgctgtccggaggcggggcggctgctcttttcccgcccggagccggtgcggttttgtcaccgggagacaccggaagagggaatagccaacgagtgcaaccaggaccggctcagagcactgctgctggcccgggagaaccttgtggggctggtgcagaaccgggatctgccactgacggagcggatgtgccgggcgttggagtttgcccagggggcccagaatgccctagagcggggagagtggaatgcggttgcggcgccagagccggtgtgtgcagaaggtgcggcgctgtccttcggcggcgcggcgcggcagctgtggggctggctggaagaactgtccggcctggaggccatcagcccagcgtggacggaactgctggaggagacaaaaagggtgctggtccagccggaaccagcgattagggcactttggggacggtttcgccgcgctgtgtccgacagatggtatgagtatgaacatctgctggtatatttcctgttccgctattttctcaagtcagtgtacacaggtgattgtctgacgccggtacagctggcggtggtcagtagcctgattgtgggggcgatggacctgacgcgctttgaggcacggggacagtttcctctggcggagcggattcggattgccggactctattccaagcagatggagtactccgaggagaatcgagtggcgttggaggaccggctgatctttgacgagtcgttttcctgccggaaaatggaggggattctggcggcggtggggaaaagagattga

SEQ ID NO: 966 - DNA, 618 bp, Unknown
  Artificiall/Consensus sequence
atgacggaaatcatccgttcgccggacaccgaaacatatcaggcatcgaacagaagcaccgtggcgcagtggatgcacgaacgactggaggtgttctgcacccatgcagtgaagccgctgactctcgccagctatgagagcatcttcaggaattatatctccctcagaatcggggccatgcagcttcaggaggtccggggtacgcacatccagagaattttcaacgatatgattgcagatggttcatccgcaaaaaccgtgaaaaacgtggctgcggtgctacataagtcgctttctgtggcactgaaacaatggctcattcagcagaacccatgtgacgcgacaggcatgccaaaggcacagaaaccggagatacagccgttatctgacagcgagatacccgtctttctgtcagcgtgcgcacaggacgcaatgggacgtgcctttgtgttatgcctcctcgccggcctgagagagggcgagtgtatggggctttcatggaatgatgttgactcctcttcaggccgaatcacggtacggcagcaactgcaaaaagaaaaaagaagggcggaaaatactatatcgctccgacaaagagcgcaaaggtccgggtgttag

SEQ ID NO: 967 - DNA, 3138 bp, Unknown
  Artificiall/Consensus sequence
gtgaaacccatccaactgatcctgtctgcttttggcccctatgccggggaagaacgcattgatttttctcaaatccggggtgggctgtatctgatcacgggagataccggggcagggaagaccacgatttttgatgcgattgtctttgccctttacggtgaaaccagtggaaatagccgtggaatcaccatgcttcggagtgattttgcagcgcccgagacgccgacctttgtgcagctgacgtttgtctatcagggccgccgctatactgtcagacgcagcccggaatacctgcgaaaacggaagcggggcgatggcgttacaaagcagaagaaggacgcggtgctggaggggccggatggccaggtgattaccggagaccgcccggtgacagaggcggtagtggaactgctgcagctttccgctccccagtttaaacaggtggccatgattgcccagggggagttccgcgctctgctggaggcggacagtgaaaaacggggggagattctgcgccacctgttctctacggaccggtatcgggcctttcaggaagcgctgaaagagaggtatgccgcggcgcgggaggaacgcgcagagctgcgccggggagtggagcagctgcttcagacggtacagtgtcctgacaattacggggggaaagcggagttgttggagagcatatcccagggatgtgaccggctggaacagacgttgagcctgttggatgcactggttgcggcggatataacggaacaggcggtggtgcaaaatcaacggaaaaaagagaatgatgcccttttagcgctccaggagcagcggacccgggtggagatctccaatcagcgtttggataatcggaatgaagtccaacggaccctgcatgagctggaacaggagtggagccggtatcagttgctggaggagaagcgtgggctggcggcccgggcgctgcgacaagtgtacccaaaggagggagagtggcagcggctaaaagaggcggtgcagcggttaaaggaggagattgtccgccgggaacaggatgataccgcctgggaggcagagcgggaccatctgcaaagggtgtgcgatcattggaaagaacaggagtcgttggagcaggagtgggagcagactcgtcggcggctggttcgggagctggaacagtacacggtccttgaagatttagagaagcaatgcgctgatttggagcatatgttggcgctggtcaatgaaaaggtggcagagaaccaacggctgacgctggaaaagaagaacgaagaacaggcgctcaatcgaaagctggaactactacagacagtggaagtggatctggaacggctgtcaggagagcgaaaggagacggaggaaaccgtccggaaggggacagagctgctggcagatcaggcgtgcatccgagagcggcaggaacagctcaaagaggaggagaactgctaccagatggaggaagccagatggaaagcagcacgagaagcggcagaccgcgggcaggcggcgtttcttcaaaatcaggctggtctgctggcccgcgggctggcagaggggctgccctgcccagtgtgcgggtcccgaagtcatccagcgccggcagagtgtacggaagaagcggtgtcccaggcggagaatgagcgtttgcaggcccaggcagaacagcagtaccgccactgtgtggccctggccaaccagctgtctgagctgcggggacaggtgacaactgaggaagggcgctttcagcgggagacagagcagttgttggggaaggagaatcgggggaaaacgctggaggagtactgcctggcacaaaaaagacgcttgacagagcaggaacaggcgtgccatactgcggaagaacagtgccgggagaaagcagcggccacagccagaggacggcagctccaggtcgaggtagaggagctgtcggcagagttggcttcactgcggcaggagcgggaggacgtcaagggaacgtggcagacccagactgcgttgtgtgatcaggcaagagccggactgctgtttgccaacgggcgggaggcagaggcggaaatgcaacgcctgacagagcagctggcgcagcagagagcggcgtctgggcaggcgagggaggcgttggaacgccaggagcagaagatggcggaaaaccgggtgctgcttgagacccgcagaggggagctgcccgttcaggagcggcagctggcagaggctcggcaacaatttgagcaggcgctggcaaaggcgggcttccgggatgtgccccactatcaggatgcccttcggacggagggacagccggtagacgaggcctggttggaacggcagcgggagatgctggaggaatactacggcaaggtgcaggccgcagaaggccagctgaaacagctggaccgggaactgaagggagttgcccggcaggagctggcgccgttggatgcgcagattgtggaaaaacgcaggactttagaggcattgggggagcaggagcgcagcctgtacagccgtttacaggcaaaccgaactgttgcggagcgctgtcaatcgtgggcccaggcgctgaatgacacggagcagcgctatctcctccaaaaggaactgtctgacaccgccaacggagagctgaacggccgggcaaagattacctttgagcgctatgcgcagggggcgtttttccgccagattattgcccgggccaaccgcaggctgtatcagatgacagacagtcgatttcagttgatacaacaggagatggcggagaacaaccgcagcaaaaccgggctggaactggatgtgattgaccactatacggggaaaaagcggagcgtgaaaaccctttctggcggcgaggcatttcaggcctctctggccctggctctgggcctgtccgacgtggtccagagccggagcggcggcgtgcagttggatgccatgtttattgacgagggatttggctctctggatgaagatgcgttggaacaggcgatccggatgctccaacagctggcggcgggccagcggctggtggggattatctcccacgtgtcggaattgaaagaagccattgaacgcaaaatagtggtacagggatcggaacagggcagccacgtgaaaattcagttgtaa

SEQ ID NO: 968 - DNA, 585 bp, Unknown
  Artificiall/Consensus sequence
atgacacattatgttacaggcaatacgattaaagcgttgcgtgagaaaaagaagtacacgcagaaacaactggctgaccggctggcggtcagcgacaaaacggtctccaagtgggagacccaaaagggactgccggacatctctctgttggaacctctggcaaaagagctgggggtatcggtggcagagctgctctctggcgagtgcatcaccaaccggaaccgggcgggcaacatgctgcggacgaagttttacgtctgcccggtctgcggcaatgtgattcatgccaccggcgagggagcgttcagctgctgtggcatcgggctgcccgtccaggaggcggagacgtcagaggaagaccacgagattttggtggagcagattgagaacgactactatgtcacgctggagcatccgatgaccaaggagcactacctctcctttatggcttacgtcacgtcggaccgggtgcagctggtcaagctctacccggagcagtcgccggcagcgcggttttcccgtgtgggccacggtgtcttctatgtctactgcaaccggcatggactatataccagaaaaccttaa

SEQ ID NO: 969 - DNA, 1038 bp, Unknown
  Artificiall/Consensus sequence
atgaagataaagcgggctctgggccgcgcgggaaagctcctgatctttttcctcatcgccgccctgctcttctgcctggtcagcgccgtcttcatccccaagtggagaggaccctggggcaacattgatgcagtcgccgggttttacgagctggaggaggacagcattgacacctttatcgtaggcagcagccaggtgatcagcggcgtcgcccccctgcagctgtaccaggaggaagggatccgggcctacaccatcggttcgggccatcagcccgtgatggggtcctactacctgctgaaaaacgccctgctcacccagcccaacatcaaaacggtggtgctggaggtcactgagctctttgtccagagcaacgagccctcctaccggaaggtcttcgactacctgcccctgacctccgtcaagtgggagggcattcaggagcggattcgctgggcggaacttcaggatgaggaacaggggaccgatgtggccccctctgcggcggagtacgtcctgcccatcctgtcctaccacgaccggtggagcgagctcacctatgacgacttcacctaccccttccaggacacccccatacagatccggggccagtccctcctggtggaccagggggccagggacacctaccagcctctggaccccgccagcacagcagtgtgcgctgagcccaaagcggaggcactgtacttcctgcgggccttctgcgcattctgtcaggagcagggcatttccctggtgctgctgaaaactccccggatggactggagcattgagcagtacaacacggtcaacgccgtggccaaggagtacagcgtcccctacctggactttaacaccgcaagtctgaatcgcgccatcggtttcgactacgccacagatatcctgaagggctcggagacccacctgaacctgtccggcgccggcaagctcactgcttatctgggcgactatctgacccggcactgcccggtgctggacgtgcgcaccaaccccgcctatgactggatggaagcggaa

SEQ ID NO: 970 - DNA, 690 bp, Unknown
  Artificiall/Consensus sequence
atgagaaagctgaatttaactagaaccacccgcaaaaacttctttacttacggcctggtcatcctggcttttgtgatccttcagatcctcagcggcacaggtgccatcacttcttcgctgaaaggcatgctggtgccgatctgtgcctatgttgtcatggccatttctctgaacctgacggtcggcgtattgggtgagctctcccttggccacgcaggctttatgagcgtcggcgcttttaccggcaccaccgtggcaatcatgctgcaggacgccgtgcccagcgcagtgctgcggctgctgatcgcactggtcgtgggtgcgcttttcgcggcaattgccggttttctgatcggcattcccgttctgcgtcttcagggcgactacctggccattgtcaccttggcgtttggtgagatcatcaagagtatttttaacaacttctacctgggcattgacagcaagggcctgcacgtcagcctgctgagtgataagaccaacttggcagagggcggaaagctgattatcaaaggccccatgggcatcggtggcattccaaagctctccacctttatctccggctttattctgattatgatcacacttgtggtcgtattcaacttgatcaacagccgctccggacggacgatcatggcaatccgggacaaccggattgcggcagagagtgtc

SEQ ID NO: 971 - DNA, 660 bp, Unknown
  Artificiall/Consensus sequence
atgaaacggtgtgtgagaggtctgttgttccccgtccggtggctggttagggggctctgggcattggtgaagggctgtggccacctgatgggaatgcggcggaatacaaaggtgctggacggagctggctacgaggtgtttgtggcaaagtggctcagggagcagggatttcggcagatacttcatacaggggctaccggtgactttggcgtagaccttgtggccagaaagcacggaatctattatgctgttcagtgtaaatactactcgagttccgtctccggcgccgctgtccaggaggcggtggccgggatggcgtattatcactgcgaccgggccatggtagtcaccaacagccagctgacccggggcgccagggcgttggcagaggccaatcacgttttggtgctggagcacgtggaaccgggaaaggtgacagcggcagggattgccacgccggagcgcatcatcagcgtggcggtctgcacggttctttctgtgctgctcctgcccaaaatacggacggccagcgccaccggatggggtgtgtatgtccttggcattatcctatgctatctgattcccagatgtattctggggctagtggagtggttttggaaccgggcgctggaccggatcgggcgtcagaaagccccctga

SEQ ID NO: 972 - DNA, 762 bp, Unknown
  Artificiall/Consensus sequence
atgatgaatgcaccattgcagggaatcaaagtgttggaactgggcacccatgtggcagtcccctctgcctgccgcctgatggcggaatatggcgcggaggtcatcaagatcgaaaccgccggcggcgatccatggcgctactcgggcctgaatgtcaacctgtccatcgaggacttttcctgtcccgtcttcaccatccagaacaacggaaagcgtctgatcagcctggatctgaagactgacggcggcaaggaggtatttctgaagctgctggaggataccgacatcttctgcaccaacgtgcgtctgaagggcctggccaagatgggcctggactacgagactctgaaagagaagtttcctcagttgatctacgtccacttcaccggatacggccaccgtggtcccgacgccgaggccccggggtttgacatcgcctccttctggtcccgggtaggcgcccgggtgggctgggtggaggaggggaccttccccgttcgcgcctccggtggctatggggatatggtcactggcctgctcatcttcggcggcatggtcactgccctgttgggcagagaaaagactggccggggcacttttgtttccaactccctttatggcactagcatgtgggtcaatgcccagtccattatgtgcgctcagccgccctacaatcacaccttccccgaggatgtggatcggcccggcagccctgtggcgtacgactatgtctgtaaggatggcgagtggctggccctggtg

SEQ ID NO: 973 - DNA, 738 bp, Unknown
  Artificiall/Consensus sequence
atggcagaaaaattgaaaattgtcgccctgggcggtctggatgagatcggcaagaacatgactgtgttcgaatatggaaacgacctcatcgtggtggactgcggcatgggcttcccggatgacgacatgtacggcatcgacgtggtgattcccgacatcagctatctgatgaaaaaccaggagaagatccgcggcatcttcctgacccacggccatgaggaccatatcggcgcgctgccctacgtgctgcggagcattcaggcgccgatctacgctacccggatgaccgcggggttggtggagctgaagctggaggaacacggcctgctcaagcagaccaaaatccacacctgcgccgccggggaccgggttaaggccggtcagtttacggtggagtttattcacattaaccactccatcgccgacgcggtggcctttgccattcgcactcccgtgggcatgtgtgtccacaccggcgattttaagatcgaccccacccccatctccggcggcatggccgatctggcccgcctgggacagctggggaaggagggcgtactggccctgctgtgcgattccaccaatgtggagcgggccggctttaccaagagcgagcgcagcgtgggggacagtttcgacgccctgttcaacagctgtgaccagcggattatcgtcaccaccttttcctccaacgtggaccgcatccagcaggtcatgaatgtggccgcccggtacggc

SEQ ID NO: 974 - DNA, 1230 bp, Unknown
  Artificiall/Consensus sequence
atgacactgtatgatgaattgattgccagaggcctgattgctcaggtgacggacgaagagcaggtaaaagaactgattaacaacggcaaggcgaccttttatattgggttcgaccccactgcggactccctgcatgtgggacactttatggcgctgtgtcttatgcgccgcctccaggccaacggcaataagcccatcgcactgctgggaggcgggactgcaatgataggcgatccctccggtaaaaccgatatgcgcaagatgatgacccgggaggacattgaacacaacgccagctgttttaaaaagcagatggcacggtttatcgacttttccgacggcaaggctctgatgctgaacaacgcggattggctgctggatctgaactatgtagagttgctgcgggaagtgggctcccgcttctccgtcaacaatatgttgcgggccgagtgctataagcagcggatggaaaaagggctgtccttcctggaatttaactatatgattatgcagagctatgacttctatcatctgtatcaggagtacggctgcaacttccagtttggcggagatgatcagtggtccaatatgctgggcggccgggagctgatccgccgcaagttgggaaaagaagacgcacaggccatgaccattaccctgctgctgaacagcgagggcaaaaagatgggcaaaacggtttccggtgccgtctggctggacccggagaaaaccagcccctatgagttctatcagtactggcgcaatgtggaggatgccgacgtcatcaagtgcctgaaaatgctgaccgacgttcccctggaagagattgcggagatggagacctgggagggcgaacagctcaacaaggccaaagccattctggcctacgaactgaccaagctggtccacggggaagcggaagcagaacaggcccagaaaacggcccagggactgttttgctccggcggagatgtcaccaacatgccctccacggagctgactgcggaacagtttgaagacggaaaaatcacggtggtcaagctgctgaccgctgcaaagctggccgcatcgaacaaagaggcaaagacactgatcaaacagggcggcgtccaggtcaacggggaaaaagtggacgatttttctgctgcctatgtcgcagatcagtttgcaggtgacggcctggtgttgaaaaaagggaaaaaagtgtatcggcgctttcttttgaaataa

SEQ ID NO: 975 - DNA, 1761 bp, Unknown
  Artificiall/Consensus sequence
atgaatgcaaccttaaccggcaaacccagcgtggatagaccctggatgaaatattatccccccgcgatgctgcagatgatttccattccggagtgtacggtgatggaatatctgaaggagcactgcccgggcatggacgtggccgcaatcaactactacggcgaggatgtgccctggcgggaggttttcgaggaggcggagcaggttgcccgttcgctgaaggtgatgggctttcgggaaggggatcagattccggtgttcctgcgcctggtcccggagtttatcagcctactgctggcggcggagaagatcggcgcgtctgtgctgtgccgtgacaacactctggaggagaatgttgaggctgcggtgaaggccggtgcgaagatcatttttgtccacgacttcctgtcccaggaggaaaaggcggcattccaggctggagggattgagaccatcatcaccctgtcgccgctggagcgcggcagccgggagagtatgccccagcatgtccaggactgtctggattcctattatcctgaggcctgtgccagcggagcggaggtcatcccctggcgaaccttcctgggaatgggggagcgctggcagggccaggcggatgctcctgtggatattgaccggcctctgtaccgttgctataccagcggctccacaggcccctccaagcaggtcattcactctgcaaacaccatgctgagcatcatctgccagatgaattgctacggcagcgccgatggcttccgccccaactggctggttacctgcctgcctccctccctggtggcggtggtagtctccatggtccttctgcccatggcctccaacaagctgatgatcatggatccctttgtctttgaacgggacgtggacctggaggtcatgcgctacaaggcaaacaactggccccagctccccctgtttgcggagacgatgatgcgcaatggccgtgtgcccgatgactatgacatgtcccacctgctggccggaggcgccggctccgaggctatgaacaaccaacagctcaagcgtgctcaggcctttttcaatgcccacggctgcaaattccgctataccaccggttacggatgcagtgaggccggctccaatgtgacgttgcccatggcccccaagcctctggggaacggcaacgtaggggtgcccatgccgctgagcgtcatgtcgatcttcaagcccggcacacaggaagagctgagctattatcaggtcggcgagatctgcaagaccgggccgggcaatatgctgggctatgataatcctgaggccacggcaaaggcgctccagttacatgacgatgggaatgtctggctccacctgggtgacatgggctatatggacgaggacggtgttctgtacaccgtgaaccgcggcagccacgcacgctatggcggcggttttatcgacattcagaccatggagaaccttgtggcagaccgggagatcaagggcatcgacgacgagttctttgtcaacattccggacgacgagcaccccggatactacttaccctacttatacgttgtgctggaggaagggtataccgtagaggatatttgggaggaggtctgcgactgcctggagccccatatgtggccggtggacatgattcccatctccgcccgtccgttctggcactttaagaccaaccgcatcggcctgacccaggaactgcaggccatgcgcgctcaggctgccagtacgcagcggcggagtgcgtgtctataa

SEQ ID NO: 976 - DNA, 654 bp, Unknown
  Artificiall/Consensus sequence
atggaaatgattgtgccggacgcctaccctgatatttccaagctgctggatacctctggcatctgctgcctgaataccagggaggcatcggaggggacgctgtcccttgccggacggattcggttcagtattctgtatcttccggaagacggcggggaaatcaacagcctgggggcggaattggaatttcagtgtagtgcagaccaggagggattgacagccgagtgcagtgtggtggccattcctcgggtcctgtctgcggagactaaggccatcaatcccagaaagatgctgattcgggtaaactatgagattactgtgcgtgcgtaccggatggaaacgatgatgattcccagcggtgtgctggagcccggattggtggaggagaaacaggaggaggcagaagggtattttgccgtagcgataccggaaaagcgctttcagtttcaggatcagctggatctctctggcagccaaccggcgatggcggagattcttcgggtacagccggatgtcagctgtggagatgccaaactgatcggcggaaagctggtgttcaagggggaagtcctcctgcgaaccctgtaccgcagtgtggaccatgagatcctggcgacggagtttgtgctgccctactcacagattatggatgcg

SEQ ID NO: 977 - DNA, 1161 bp, Unknown
  Artificiall/Consensus sequence
atgtataccatcaaaacactgaacaacatcgcccccgcggggctggcgaagctgggcccggcccagttcaaagtggataacgaggccgacgcgccccagggcattctggtgcgcagcgccaagatgcacgagatggagctgcccgagagcctgctggccatcggccgcgcgggcgcgggggtgaacaacatcccggtggaaaaatgcagcgaggcgggcgtggtggtgttcaacacccccggcgcaaacgccggcggcgttgccgagctgaccatcggcggcctggtgctggccagccgcaacctgctgcccgccatggagtgggcccagagccttgccggcgagggcgacgcggtgcccgccctggtggagaagggcaagagccagttcgtgggcccggagcttgcgggcaaaaagctgggcgtggtgggccttggcgccatcggcgtgaaggtggccaacgcggcggtgcatctgggcatggaggtctttggctacgacccctacatctcggtgcaggcggcctggaacctgagccgcggcgtgcgccacagcgtgagcctgaccgagctggtggcccagtgcgactacatcaccctgcatctgcccgccaacgcccagaccaagggcttcatgaacgcgggggtgttccgggcctgcaagccggggctgcgcctgttgaacttcgcccgcggcgagctggtgaacaacgccgacctgctggcagccctggccgagggccagctggccgcctatgtcaccgacttccccgccgccgagctgctgggtgtgccgggcgtcacctgcatccctcatctgggcgcttccacccccgagagcgaagagaactgcgccgtgatggccgccagccagctggcggactacctgctgaacggcaacatcgtaaacagcgtgaacatgccggaagtggtgcaggcaagggccgcgggcaggcgggtgtgcgtcatccacaaaaacgagccgggccttatcagcgccatcaccgccgtcatcaccgagagccggctgaacatcgagaacatggtgaacaagagcaaaaaagaaatggcctacaccatgctggacgtcaccggcggcatggacgccgccctggccgaccagctggccgccatcccctcggtcatccgggtgcgggtgctg

SEQ ID NO: 978 - DNA, 948 bp, Unknown
  Artificiall/Consensus sequence
gccggccttttttccgcccgccgcgccgcccggatttggtatgagaatatttcatactttgcaccgggcgcatttgatggtagcctaagaatagaaaatgacgcgccgcgccgcgctatctttgcaaaaggaggaagaaaaaccgctatgttcagttcgaaaaagaaaaccggcttttccaagttcgtagcgtccattcccaatggggtctggatcgtcatttcgctggctgccgcgctgcttttgtgggtcgtcatctcccacaccgaaaaaggcggcgtcgtgttcgccactccccccgaggtggtggagagcctgatcagcaagatccaggacggcaccctgctcacccacatcggccacagcctgttccgcgtgatcgtgggcttcagcctgggctttgtggcttccatccccgtggccttcctgatgggctggtacgcccccttccgccatgtggtggagccctggatccagttcgtgcgtaacattccgccccttgcctacatccctctggtcatcgttggcgccggcgttggcgagccctccaagatcatcgtgatcttcatcgcctgcttcctggtgctggtggtcaccatctaccagggcgtgtgcaacgtggacgtcaccctcatcaaggccgcccgcatcctgggcgccaccgaccgtgacatcttcttccgggtggtcattcccgcttccacccccttcatcctcaccggcgcccgtctgggcctgtccgccgcgctgaccaccctggtggccgccgagctgaccggcgcttccgagggcctgggcatgatgatccagaaggccagcggctactacgacatgggcaccgtgctcatgggcatcatcgtcatcggcatcatcggcatctccatggagaagctggttcggttcttagagaggaggctcacaggatggcaggaaacagtgcagcagtaa

SEQ ID NO: 979 - DNA, 900 bp, Unknown
  Artificiall/Consensus sequence
gtgaagatcgcttcgtttgaacagatggaagcctttgtgaagggccacgccagccgcaagaagatcgccgtggcctgcgcccacgacgacgtcaccctggaagcggtgctgatggccgtggacaagggcgtggccgacgcggtgctcatcggcaagcaggatgagatcgaggcgctgctgcggcagttcggcaaggaccccgccgccttcgagatcatcgacgaggccgacgagcgggccgccatcgacaaggcagtggccatggtgcgcgagggcacggcggacatccccatgaagggcctgatgcacaccgccaccttcatgcggggcatcctggacaagcagaccggccttctggagccgggcgagctgctgagccaggcctcggtgttcgaggtggaggagaccggcaagatgctcatcatcagcgactgcgccgtgaacatcgagcccaatgtggaccagaagtgcaagatcgtggagaacgccgtgaaggtggccgggtccctgggcatcgaagagcccaagatcgccatgctctcggcgctggaagtggtgaacccgaaaattcagggcacggtggacgccgccgaggtgactgcccgcctgaaggataaataccagatcgacggccccttcgcgctggacaacgccgtcagcgtggaggccgccaagcacaagggcatcgacagccccatcgccggcagggcggacatcctcatcgtgccggacatgtggagcggcaacatcttcaccaagggccttgtgttcttcgcccatatgaagagcgccggcaccctgaacggcctgcgcagcccggtggtgatgaccagccgcaccgacaccatcgaaaacaagtactactccattctcacttcggtgctgggcaccatccaatga

SEQ ID NO: 980 - DNA, 1332 bp, Unknown
  Artificiall/Consensus sequence
atcctcatcatcctgctgatgccgcccctcggggtggtgttctatctcttctgggggcaccgcaacaccaccaaccgccacgcgcggcggatgaactccatctgcgcgcgcctcagccgcaccctgccccaggacccgaaggccctgcaccggctggaagtgcaggacgagagccttgcccgcagcgcccgctatctcatccgcaacgcgggcgcgcccctctacgccgacacccagagcgaatattacgcctggggcgaggagttcttcccccgctttctggaagagctgaaaaaggccgagcgcttcatcttcatggagtatttcatcctgaaacccggctacatgtgggacaccaccctggaaattctgaaagagaaggccgccgccgggctggacgtgcgccttttgtacgacagctggggctgcatgctcaccatgccggaggactatgacgagcagctgcgggagtggggcatccagtgccaccgcttctcccccttccgcctgtcggcccacatctccgactacaccatgttcaaccaccgggaccaccgcaagatcaccgtcatcgacggcaacgtgggcttcatcggcgggctgaacttcgcggacgaatacatcaaccgcaaaaagcgtttcggcgtttggaaggacaccggcctgatgctgcggggcagcggcgtttacaacctcaccgccctgtttttggagagctgggacttcaccaccggtgagtccagccggctggaacagttcgcccccaccctgcgcttttccgccgacggcatggtgcagccctacggcgactcgcccctggacgaggaggcggtggcggagaacgtctacttcaacatcctccagcaggccaccgactacgtctacatcgccaccccctatctggtggtggacaacgagatgataacgaccctgagcctcatcgccaagagcggcgtggacgtgcgcatcatcaccccgggcatcccggacaagaaatacgtctactgggtgacccagagctactactcggtgctgatgaaggcaggggtgcgcatctttgaatacagccccggcttcatccacgccaagatgtatgtgtcggacgacaagaccgccgtggtgggcagcgccaacatggactaccgcagcctctacctccactttgagaactgctgcgtgttctacggcgggcacatggtgcaggacgtgcacgccgaccttttgcgctgcatgcaggtgagccacgaggtcacctgggaggacgtgaagaacgtgccgctgcccaagcggatcttccgggtcatcctgcggctgttcgcgccgcttttgtga

SEQ ID NO: 981 - DNA, 588 bp, Unknown
  Artificiall/Consensus sequence
ccctggttccatctggccgtggtggcggcttctccccgttcggcgggcaagacctacgaagaggccgttggcagccgctgggccatgcctgaccccatgccggagcaggtcaagaatatggtggtgcttgatgcctcccatgtggaagaagtggcctccaaagtcgatttcgtgttctgcgcggtggatatgaagaaagaggagatccgcgcgctggaagagagctacgccaaggcggaatgcccggtggtctccaacaacagcgcccaccgcttcacccctgacgtgcccatggtggtgccggagatcaaccccgagcacctggacgtcattgcagcccagcgcgcgcgcctgggcaccaaaaagggatttgtggcggtgaaatccaactgctccctgcagagctatgtgcccgccctgcaccccctgaaagacgaattcggcctttccaaagtgctggtgtgcacctatcaggcaatctccggcgccggcaagacctttgccacctggccggagatggtggacaactgcatcccctacatcggcggcgaagaggaaaaaagcgagcaggagccgctgaagctgtgg

SEQ ID NO: 982 - DNA, 1098 bp, Unknown
  Artificiall/Consensus sequence
atgccggtgggcatcagcttcttcgtgttcaagaacatcacctatctggtggcggtgtacaaggggagccttgccgccgagaagaaccccctctactgctttgcctacaccggctttttcgcccagctcaccagcgggcccatccagcgggcggagagcctgctgccccagctgaaaagcccgcccgcctttgaccgggcgctggcgctgaacggctgcgtgcggctgtgctggggcatctttctgaaaaagtgccttgcggaccattttgccgcctactacaacgccctttaccagccggaccactactacgccttgagcatcgtctggtcgctggcggcctattctctctacatctatttcgacttcgccagctattcccagctgtccatcggcgtggcgaacctgctgggcctgcgctgtgacgagaacttcctcagcccctacctctcccgcagcgtgggcgagttctggcggcgctggcacatcagcctttccagctttctgcgagactacatctacatccccctgggcggcagccgcaacggcgtgccggtgctcatcctcgccaccatggtcaccttccttgtgtccggcgcgtggcacggcgcggcgctgggcttcgtggtctggggcgggctgcacggcgtttacctgctggccgggcgggccacccgcggcgtgcgggaaaaggcctggggccttctgcgccagaagccggacagcccggtgcgcagcgtggtgagctgggccgtgaccctggtgctggtctgctttgcctggatcttcttcttcagcggcgatgtaaaccaggtgcggctgctgatgagctatctgctccagcccatgcccctcagcgcccagtacctgaaagagagcttcacccagctgggctacaccaccgccgttctggtgcggctgggcctgttcgccctggcggccttcggcgtggactttgccgcccgcaaagagggcttcggccgctgggccgccgcccgcaagggctgggtgcaggtgatcttctgctacgcctgcatcttcgccaccctgttctggggcgcggcgggcaccttgcagaacatctatttccagttttaa

SEQ ID NO: 983 - DNA, 858 bp, Unknown
  Artificiall/Consensus sequence
cgcgccgcggtggatttcttcgccgccctggacggggtgctggcgcagcacttcgcccactatgaactcatcgcggtgaacgacggctgcaccgacgacacggtgcccgccctgaaagcctgggccgccgagcacctggaagcgcccctgacggtggtgaacatgagcctgcgccagggcgtggaaaaggcgatgaacgccggcctcgacgccgccatcggcgactttgtgttcgagttcgaccgcccggcgatgggctacgacccggacctcatctggcaggcctatcagaaagccctcaccggctttgacgtggtcaccgtctgccccagccgccagcggctgatgagcagggccttctaccgggtgttcaacaagttcagcaacagcccctacaagctctccaccgacgcgttccggctggtgagccgccgggccgtcaaccgggtgaaggccatcagcgacgatctggcctaccgcaaggcggcctatgccgccagcggccttgcctgcgccagcctgacctttgagggcacggcggcgaaggacgacgagccccgcctggacaaagcggtggacagcctcgccctctacaccgacgcgggctacaagctgagccttggcatcagcatggggatgatggtgctcacgatggtggccttggtctacacggtggcggtgttctgcctggggcagcccatcgccggctggaccaccaccatgctggtgctttcggcggggctctccggcctgttcttcatcctcaccatcgcggtgaagtatctgaacctgctggtgcgcctcacctttaaaaagcagagctacctcatcgagggcgtggagaaactgcaaaaataa

SEQ ID NO: 984 - DNA, 759 bp, Unknown
  Artificiall/Consensus sequence
atcccccccgaactggaaaagcagtacgacatcgacatcctgccctttgtcatcacactggacggcgtgagctatgtggagcgccgggacttcggctttgacgaattttatcagatgctgcgctccgcccagggcgtgcccagcaccgcgcaggtcaccgccatccagttctgcgagcagtactgcaaatacgtggacgagggctacaccgacgtggtgcatgtgaccatcaactccaccggcagcggcacctatgacgcggcggtgctggcgcagaacatgctgcgggaggagcgccccgaccacaaactgaacatccacctgatcgacagccacacctattcctacgtgtacggcgcgccggtggtgcaggcggcccgccgcctgcgcaacggggccgaggtgggctatgtgtgcgccgagctggaggccgcctttgcccggcaggagatcgtgctctccgccttcagcctcaagcagatgaagaagagcggccgcatcagcgcggcggcggcctttgccggcgagctgctgggcctgcggcccatcatcagcctcatcgacggggtgaccaaggtggaggacaaggtgcgcggcgacgcggccgtgcccgccgccatgatcaagcaggtgcgcaagcggatggactatcccgacggggacgttcactacatgctgggctgcaccgacatccccaacgtgaaggagctggagaagctctgccgcaaggagttcggccgcgggccggacgcggtgttc

SEQ ID NO: 985 - DNA, 762 bp, Unknown
  Artificiall/Consensus sequence
gtgggcaagatcattgcggttgcgaaccaaaagggcggcgtgggcaaaagcaccacggcggtcaatctggcggcctgtgtggccgcccaggacaaaaaagtcctcattgtggacctggacccccagggcaacaccaccagcggcttcggcgtctccaagaaaaatgtggaggccagcgtctacgagctgctcatcggggaggccaaggccgccgacgccattcttcccacccagttcaaggtggacatcatcccctccaacatccagctgtccggcgcggtggtggagctggtgaatatgcccaagagtgagagccgcctgcggcaggcgctggcccaggtggccggcaactacgacttcatcttcatcgactgcccgcccagcctggacctgctcaccctcaacggcctgtgcgcctgcgactcggtgctcatccccatccagtgcgagttctacgccctggagggcctgtccgagctgatgagcaccctcaagaccgtgcgcaagatgtacaaccactaccttgagatcgagggcgtggtgttcaccatgtacgccggccgcctgaacctcaccctgcaggtggtggagcaggtgaaaaagttcttcggggacaaggtctacaagaccaccgtgccccggaacgtgcggctctccgaagcgcccagcttcggcatgcccatcaattactacgacccggtgagcaagggaaacgaggcctacatggaaatggccagggagttccttgcaaacaaccggtaa

SEQ ID NO: 986 - DNA, 381 bp, Unknown
  Artificiall/Consensus sequence
atgcaggtccatgaatcctcggaggattatctcgaggccatcctgatgctgaaagagcgcaagggctacgtgcgctcggtggacgtggccaacgaacttgccttcaccaaagccagcgtgagcgtggcgatgaaaaagctgcgggagaacggctacgtgcaggtggacgccgacggcgggctggtgctgaccgaggcggggctggccattgcccggcgggtgtatgaccggcaccggctgctcaccgagttcttcgtgcggctgggggtggacccggaagtggccgcccgggacgcctgccgcgtggagcacgacctgagcgagcagactttttcgaagcttgtggaacacgcgcaaaaaaagtttgaaaaagatggttga

SEQ ID NO: 987 - DNA, 1755 bp, Unknown
  Artificiall/Consensus sequence
gtgaaaaaactcttcgcccgggcggcggcgtccctctcggggcgctaccgcaccatgagcatccagatggtcatctccctgtccttcaccgcggccgcggtggcgggcatggtgctcatgggcctgagccttgtctggcgctactccgcgggcaccgagcagctggtgcgggagaacaccgagcgggtgctgggccaggtgaacatgaacatggacagctacctgcgccggatgatgcgggtgagcgacaccatgtattaccgcatcatcaaaaacgccgaccttgccacccagagcctggacgaggggatggagctgctgtacgaggagaaccgggacgagctggtctccatcgccgtgttcgacagcaggggcgcgctggtggcgggcacccccctcaccgccctgaaggaaggggcggaccccgcctcctccgactggtatcaggcggcgctggacaagatggagaacctgcacttttccaccccccacatccagcacctgttcgccgacccggacgacagcttccgctgggtggtgtccctgagccggtatgtgcagctcacaagagagggcagcacctacagcggcgttttgctggtggacatgggcttttccggcatcgagcaggtctgccgggacgtggagctggcgggcggcggctacatctacctcaccgacgcgtccggcgaactcatctaccacccccgccagcagctcatctacgcggggctggacaccgagaacaatctggccgccgcgtccctggccgacggcacccacaccgagaccttccagggggaaagaagactggtcaccgtcaagacggtgggctacaccggctggaagctggtgggcgtggtgccccgcaccggcgcgggggacgacgggggctacatcttcctgttcggcctgtccatgctgctgttctcggcctttttgatggcctttctgaacttccgcatctcggcgcgcatctccgaccccatccgccggctggagcagtcggtgaaggagttggaggccggggcccaggaggtggccatccgggaggacggctgctacgaagtgcggcggctggcccactccatcgcgtcgatggtgtccaccatgcgccacctgatggacgacatcattttgcaggaaaagcgcaagcgccgcagcgagctggaagtgctgcaaagccagatcaacccccatttcctctataacaccctggactcggtgatctggatgaccgaggccggccgctacgacgaggccatccagatggtcacctcgctggcgcggctgttccgcatcgccctcagccgcgggcgcagcttcatccccctggcggacgaactggagcacgcccgccactacatgaccatccagcagatccgctatcaggacaagttcaccgccgccgtgagcgccggggagggcaccgaggggctttacaccctcaagctcatcgtgcagcccctgctggagaacgccatctaccacggcatggccggctgcgaggaggacgggcgcatcaccgtcaccgcaaagcgggagggcggtgatctggtcatcgacgtgagcgacaacggcgtgggcatgccccccgaggtggtggagcgccttctggacgagagccagccccagacccggtccagcgggtcgggcatcggggtgcgcaacgtccaccggcgcatccggctgaccttcggcgaaggctacggccttgaggtgttcagcgagccggacgagggcaccaccgtgcgc

SEQ ID NO: 988 - DNA, 978 bp, Unknown
  Artificiall/Consensus sequence
atggaacttctcatcgtgggcctgggcagcatgggcaagcgccgcgcccggcttttgaagggcatcgacaaaaacatcgccctctttggggtggacaccagcccctcccgccgggaggaggccgcggctctcggggtggaaggcttcgagagcatcgacgcggcgctggcggcaaaaaaattcgacggcgcgctggtgtgcaccgcgcccctctcccacgcggccatcatctggcagctgctggaagcgggcctgccggtgttcaccgagctgaatctggtcagcgacggctatgccgagaacatggcgctggcaaaggaaaagggcgtgcccctgttcctttcttccaccatgctctaccggggcgagacccagtacatcaagagccgggtggacgcttttgaaaagccggtgaactacatctaccacatcggccagtacctgcccgactggcacccctgggagaactacaagaacttcttcgtgggcgacgcgcgcaccggcggcgtgcgggaaattttcggcatcgacctgccctggctgctggacaccttcggcccggtgaagagcctgcacgcggaaaaggacaagctcagcgagctggagatttcctacccggacagcgtctttgtgaccctgcgccacgaaaacggcaccaagggcatgctggcggtggacgtggtgagccccaaggcggtgcgcaacttcgagtgctttggcgaagggctgcacctcttctgggagggcaaccccaagagtctttacgactttgaccacgccagcggcgagaagaaggccgtgaacacctacgccagcgtggagcacgactcccgttacagcgacaacatcgtggaaaacgcctacgtggacgagctgcagaacttcctcggcgtgctggcgggcagggaagaagcccgttacagcttcgaaaaggacctggagaccatccggctgatcgaggccatcgaggaggcgtga

SEQ ID NO: 989 - DNA, 927 bp, Unknown
  Artificiall/Consensus sequence
atggaacggtttgacgtctttgttcccgcggagtgcgccggccagcgagccgaccgctttctcgccgacctggaagagatcgagctgacccgaagcgcgttgcagcgcctttttgagcaggggctggtgcagtgcggcgaaaaacctgtggcaaagaacctgaagctgaaagcgggcgaccacctgaccgtggacctgcccgacgcaaaaccgctggaggctcagccccagaacatccccttggagatcgtctatgaggacgactatctactggtggtgaacaagcccaagggcatggtggtgcatcccgcgcccggcagccccgacggcacgctggtgaacgcgctgctctaccactgcgcgggtcggctttcctccatcgggggcgtggtgcgccccggcattgtgcaccgcattgacaaggacaccagcggcctgctggtggtggccaaaaccgatgccgcccacgagggcctgtgcgcccagatggcggtgcacagtgtggagcgggtgtatgaggcggtggtctacgggcgcttcaaggagccggaaggctttgtggaggcgcccatcggccgccaccgcaccgaccgcaaaaaaatggcggtggtccctgatggaaagtacgcctatacgggatatcaggtgcttgcacagtataacggctttacacacattgcctgccgcttaaagacgggccgcacccatcagatccgggtgcacatggccagcatcggccacccgctggcgggcgacagcgtctatggcccgcgggacagcatcaagcggctgaacgggcaatgccttcacgcccgggtgctgggatttgaacaccctgttaccggcgaaacgatgcactttgaaagccctctgcccgattatttcacagactttcttcgcactctccgaaaggagccggaatcatga

SEQ ID NO: 990 - DNA, 516 bp, Unknown
  Artificiall/Consensus sequence
atggatgaaaacaaacagctttggcagaaggccgcggactttcacggccatgtgtgtggcgggctgaccatcggctacaaggcggcgctttacgccatcgaactgctgggcatcgaaatggtggacggcgtgtgctccaaggacgaggagatcgtgtgcatcaccgagaacgacgcctgcggcgtggacgccatccaggccatcctcagctgcacggtgggcaagggcaaccttttgttccacatgcggggcaagcaggccttctccttctacaaccgcaagaacggccgttcggtgcggctggtgctgcgccccgccccggcgggcatgacccgggagcagtccttcgcttactaccaggcccacgagcccaaggaactgtttgacgtgaaggccgccacgctggcggtacccgagcgggccaagcttttcgactcctacgtgtgcgagaactgcggcgaagtgaccggcgccaactgggtgcgggtggcaaacggcaagcacctgtgcctggac

SEQ ID NO: 991 - DNA, 1707 bp, Unknown
  Artificiall/Consensus sequence
gaaccccaacgtcagagcgtattcatcaaccgggagctgagctggctggattttgaccggcgcgtgctggccctgggcaaggaaaaaacggttccgctggcggagcggatgaagttcactgccatctacggcagcaatctggacgagtttttcatggtgcgggtgggctcgctctatgaccgcacgctgctgaaaaacgagatcaccgacaacaagaccaaactcaccgccgcccagcagctggcggccatcatgcccaagaccgccgacctgcagcagcagtgcgacaagatcgtggtaaagctgcgccagcatctggccgagcagggctatgtgcgcatcgatttccagaacctgaccaaagaggacgagcgcttttggaaaaagtatttcctgaatgagatgctgcccgtcctttcgcctcagatcatcgaccaccgccaccccttcccgttcttgcgcaaccaggaaatttacctctgcgcgaccctgaaggcaaagggcgatgacgcggtctcctatggtcttatccccatcagcagccagttcgaccgcatgctctacctgaaaaaggacgagcagctgctctacggtctggcggaggagcttatcctgcgctttgcggacctcgttttccccaaggggatgctgcagaagaaatgccttttccgggtgacccgcaatgcggacatcgacgtgaaggagggcatgttcgaccaggacatcgactatcgtcaggtgatgagcgaactgctgaaaaagcggcgcaagctggccgccgtgcggctgcagttctggaacgagccgccccaggaagtggccaaatacctgtgcgaaaagctgatgctgccggaaaagcagtgcttctatcaggaaagcccgctggacctctcctgctacttcaagctggcggctcgtctgcaggcggacggacgcacagacctgttctacccggtggcaaagcccatgcaggcgcccgcgaacttcaagctgggcgaggaggcaaagcaccgggacgtgctcatcgcttacccttatcagagcatgcgccccttcatcaaaatgctgatggccgcggcctacgacccggacgtggtcagcatcaagatgaccctttaccgcatggccaacaactctcagatcgtgcaggcgctggtggctgctgccgaaaacggcaaggaagtggtcaccatcgtggagctgcgggcccggtttgacgagcagaacaacatcgactggtccaaaaagctggaggaagcgggctgcaccgttatttatggcctggatgactacaaggtccactccaaactgaccctcatcacccggcgcagcaagggccgctacttctacaccacccagatcggcaccggcaactacaacgaaaagaccagcgagcagtacaccgacctctccttcgtcaccacgaatcaggaggtgggcgaagaggcagccgccgtcttcaacaatctggcggtggagcgcctcaccgacgacaccgagcacctcatcgttgcgccgctgcatttcaagagcgtgctgctgaaagaaatggacaccgagatcgaaaaggcgcgtctgggccagcctgcccgcattatcctgaaaaacaactccatcagcgacaagaacatcatcgaaaagctggtggaggcatcccaggccggggtgcccaccgacatgatcgtgcgcggcatctgctgcgtgcag

SEQ ID NO: 992 - DNA, 1719 bp, Unknown
  Artificiall/Consensus sequence
atggacgaactgatcggcaaaaaactggaaggccgctacctgctggaaagcctggtgggcgtgggcggcatggccaacgtctacaaaggacgtgacctcaagaccgacgccgttgtggcggtgaagatcttgcgggaggagttcagccagaacaccgaactggtgcggcgcttcaagaacgaatccaaggccatctccattctggaccatcccaacatcgtcaaggtctacgacgtctcggtcaccgaccggctccagttcatcgtgatggagtacatcgacggcatcaccctgaaggaatacatgaaccgccggggcggccccctcacctggaaagaggtggtccacttctgccagcaggtgctggacgcgctggaccatgcccaccagaagggcgtcgtccaccgggacatcaagccccagaacatcatgcttctggcggacggccgggtcaagatcatggacttcggcatcgcccgcttctcccgcgcggagtatcaggacaccagcgaaaaggccatcggctcggtgcactacatcagtcccgagcaggccaagggcgacgtcaccgacgccaaggcggacatctactccatgggcgtgatgatgtacgagatgctctccggcaagctgcccttcgagtcggacagcgccgtgtccgttgccatcaagcagattgccgacaccgccgcgcccttgagcgaggtggcgccggatgtgcccaaagcattgcaggacatcaccgcccgggccatggcgaaggacccggcgcggcgctatcccagcgcgcgggccatgctcaacgacctggaggagttcaaaaagaaccccagcatccggttcgagtacgaatatatgaccgaagattcgccagaaaggtatatcgacaaggtggttaaacagtcaagcggcggcccctcgggccgcaagggcccctcttcccagggcagccgcaaggcgccggccccttcttccggcagcaaaaacacccagcaccagcgcaaaccccgccgcaaggtgggcgttctgcccatcctggcgggcatggccgcggccttcgccctgggcagcgccattctgtgctatctcatctttgccaactccaccaaccccctgttcagcaacaaggcggacgtggaactgcccgatttcaccggcatgcagtgggagacggtgaaggagcagtactccggccagctgaccctggtggccgagcaggagtacaacgcccagtatgaagagggcgtcatctactaccagtcgccccgtgggccccgcaccgtcaaggagggccagaaggtcaccgtcaaggtgagccttggcaccctgtatgtgaacgtgcccgacgtgacccagtggaagatcgccgacgccgaagaggagctgaaggacttagggctgcaggtgcgccgcatgatcgtggaggacgactccctcgccgagggcaccgtcatccgcaccgagccggcggcgggcgagagcatcgccagcggcgagaccatctcggtctacgtcagccagaagaagatcgagaccgagaccaccgttcccccggtgaagggcatctccctggaggacgcccagaaggccctgaccaacaacaatctggtcaccggcgtcgtcaccgaggcttacagcaacgagtacgcggcgggcgtggtcattgattccacccccaccgaaggctccaccgtcaaaatttactcccaggtgggtctg

SEQ ID NO: 993 - DNA, 1266 bp, Unknown
  Artificiall/Consensus sequence
ggcagccccatctgcatcgccaccgtgctgcgcaccaccctggcctacaacaacctggaggcggtggaggacggctacggcatcaacacccgccccctggccctcttcgccgagaacacctaccgggactgcgacatccaccatttctaccccaaggtggacgagagccgcgggccttaccaccgcagcgagctggcccgcgtggcccggatgcacaaggccatcgccgtcatcatgttcaagctggagtgcgccgtcatcgaccgcaacccagactttgagctggaagggcgggactttctgcgccgcatcgattttgcggcgggcaccgtggaggtggagggcaagcgctatcccttgcaggacgacgacctgcccaccgtggacccggcagaccccgcccgcctcacccccgccgaggaggaggtgctggcctcgctgcagcgctctttcaccgacagcgagcgcctgcagcgccatgtgcgcttcctctacgccaagggcggcgtgtaccacatcgaaaacggcaacctgatgttccacggggccatccccctcaccgagtccggcagcttccaggtggagaccttcgagcagcacggctatgccgggcgggccctgatggactactgcgacgagagggcccggcgggcctatttctcccccgagggcagcgaggcctggcagaccgggtgcgattttctgtggtatctgtggtgcggcaagctctcgcccctctatggccgggccaagatgaccaccttcgagcggctcttcgtggcggacaagaccacccacgccgagcccagcaacccctactaccgcttcgtcaacgacacccgcatggaccgggccatcctggcggagttcggtctggaccagacccgcagccacatcgtcaacggccatgtgccggtgcgggcggtggaaggggagaccccggtgaaggggtccgggcggatgatccgcatcgacggcggcttctgccgcgcttatcaccagcgcaccggcatcgccggctacactctggtctataacagccacggcctttccctgcgggcccaccagccctttgaaacggtggagaaggccatcaaagagaacctggacatcgtctccagcgtggacacgttcgagactaccaaaacacgggtgctggtgggcgacaccgacaacggccgcaagctggccgccgacgtggaggacctcaagcgccttgtggccgcctaccagaccggcctcgtgaaagagcgccccgagggctga

SEQ ID NO: 994 - DNA, 1449 bp, Unknown
  Artificiall/Consensus sequence
ttgaattttcgagcgatcaaccataccatcgggtccatcatccttctggagatggccttcatgctgcccagccttgtgtggtgctgggtggaccgggacgggcactccgccctcgccttcggcgcgtcgctgctcatcatgggcgtgtgcgccgggctgtttctgctggtgggccgccgggcccgaggcagcatcttcgcccccgagggctttgtgacggtggccatgtgctggatcgtgctgtcgctgctgggctgcctgcccttttacatcagcggccagatccccagctacatcgacgctttgttcgaggtggtgagcggcttcaccaccaccggcgcctccatcctggcggaccctgccgagatgagccggggccttctgttctggcgcagcgccacccactggctgggcggcatgggcatcctggtgttcatgctggccatcctgcccgcgcggcagggcggcgcgctgcacctgatgcaggcggagagcccggggcccacggtgagcaagctcaccccccggctgcgccagaccagcaagatcctctacgccatctatctggcgctcaccctggcctgcatcctgtttttgctggcggggggcatgtccctgttcgacagcctgtgcaccgccttcggcaccgccggcaccggcggctttggcatcaaggcggacagcatggcaagctacagcccctatctgcaatgggtggtcaccgtgttcatggccctgttcggggtgaatttctcggtgtattacctgctgcttctgcgcaaggtgggccttgcggtgaaagacgaggacgtgcggctttatttcctcatcctgctggtcgccggcgcgctcatcgcctgggacatccgggacctcatccccgatctttccgagcgcatccgccacgcctatttccaggtgagcagcatcatgaccaccaccggcttttccacggtggattttgacgtctggcccgccttttccaaggccatcctgctctgcctgatggcggtgggcgcctgcgccgggtccaccggcggcggcctgaaggtgattcgccttttgcttatggtcaaaagcctgcgccgcgccatgcgccggaccctgcgccccagcagcgtgcagctggtgcgggtgaacggcaaggtggtggaggacgatgtgctccacaacgtgagcgcctatctggtggcctatgtgctcatcctcttcggcagcttcgtgatcgtctcgctggacgagctcagcctggagagcaacatctccgccgtgttctcctgcttcaacaacatcggccccggcttcgacgcggtgggccccatggtgaactacgactgctacagcgacctgtccaagctggtgctgacgctggacatgctgctgggccgcctggaaattttccccctgctggcgctgttcagccgccacagctggagccgccggctgtga

SEQ ID NO: 995 - DNA, 1344 bp, Unknown
  Artificiall/Consensus sequence
atgcgcaaacaggacctgtttcgcctgtgcctgcaaaacctcctgcgcaagcgctcccgcacctttctcacggtgctgggggtggtcatcggcggatgctccatcgtcatcatggtgtcgctgggcatcggcatgaaggaggcccaggacaagcttctggcagagctgggcgatctgaccatcatcaccgtcaccgcgccccagggcgggcgcggcaaggtgaagctggacgacgccatggtggcccggctgaaaaaactggacggcgcggtggcggtgatgccccggcagaccatcgatctgccggacctgcacctttacgccggcagcgcaaggcgctatgtggcggactgggtgacggtgaccgggctggacaccgctggcatggaggccatgggcttcaagttggaaaagggcgagcggcccctgaagcccggcgaggtggtgctgggccagtacgcggcctacaacttccgggacaccctgcgccccgagggctccaacatggtggaccgctggtccgccgggtggaacgaggacaccggcaagctgaacgacccgcccccggcctattttgacccgctgaaggagccgctggtgctggaggcggagaacggcgaatacaagaccagcctcaccctcaagccggtggcccttgccaaggaggactactccaagggcatggagaccggcgagggggtgctgatggacctgaaggacctgaaagtcctcaccgaaaagctgcatctggtcaaaaagggcgcgtcgccctaccagtcggtgctggtgaaagcgaacagcatctcccaggtggcggcgctggaaaagcgcatccgcgccctgggctgcgccaccgaatccatggagagcatccgcgagcccatggaaaaagaggcccggcaaaagcagatgatgctgggcggcctcggggccatcagcctggtggtggcggccatcggcatcaccaacaccatggtcatgtccatctccgagcgcaccaaggagatcggcgtgatgaaagccctgggctgctatgtgcgggacatccgcgccctcttcctcgccgaggcgggctgcatcggcctgatgggcggcatcgtgagctgcgtcatcagctttgtggccgccttcatcgccaacatcgtcaccttgggcgggccgaccgccgaaaacctgcgcatcgcccttctgggcggcgacggccccgcccgggtctgcgtgacgcccccgtggcttttactcttcgccatcgccttctcggtgctcatcggcctgggctccggctactaccccgccaacaaggcggtgcgcatcccggccctggaagccatcaagagcgactga

SEQ ID NO: 996 - DNA, 1641 bp, Unknown
  Artificiall/Consensus sequence
atgctgcttctggtgttctgcgtggcggccctggcgggcatcgccctgctgcgcatgcgtcaggacgcggtcacccttctgggcgcgcgtctggcggacgccgaacagctggcctccatcaccgccctgccccagacttccgccgagggctgtgtgctccactggaacggcgaggtgctgccctacgattctgcccggggcgtctattgcctgcctcagccgctggacggcagcgccaccggcagcctttccaccacctggggccgggtctacctgcccgcggaccagtgggcccagggccgccaggacgccatggccgaaggccggacgctggaagtgtatgtgagcgacggcaagcgctggtgccggctggaggtgtatctctccggcgtgcccgccctggtggtgcacacccagcgcagcgtgccctacaagctggacccccagtacgtcagcggcaccatggccagcctggacctggccttcaactacggcgaatacaccctgttctggccggagggcaactcccgaagccagactgtcacgggcaacatcgaataccactggcggggcaacaccaacctgctggccaacaaaaagtcttaccgcctgaacctgctggacgccaaaggccagccggacgcgaaggacctgctgggcctgggggaggacgccgactggttccttttgaacttcgccaccgacaccacccgcgcccgggacaaggtggcctggcagctgtggcagcagatggtgcagcagaacgaacacgacctgccgggcatccaggtggagtacgtggaactgtatctggacgatacatacgtggggctctacggcatcgcccgccccatcagccgggacagtttgcagctctcggccaatgacctgctctataaatggcgcaccatgcccatggaccgctccatgcccaccgccgagacctttgcgtccctggaagcggacgagagcctctcctggggcgtgtggctggaggtggtctggcccaagactttcagcgagggcgtgtggcagcccatggcggactatgtggacctctactacacgccgggcgcgcagaccagctggcagcagctggaaagcaccaccaacctggacaatctgctggatgtatcgctgttccggcagttcgtctgcgcggcggacaatttctcttataaccagtactttttgcaaaacagcgccgacggcctttactaccgcatcccctgggatatggactataccttcggtgatgtttatgatgaattctactctctggatatgacctccaccttcctgccggacatggagctggacaccctctattatgccgacagcggccgggcacagcagctcatcgcccagcgctggagcgaactgcgcggcacggtgctcaccatggagaacgtgaccgccctgttcggggccgcccaggagcagttgacggccagcggggccctggggagggacacggccctctggggcaatgcggagacctacccctgggagtctcatttccgcacgctggacgcagagcagactttggaattcatggagcagcgtctggcatttctggacgattacatggcggagtacacccccgccgaccgggaggcgttcgatgtattaccgaaatga

SEQ ID NO: 997 - DNA, 2064 bp, Unknown
  Artificiall/Consensus sequence
ccccaccccggccacggcgagaaaaagcgcacggccctggcggaggacacgcccctggtgttcgcgctggcgggcaaccagaactgcggcaagaccaccttgttcaaccagctcaccggctccaaccagcatgtgggcaacttccccggcgtgacggtggaccgcaaggacggccagatccgcaagcatccccaggccacggtggtggacctgccgggcatctattccctctcgccctacaccagcgaggagatcgtgacccgggattttctggtgaacaacaagccggacggcatcatcaacatcgtggacgccaccaacatcgagcgcaacctctacctgaccttgcagctcatcgagctgggcatccccatggtgctggcgctgaacatgatggacgagatgcgggccaacggcaacacggtgcatgtgaaccacctggagcaggccctgggcatcccggtcatccccatctcggcggccaaaaacgagggcatcgacgagctcatcgagcacgccatgcaggtggcgctgaaccgtgaaaagccccagcggctggacttctgctccggcgcggtgcaccggtgcatccacgccatctgccacctcatcgaggaccacgcccagcgggcgggggtgccggtgcggtttgccgccaccaagctggtggagggcgacgcgcccatgctggagaagatggacctctcggacaacgagaaggacatgatggagcacgccatcaccgagatggagggcgaagtgggcaccgaccgtgaggcggcgctggcggacatgcgctacggcttcatcgggcaggtgtgcgccgagtcggtggtgcgccggggcgagagccgcgagcacgcccgcagcgtgaagatcgacagcatcctcacccaccgggtgctggccatccccatcttcctggccatcatgggggtggtgttctggctcaccttcggcctcatcggccaggggctgagcgacctgctcagcctggggctggaccagctcaccgccctggcggacaagggcctcaccgcctacggcatcaacccggtggtgcacagcctcgtcatcgacggcatctttgccggcgtgggcagcgtgctcaccttcctgcccatcatcgtgaccctgttcttcttcctgtccattctggaggactcgggctacatggcccgggtggccttcgtgatggataagcttttgcgcaagatcggcctttccggccgcagcttcgtgcccatgctcatcggcttcgggtgcagcgtgcccgccattatggccacccgcaccctgtccagcgagcgggaccggcggatgaccattctgctgacccccttcatgagctgctccgccaagctgcccatctacgccatgttcaccgccgccttcttcaccgaccacaaggcgctggtgatgatcggcctgtatgtgatgggcatggtcatcggcgtgctttacggcctcatcctgaaggcggtggccttcaaaggcgagccggtgccctttgtgatggagctgcccaactaccgtctgcccagcgcgggcagcgttctgcgcctgatgtgggagaaggccaaggacttcctggtgcgggccttcaccgtcatctttgtggccagcctgctcatctggttcttgcagaccttcgacagccggctcaacgtggtcaccgactccgccaacagcctgctggcggccctgggcggcctgctggctcccctcttcgcccccctgggcttcggggactggcgggtgtccaccgcgctcatcaccggcttttccgccaaagaggcggtggtcagcaccctggcggtgctcaccggctccagcctgaccaccctgccccaggcgctggccggcatgttcacccccctcaccgccttcgtattcctcaccttcaccctgctctacaccccctgcgtggcggccatcgccgccgtgaagcgggagatgggcagcgcaaaggccgcggcgggcgtggcgctgacccagtgtgccatcgcctggggcgtggccttcgtggtgcggtgcatcggcctggctttgggcctgggctga

SEQ ID NO: 998 - DNA, 537 bp, Unknown
  Artificiall/Consensus sequence
atggcactggggtgcctcgcagttctgaccgcctgctccagcgacaaaagcacttcgcagacacaaagcaccggcacatcttcctctcaggcttcgtctggcagctctgagagcacagaggcgcaggagaccgtgatgggcgaggtgacctacgtcggctccagctacatcagcgtcactgcctacaccggcggcgaggacgtcaccgacttcaccactctggacgtttccgggctgacggcctctgaggacaccgagagcatcgacaccaccgaggataccgagtatctgaaagtggagtccggcatgctgaacgcagccacccgcgatgatgtgaccaccgggtccttcatcgtctccacctacgacgaggacggcacccaccagatcatcctggtcgagagcggcgacgcgacgggcaccgacactgattcggcctccgccagcacctctgaggacgaggcggccgaaggggcagactctgcttctgctgacgattcgacggtgagcgacgagagcagcacggccgaagcgtaa

SEQ ID NO: 999 - DNA, 978 bp, Unknown
  Artificiall/Consensus sequence
catacctgcgtggaacttctggcggccggctatgacatcgtcgtggccgacaactactacaactcctgcccggaggcggtgcgccgggtgaaggagatctccggcaaggatttccgctttgtggaggtcgacctcaccgacgcggaaaaggtggagcagctgttcgcgcagaacccggacattgactcggtgatccagttcgccgcctacaaggcggtgggcgagagcgtgggcaagcccatcgagtactacaccaacaacctcaccaccaccctcaccgtgctggccgccatgcgccgccacggcgtgaacaatctggtgttctcctcctccgccaccgtctacggcgacccggagaaggtgcccatcgatgagaactgccgcgtgggcggcaccaccaacccctacggcaccagcaagctgatgaacgagatgatgctcaccgactgctgcaaggcctaccccgagatgaacgtggcgctgctgcgctacttcaatcccatcggcgcccacaagagcggcctgatcggcgaggaccccaacggcatccccaacaacctggtgccctacatcgccaaggtggccgtgggcgcgctggaaaaggtgcatgtgttcggcaacgactatcccaccccggacggcaccggcgtgcgcgactacatccatgtggtggacctggccaagggccacgtggccgccatcaagaagctggagcagaagcccggcctgttcatctgcaacctgggcaccggcaagggctacagcgtgctggacgtcatcaaggcctatgagaaggcctgcggcaagaccctgccttatgtcatcgacccccgccgccccggcgacatcgccactgtctacgccgaccccgccaaggccaagaacgagctgggctggcaggcgcagtacggcatcgaggagatgtgcgcggacagctggaagtggcagagcatgaaccccaacggctataagggctga

SEQ ID NO: 1000 - DNA, 1491 bp, Unknown
  Artificiall/Consensus sequence
atggaagaaaaacgtctgcaagaacggcttcgccgcgcagtggtgctcatcgtggccgcaggactgctgctgcttgccgccggggaaggggtggcggcgtttttggcccgttccatggtcgaggtcaccaaagaccagatgcgcgcagagaccgatgaatacaaaaaccggctggaaaagcagatgagttcggactatcagatcctgaccaccatgtccggctttctcgagttcagcaatgtggacgaggccgaaaactttgacgagatcctgaacgaggcaaacctgcggaacgatttcgtgtccatggcctatttcccgctgaacgggtctggcgttgtggccgttttgggtcagccggtgcgcagcgatgtggaactggcggagatgcagccggaggtgcaggaagtcgtggcccaggcctggcagggagagatggcgctgtccgacctggtccaaagcgaactgacgcaggagaaaattttcatttacgccatcccggtgagccggaacggcgatacagtgggcgcattgatcgccagcgatcaggtggagatattctcggacatcctgagcggcgacaccgtgctttccggcaacggccacaaccatctgctcaactccaagggcgaactgctgatccattcccagaattccgttgtggaagaatcggtggcttccatctatgaagaaccctatttcagcggtcagaaagcggaagaaattcggacagccctggccgccggggaaagcgtctattcctccttccgctgcgagggccgcagctatcaggcgctgttggagccggtggacatcaaggattggtatatgctctgtgtcagccgggtgcaggaagcaagcgggctttatcggatcgtgacggtcattgcggtcacctttgcggtgctgctgctgttgatggtcatattgcttgtgtacggctatcgcctgacccgccgcaacgaccgggaacttcgcgatctggctttccacgacgccctcaccggcggcgacaatctgcgcggcttcactttgaagctgcaagaggccctgagccagcggcaggatgtgaatttggcggcgctggatgtccgtcagttcaagttcatcaacgagatctttggccgcgagcgggccgacaagcttctccgccacatccatcagcagctgcaggcacggctggaggagggagaattctgctgccgtgacagcgccgacctgttctatgccgtgttgctgaacaccgacccggagcaggctgccgcccggctgcggaacatcatggacgaggcttgtgccgctgccctgcaggacgcgaacagtgactaccatgtcctgctttatgccggaatggtggcggcgccgcagtgcgccgcgtccgggaaggtggacgatgtgctcacccatgcgatgttcgcgctggagcgggccaagggcgccagctgcaacacggtgtggacctacgacacagaactgcataaaaaagaagaa

SEQ ID NO: 1001 - DNA, 2424 bp, Unknown
  Artificiall/Consensus sequence
atgaaacacaaggaactcatcgaacagatgactctggaagaaaagtgcggccttctgtccggccgggacatctggagcacccggtcggtggagcggctgggcgtgcccaccatctacctgtccgacggccccaccggcatgcgcaagcaggtgggcgagggcgaccatctgggcctgaacgccagtctgcccgccacctgctggcccaccgccgtcaccgtggcctgcacctgggaccccgctctgggcgaggaactgggcgcggccctgggcgaggaggcggtggcgcagggggtgagcgtggtgctgggccccgggctcaacatccagcgcagccctctgtgcgggcgcaacttcgagtacttctctgaggaccccatcctggcgggcaaactggccgcgggctacatccggggcatccagagccggggcatcgccgcctgccccaagcacttcgccgccaacagccaggagaccctgcgcatggccagcgacagtgtggtggacgagcgcaccttccgtgaggtgtatctcaccaactacgagatcgccgtcaaggaaggcaagcccaaattcatcatgtcctcctacaacaagatcaacggcacctacgccaacgaggacaagaccctgctcagcgacatcctgcgggacgagtggggctttgagggcgctgtggtcaccgactggggcggctccaacgaccatgtggagggcgtgcgtgcgggcagccatctggagatgcccggcaccgccggcgactctgaccgccagctggccgccgccgtgaaggcgggcgtcatcagcgaggaagtggtggaccagcgggtggacgaactgctggacgtcatcctggcggtggccccgaaggaaaaggccgacggcagcttcgacaaggaaggccaccacgctctggccgccagggtggcggaagaggccgtggtgctgctgaagaacgaggagaacatcctgcctctggccgccggcgcgaaggtggccgtcattggcgactttgccgccaacccccgctaccagggcgcgggcagcagtctggtgaaccccaccaagctggagtgtaccctggacgtgctggacaagatgcccctggagagcgtgggctacgcccagggcttcacccgggcggacgcggtggacaaagccctcaccgagcaggcggtggccctggcaaagcaggcggacaccgtgctgctctacatgggcctgccggaaatcagcgagaccgagggcctggaccgggagcacatgcgcctgccggacaatcaggtccagctgctgaaagcggtggccgcggccaaccccaacgtggtggtggtcctggccgccggcagcccggtggagaccccctggctggagcactgcaaggccctggtctacaccggcctgtgcgggcaggcgggcgcttccgccgccctgcgggtcatcaccgggcaggtgtgcccgggcggccgtctgagtcagacctggcctctggagtgggccgacgagccggtgagccattactggcccggacgccagcgcaccgccgaataccgtgaaggccccttcgtgggctaccgttactttgaaacggcgaacaagcccgtgcgctttgccttcggctatggcctgtcctacaccacctttgcttacagcgaccttgcggtgagcgagaccgaggtcagcttcaccctcaccaacaccggcagtgtggagggcgccgaggtggcgcaggtgtatgtcggcaagcccggcagcgccattctgcggccggccaaggaactgaaagggtttgccaaggtgcgcctggcggaaggggagagccgccgggtcaccatccccctggacgacaaggccttccgctggtacgatgtgcaggccaaggcctggaaggtggagggcggcgagaacaccgtgatggtgggctccagctgcgccgacatccgcctgtccggcagcgtgaacgtggcgggcgaggccgtgcaggccaccgcggacaaggaagcgctggcctgctattacgacctcaaactggacgatgtgcccgacgaggccttcgctgccctgctgggccgcgaagtgcccgaaggcaagtgggacgagaccaagctgctggagatgaacgacgccatctgccagatgtactacgccaagaaccccatcgcccggctggcgggccgcatcctgactaacatgaaggaaaaaagcatcgccaacggcaagcccgacctgaacatcctgttcatctacaacatgcccttccgcggcatcgccaagatgatgaacggcatggtgagcatggagatggccgagggcatcctggtgatggtcaacggtcacttcttcaagggcctggggcaggtatggcgcggctggcgaagcctttcccgcatcgccaaggccgagaaaaacgccgcgcagggctga

SEQ ID NO: 1002 - DNA, 603 bp, Unknown
  Artificiall/Consensus sequence
gtgcatgtttatgcccttttctcgccatggcgggaaaagggcttttttatcgcgaacgaaagaatgtatcgcttgaaacgaggtgaaaccgaaatgcccagtgagaagattttgactgtcaagcaggcctatgttgccgagctgaaagagaagatcgccaattccgttgccggcgtggtcgtggactacaaaggcatcaacgtggccgacgacaccaagctgcgcaaggagctgcgtgaggctggcgtggagtacttcgttgtgaagaacaccatgctgcgtcttgccatcagcggcaccgagctggaaggcatgaacgacgtgctggaaggcaccaccgccctggccatcgccaaggaggaccgcatcgccgccgcccgcatcctgtgcaagtttgccgacgcttccaaggacaagttctccgtcaaggccggttatatggacggcaagctgatggagaaggcctccgtggaggagatcgccaagctgcccggcctggaaggcatgctctccatgttcgccggcgccctcaccagcaccctcagcggtctggccgtggccatgcaggcttatgtggacaagagcgaagaacccgccgcctga

SEQ ID NO: 1003 - DNA, 1557 bp, Unknown
  Artificiall/Consensus sequence
atgaacacagcaaagaaagcggcggcccgcgccgggcgcggggcctttttcagcctgcgctatcagatgatgatcgtgttctgcgttgtggtggcgctggtgctggggctggtgtggttcatctccgcccagctgctgcagccgctctacaaccggcacatctacaattacctcaacacccaggtggacacgctggtggccatgatcgaaagctgcgacgcgccggtgagctaccgggccttcggcttttccgatgcagtgaagaacgacgagttctgggccagcgtggacgccgccgcccaggacgggcggctggacttccgcaactgctgcgtggacatcgccgattccaccctgcgccatgtggccagcagcgagaacgtctatccctgcctgctgcacgagtcggcgggcgatctgttcggcggcaagatcaccaccaagcgggacagcgacaccatcatcgcctttcgtcaggcggtgatgacgggcggctcggtgagccagatcgtgggcacctccagcggcgcccagcagatggtggtgggcaagctggccaaaaacggcgagtggggcaactactcggtcatcatctccaccaccctcacccgcgtcagcgaggcggcggtggtgcagggccagctgatgcccgccatcttcgtgtgcatgctggcgctggcggtgggcgtgtcctggctgctcagccgctggctcacccggcccttgagcgaactgtccagcgcggcgaaaaagatggctgacggcgactattccgtgcgggtgcgggtgccccattccgatgagataggccgcctggcggacgagttcaaccacatggcggaccaggtctcccgctcggcccagctccagcgggagctgcttgccaacgtcagccacgacctgcgcacccccctcaccctcatcaagggctatgccgagacggtgcgcgacctcaccggcgacgacgcggccaagcgcaccgaccagctgaatgtcatcgtggacgagaccgaccggctctccggccttgtgaacagcgtgatggagctgtccaaggtgtccagcggcaccgagcagccccagcgggtgcgctttgacatgagccagctctgcgaggaggtggcccagcgctacgaggcggtgtgcgcccagaacggctgccggctggaactgcaggcggacgagcccgccatggtcagcgccgacccggccatgatggagcgggtgctccacaacctcctgggcaacgccatgcaccacgtgggcgaggacggcgtgttcatcctgcgggtggtgcccaaagagggctgcgcccgggtggaagtggaggaccacggcgcgggcatcgcccccgaggacctgccctacatcttcgaccgctactaccgcagccgctccgacgcgggcaaggtgggcaccgggctgggcctgtccatcaccaaggccatcctgcggggccacggcttccgcttcggggtggacagcaccgtgggcaaaggcaccaccttctggttcgaggccaccgacgaagcccccggcgacgcaaagcacaaataa

SEQ ID NO: 1004 - DNA, 1242 bp, Unknown
  Artificiall/Consensus sequence
atgccccatccgaatccgaaggaagtgtacggctcgctggtgttcaacgagcatgtgatgaaggagcggctgcccgccgccacctacaagagcctgaaggccaccctgcagaagggccagcccctggacatcgaactggccaacgtggtggccagcttcatgcgggactgggccatcgagaagggcgccacccactacacccactggttccagtccctcaccggcatcaccagcgaaaagcacgacagcttcatcagccccatgaaggacggcaccgccatcatggagttttccggcaaggagctggtgcggggcgagtcggacgcttccagcttcccctccggcggcctgcgggccaccgccgaggcccgtggctacaccacctgggaccccaccagctacgcctttgtgaaggacggcacgttgtgcatccccaccgctttttgcagctggacgggcgaagccctggacgaaaaaacgccccttttgcgcagcatgaaggcggtgagcgaccaggcctgccgcattttgaagctgttcggcaaggatgtggcccatgtggacgtgaccgtgggcctggagcaggagtatttcctcatcaagaaggagcactacgagcagcgtgaggacctcatcctcaccggccgcaccctcttcggcgcggcgcccgccaagggccaggagctggaggagcactacttcggcgcgctgcgcccggaggtgagcgccttcatgcacgagctggacgaggagctgtggaaactgggcgtgggcgccaagaccaagcacaacgaggtggccccggcccagcacgagctggccccccttttcgaccgctgcaacgtggcggtggaccacaacctgctgaccatggaattcatgcgccggctggccccgaagcacggccttgcgtgcctcttgcacgaaaagcccttcgagggggtcaacggctccggcaagcacaacaactggtcgctgagcacgcccggcatgaacctgctggaccccggcgacacccccatggataacctgcagttcctcatcttcttcgccgccgtcatccgcgcggtggacgagtatcaggacctgcttcgcatgtgcatcgcctcggcgggcaacgagcaccgcctgggcggcaacgaggcgcccccggccatcgtgtcggtgttcgtgggcgacgacctggccgccatcctggacgccatcgcctccgacagccagtacgtggcccccgaggccgcc

SEQ ID NO: 1005 - DNA, 1221 bp, Unknown
  Artificiall/Consensus sequence
atggtcttgtcaccgggcggcagcagtcctttcggcgcgaaaggcgcaaaaaagctccgccccaaaaatcaaggaggacaaaccatgaaaaagcttcttgcacttgcactgagcgctgtgctggccctgagcctggcggcctgtggcggcgcccccgcttccacccctgcttccacccccgcttccggggctgcctctgagggcggcgctgccgcaacctccgacatgcgcgtggacgtgttctattacgacttctccgacgtgtacatctccaccgtgcgcgccgccatggacgagcagctgaaggccatgggcatcgagcccaacaactgggacgccgccggcagccagcccacccagaccgaccaggtcaacaccgccctcaccgccggttccgacctgctgatcgtcaacatcgttgagaccgccacttccgcccccgcgcaggacatcgtgaacgccgcccagaccgccggcatccccgtgatcttcttcaaccgcgaggtggccgacgaggtcatcggcagctacgacaagtgcgccttcgtgggcaccaacgcccccgacgccggccatatgcagggcgagatgatcggcaactacctgctggccaactacgacaccgttgacctgaacggcgacggcacgatctcctacgtcatgttcaagggccaggagggcaacgccgaggccgaggcccgcacccagtacgccgttgaggacgccaacaagctgctcaccgaggccggcaagcccgagctgagctactacgacgccagcgcttccaccaagtacctggtggacaccgagggcaagtggtccgccaaggccgccaacgactacatggtcgccctgctgggctcctacaatgaggacaacggcaacatggtcgagctgatcatctgcaacaacgacggcatggccgagggcgccatctccgctttgcagaacgtgggctacaacaacggcgaaggcaccaccatcatccccgtgttcggcgttgacgccaccgacagcgccaaggctctgatcaaggccggcaacatggccggttccatcaagcaggacgccgtgggcatggcttccaccatcaacaccctggtcaagaacgtccaggacagcgccgagctgatggccaataccgatcagtacgtcgtggacgaaggcgtggccaagatccgcgttccctacgcgatgtacgacgccaccagcgaggactga

SEQ ID NO: 1006 - DNA, 1464 bp, Unknown
  Artificiall/Consensus sequence
atgccgcgacccctgactgattcgctggatgcgaatgtcgcccgcctgaaagagatgtttggcaactccgccgacctgtatgcaaagcccgtcaacgtgcggggcgtgccttgctgtttgtgcttctttgaggggctttccaccctggaacggctgtgggtagtgatgctctcgatgctgaacgagagccattttgagcccgcaaacggccaggacctgttcaactacatccagcaccagaccgacctgccggtagaaaatgcgccggtggaggactttgaagccctgcgcacccagctgaccgcgggcaccaccgtgatgctcattgacagatgccgtaaagcagttgtgctttccacgcagagcatgcagttccgctcggtgcaggaaccctccggcgaaggggacatccgcggctcccgggaagggttctgcgaccttgtgcgcatcaacgtcagccttgtgcggcggctggtgcgcactgaatcgctcaccatcaaaatcttccccgcgggcaagcgcaccggcaccgaggtggccatgttgtacgaccgcacgctggcaaagccggaatttgtcgaagccatcgagaaaaagctcaggtcggtggacctgccggtgctgttcgacagcgggtatctcgcgccctatctccagcggggcagcttcagcttctttcaggaggtgggctacaccgagcgtccggtgaccgccgccgccaagatatgcgagggcaagatcatcgtgctggtgaacgcaagcccctttgcgatgatcgtgccttacttcttcaatgaaaacttccaaagcctggacgattacgccggcaaggcctacttcgccagcgccgtgcggctgctcaagtatacggcgttctttttgtcggtgctgctgccgggcctgtttgtctccattgcggagtacaccccggagttgttcccgccacagcttctttacaaggtggctgccgccgagacggccacgcctttgccgctgttcatggagatgatgctggtcatcgtccttttggagatcatccgggaggccggcctccgcctgcccaagcccatcggccattcggtgagccttgtggcggcgctcatcgtgggagacgcggccaccaaagcgggcatcatgagcaccccggtgctcatcgtggcggccctgaccaccatctccatttttgtcatcccgtcgctgtatgagcccgccaccgttctgcgagtgctgttcgtgctggcaggcggcctgttcgggcccttcggtctggtgaccatgttcttcctgatgctggtgagcatctgcggcatgcactctttcggcgtgccctacacctcgccgctggtgccctttggccgcagcgccctgcgggacggccttgtgcgcatgccctggcagcgactggcgagccatccctttgacgtgaacgacctgcccggtggtgaggaaaactatgaatcgtga

SEQ ID NO: 1007 - DNA, 1071 bp, Unknown
  Artificiall/Consensus sequence
gtgctggtggcggtgctgctgggcgcggccctgggcttcatgtacacgcaggtgaatgtgggtgatctgcccgcctacgccgtgaccttcggcggcggcgagctgccccagaccggctaccagtggaaggtgcccatcgcgggcaactggctggcccgcaccctgagcgaggagggcgaggccgccgacctgggcgaagtgaccgacagccaccccgccctggagctgcccgccggcaccgagggtcagctgaccatccgcgacgaggcggaggaagtggtgttcgagggcaccgccgacgaatacgccgatttttcctttggcaaaaacggcagctattccgcccggctgacggtgagcccccagacgaacgagctgaacccctccaccaaaatggagggcttctgcctttatgacttcaccttccagctgcgggcccagcccaccctcaccctctcccacaccagcatggtgcagggcggcgtgatcggggtgaagctgaccggcgtggtgggcgacgcaacccccaccctttcctgtgagctggccccggcggtgttcacctaccacgacaatgcctggatcagctacatacccgtggactacaaccagttcggcggcgactacgagatcaccgccacggtggacggccagacggtgagcgcctcggtgtacatctacggccgcgagaaccgggagctggacacctacaccatcgacggctcggcggccatcccctacatggcctccatccccagccagctggaggatgtgatgagcatctgcgacccggacatctactggaacggcgccttcacccagccggtggatggcaaggtggtgcgggactacgccgtgctggaatacaccgaccgcatcgacgagctgaccctctccatctacccggagctggcggtgctgaacgagtccatcgcgccccggcgcagcgtcaacgtgaccatggccgtgaccccaggcaagaaggtgctggcccccgcggcgggccgcgtggtctacgcgggcaccaccagcggcggcgggcgcacggtggtcatcgagcacggctgcggc

SEQ ID NO: 1008 - DNA, 546 bp, Unknown
  Artificiall/Consensus sequence
atgaatgaaccatacggacagggctttgagcccgacaacaataccttttacgccagccaggggccggacggcgtgttcagcaccaatgcccgctatgagacgctggcggaatacaccgccaagaccttcggctggatgttcgccggcctgacggtcaccttcctggtggcgctggcgggctacaccagcggcatcggcatcctgctgctgcgcaactccctgctgttctggggcctggccatcgccgagatcgcggtggtgatggtgatgagcgcccgcatccacaagatcggcgtgggcaccgcccggggcatgttcttcctctacgccgccctcaacggtttggtgttcagctgctacttctacctctaccaaatgttcgatctggtgctggccttcggcgccaccgccctctacttcggcatcatggcggcctacggctaccttaccaagcaggacctgtccggctgggccaaacccctgatgttcggcctcatcgccatgctcatcgtcagcgtgttcggcatcttcttcggcggggtgaac

SEQ ID NO: 1009 - DNA, 1350 bp, Unknown
  Artificiall/Consensus sequence
atgtctaccatccgtttgctcgactgcaccctgcgggacgggggctatgtgaatgactggaaattcggctttgagaacatccgcgacatcgtgtcgagccttgtgaacgccggcactgacatcgtggaggtgggctttctgcgcaatctggaaccggacatggaccagagccgctggaacaccgtggccgaactgaaaaaggtgctgcccgccgaccgcaagaacaccatgttctccggcatggcgctgcacaacttctacgacatcgacaagctggagccctgggacggcaccggcatcgacatgatccgggtcaccttccacgactacgacatcgaacagggcctcgccttctgccgcaaggcccaggacaaaggctacaagatcagctgcaaccccatcaacatcatgggctactccgacgcgggcgttctgtggctgtgcgaacaggtgaacaagctgcaccccttcgccttctccatcgtggacaccttcggcagcatgcagatgcaggacctggagcgcatcgtgcgtctggtggacaacaacctcgccaaggacatcgccctgggcctgcacctgcacgagaatctggcccagagcttcagcctggcccagcgtttcctggacatgcatctggtgggccgtgacgtcacggtggacgcaagccttctgggcatgggccgcacccccggcaacctgtgcatcgagctcatcgccgactacatgaaccgcaactgcggcaagaactacgacatcgaccgcatgctggacgccattcaggagcacatcctgcccatcaaggaaaagagcccctggggctactccccggcctacttcctgtcggccaagtacaacctgcaccgcaactacgccgagcattttctgggcaagggcgacctttccaaccgggacatcaaccatctgctcagccgcatcgccccggagaaaaagaccgccttcgacgcggcctacgccgacgagctgtacgcttcttacaaggacaaccgcatcgacgacacggccgaccgggcccgtctggcccaggcgctggcgggccgcaaggtgctgtgccttgcccccggcggcaccctgagcacccaccgcaaagaggtggaggagttcatcgcccgggaggccccggtggtcatcgccgcaaacttcgtgccggaggacctcaaggcagactacgccttcttctccagcggcaagcggttcgacaagttcacctccctgccctgcccggtgctgtgcacctccaacctggagggcaaggcggacttccgtctggactacaacagccttgcgggtgccttcaccatgggcgccaacagcctcatcatgctgctg

SEQ ID NO: 1010 - DNA, 1674 bp, Unknown
  Artificiall/Consensus sequence
ttgataaagacccttttgaagtatgcgggcccctataagaaggagtccatccttgcgcctttgtgcgtgaccgccgaagtgctgctggagatcaccatcccgctgctgatgagccgcatcgtggatgtgggcatcgcgaaccgcgaccttgcctatgtggcaaagctgggacttctgatgatcctgatggccctggcgggcatggtcatgggcggggccagcagccgtttttccgccgtggccgccatgggcttcggcagcgagctgcggctggcggctttccgcaatgtgcagaatttcagcttttccaacgtggacaaattcagcactgccagccttgtgacccgtctgaccaccgacgtgaccaacacccagaacgcctatcagatgtgcatccgcatgctggtgcgcgcgccggtgatgctcatcagcgccaccttcatggccttttccatcaacagcgaactggtgacggtgttcctcgtggccattcccgtgctggcctgcgcccttgtctgcgtcatccggctggcctatcccaagttcatcgccatgctggcccgctatgaccggctgaacgccagcgtgcaggagaatctcatcgccatccgggtggtgaaggccttcgttcgctcggagtacgaaaagcagaagttcaaggaagccaacgacgacctgatgaaccagtccatcaaggcggagagcatcgtcatcaccctgatgcccatcatgcaggtcacggtgtacagctgcatcatcgccatcctctggttcggcggccagctcatcatcggcggcatgatgctcagcggcgaattgatgagcttcatcagctatgtcactcaaattctgatgagcctgatgatgatcggcatggctttcacccagctggtcatcagccgggcctccatccagcgcatcgtggaggtgctggacgaacagcccgagatcgtgggcgcgccggagggcgaaggctcccagctggaggacggcagcgtggagttcgaccatgtgaacttcaagtatgccaagaccgccggcgaggacgtgctcagcgacatctgcctgtccatccgctcgggcgagacggtgggcatcctgggcggcaccggcagcgccaagacctcgctggtgcagctcatcccccgcctttacgacatcaccggcggccagctctccgtgggcggccacccggtgaaggactacaacctggacgtgctgcgccacggcgtggccatggtgctgcagaagaacgtgctgttcagcggcaccatccgggagaacctgcgctggggcgacgcgaacgccaccgacgaggagctggtggaagcctgcaaggcggccagcgcccacgacttcatcacctcctttcccaaggggtacgacaccgacctggggcagggcggcgtgaacgtgtccggcgggcagaagcagcgtctgtgcatcgcccgggcgctgctggcaaaaccgaaaattctgattttggacgactccaccagcgcggtggacaccgccaccgacgcggccatccgcgaggcgctgcgcacccacctgaaggactccaccaagatcatcattgcccagcgtgtggccagcgtgtgcgacgctgacaagatcgtggtgctgaacgacggcaagatcgccgacatgggcacccacgacgaactgatggaa

SEQ ID NO: 1011 - DNA, 1281 bp, Unknown
  Artificiall/Consensus sequence
atgaatctgaatctggatgctgacctcgcccggcgcatggccgcgccgggagacgtggaggcggcgctggaggccgcgaaggcggagtaccgccggctggcggccctgggcagcgaggacaaggactggcccgtcaccggctggttccactgcgccgaggccgcccagcagctggacctcatcaaagagaaggccgccgaaatccgccggaacgccgaggtgttcgtgctggtgggcgtgggcggttccaaccaggccgcccgtgccctcatcgaggcggtgaaaaagcccggcggccccgccattgtctatgcgggcaacaccctgtccgcccacggggtggccgaggtgctgaaggccatcgagggcaagagcgtctacatcgacgtcatcgccaagaacttcgagaccctggagccgggcagccactaccgtgtgctgcgcgccgccatggcaaagcgctattccaaagaggagatggccaaacgggtcatcctcaccggcaccgtgggctcccgcctggaggagatcgccaaagagaacggctgcaccttcctccacttcccccgccgggtgggcgggcgctactccgccttcaccccggtggccctgctgcccctggcggtggcgggcctggacgtggacgcttatctcgccggcggtcttgccatggaagaagagctggccaagaccgaaggcggccttgccgccgagtacgccgcggtgcgctacgcgctctaccgccggggcttccaggtggagatgctcaccgcctttgagccgcgcctgttctgggccgagcagtggtggaagcagctcttcggcgagagcgagggcaaggagaagaagggcatgctgcccgcttccatgataaactccgaggacctgcacagcatgggccagtacatgcaggacggcctgcgcttcatgaccgagaccttcctttcggtggacgaccccggcgcttcggtggtcatcgagccggacccggactttggcgacggcttcgactatctggacgacatggattttgccaacatcaaccgcgcggcggaaaaggccaccatccaggcccacgccgccggcggagtgccctgcatggtgctgcgtctgccccgcatcgacgagcgcaccttcggccttgtctactacttcttcatggtggcctgcgccctcagcggccggctgctgggggtggaccccttcgaccaggagggcgtggaggaatataagcgcagcatgttcgcggcgctgggcaagcccggcgtcaagggcagatga

SEQ ID NO: 1012 - DNA, 819 bp, Unknown
  Artificiall/Consensus sequence
gtgtttttggtgagcgagtatcccatcccccagagctatgtgccctgcctcggcctttacgacacccagaaggccattggcatgatcaagcaggccttcgaggtcaagctgtgcgcggcgctgcacctcaagcgggtcaccgcccccctgttcgtggacccggccctgggcctgaacgacgacctgaacggcgtggagcgcccggtgagctttgacatccccgccgccggcgtcagcgcccaggtggtgcacagtctggccaagtggaagcggctggccctgcatcaggacggtttccgccccggcaacggcctgctcaccgacatgaacgccatccgccgggacgaggaactggataacctccactcggtgtatgtggaccagtgggactgggagaaggtcatcgacgcggaccagcgcacccgggagtatctgcacgctaccgtgcagaacatcgtctacgccatcagctccactttggacgaactgaaatggcagtttccccagctcaccggcagcctgtgccgggaggtgaccttcgtcaccagccaggagctggaggaccgttggccggaccttacccccaaagagcgggagaacgccttcgccaaggagcaccgcaccatcttcatcgagcagatcggcggcaagctgaagagcggcaagccccacgacggccgcgccccggattacgacgactggagtctgaacggcgaccttttgttctggcacgagccgctgcagtgcgcggtggagatcagcagcatgggcatccgggtggacccggcggccctggaccggcagctgaccctggcgggc

SEQ ID NO: 1013 - DNA, 1440 bp, Unknown
  Artificiall/Consensus sequence
atcctgatttttgcagccgtgtcggtgggcctgtttgtgggcggcgacacgctgttcaccgtgctgagcagcctgctgcagaccctcaccacccgcctggggtgggtgtatctgtggatctacatcatcaacttcatcttcctgggctggctggccttcagcaaatacggcaacatcaagttcggcgcgccggacgaaaagcccgaatacagcaacttcagctggacgtgcatggtgttcaccaccggcatcgacgcctccatcatgatcatgtccctgttcgagcccatccaatacgtcagcgcgccgcccttcgggctggagcctttttccgccgaggcctatgactatgcccacatgtacgggcagttccactggggccccagcgcctggaccatgtacatcccggccaccatcgccattgcctacaccctgttcgtgaagcgcaccgacaccacccgcatcagcaacgcctgcgtgcccgcctccggctggctggagcggcacctctgggcgcggcatctgctggacgtgatcatcgtgttcggcatcatgggcggcatcggcgcttccatcggcctggagatccccgtgatctcccgcattttccaccagctcaccggcgtggccgacaccctgggtctgaagttcatcatgctggccgcgctgctggtgctgttcggcagctgcgtgtatctggggctggaaaagggcatgaaatggctcagcagcgccacggtgtacatcacgctgggctttctggtggtgaccctgctgtgggggcccaccagctacctcatcgacgccgagaccaacagcatcggcctgctggcctccaacttcgtgcgcatgagcacctacaccgacccccatctcgcctccggcttcccccagaactggaccatcttttactggggctggtggctggcctacatgcccgtgatggggctgttcgtggcccgcatctcccggggccgcaccatccgtcaggtcatctgcgggcaggtgctgtggggctcggtgggctgcatgaccgtgttcggcatcatgggcggctacgcgctgtatgtgcagcgcaccggcatcgttgaccttgcgggcattcttgccaccgagggccaggaggccgccatcaccgccctgctctccaccctgccgctgccccagctgatgctggtggtgtatctcatttcctgcttcgtctttcttgccaccaccatcagctcctcggcctacatcctgtcgtcgatgaccagcaaaaagctcagcggctacgagaaccccgcccgctggaaccgcctgctgtggtcggtggtgttcatgctgttctccgccggcatcatggtggtgggcggcatggagaccatcaagctggtctgcgtgctggccgggttcccgctgatcgccgtcgtgctgcttctgatgcggtccatccgccgc

SEQ ID NO: 1014 - DNA, 1152 bp, Unknown
  Artificiall/Consensus sequence
atgaaactcaaactcaaacgtatccgggagctgttcggctatgcctttgaccttttaaagagcgagggcctcttcgccatggtgcggcgggcgctgggctttttccgccgccgcctcttcggcaagcgggcccgctacctgcccaagaaaaaggtgctgcaggcccagcgggcggacctggccgaccggtgggaaaacggcgcagccctgcccctcgtgagcatctgcgtgccgctctacaacacgccggagccttttttgcggcagtttttggccagcgtctttgaccagaccagcacccggtgggagctgtgccttgcggacgcctccgacgaggcccatgcctatgtgggcgaaatcgtgaagcagcgggcggcctttgcggaaaagatagccccggcggcaagccgggtgaagtacgtcaaggtggagaacaagggcatcagcgccaacaccaacgcggcggccggccttgccaccggcgagtatctggccctggcggaccacgacgacatcctggccccccacgccatctacaccctgcagatggccattctggacagcggcgcggatttcctttacagcgacgaggcccttttcaaaaagagcatccgccggcccatggtggcccacttcaagccggacttcgccccggattatctggtctgctgcaactacatctgccatctttccgccttcaagcgcagcctgtactttgaggcggggggtgagcgcagcgagtgcgacggcagccaggaccacgacctgttcctgcgcctgaccgaccggctggacgacacccaaatctatcacatcccccaggtgctctattactggcgggtgcacggcgcctcccccagcggcggcaccgccgccaagccctatgtggccaaggcggccaaaaaggccatcgccgaccatctggagcgcaccggccagcggggcgaggtgcgggacggcctttaccccagcacctacaaggtggactatgagatcgagggcgagccgctggtgagcatcctcatccccaacatggaccacaccgacgacctggaaaagtgcctgtcctcggtctacaaaaagaccagctggcacaacttcgaggtcatcgtcatcgagaacaactccaaagaggcggccaccttcgactac

SEQ ID NO: 1015 - DNA, 1476 bp, Unknown
  Artificiall/Consensus sequence
atggcgcgttttgggccattataccacacccgccgcgcccgccgcaacccggggcggagcgccgggccgggaaaggagaccttcatcttgtctgatacccaacccgtttcttccgcgtccgacagtgaccgcctgctggggcaggcgcccatcggcagcctcatcctgaaactctcgctgccggcggtggccgcgcagctcatcaacgtgctctacaacgtagtggaccggatgtacatcggcaacatcccggacatcggcgccaccgccctcaccggcgtgggggtgaccttcccggtgctgatgatcgtgtccgccttcgcggccttcgcgggcatgggcggcgcgccccgggcgggcatccgcctgggcgcgggagacaaggacggcgccgagcagatcctgggcaactgcttctcgctgctgctggtgctgagcgtggcgctgacggtggtgttccagctgctgcgcacccccattctggtggctttcggcgccaccggcaaccttctgccctacgccgaggactacatctccatctatctgtggggcacggtgagcgtgcagctggcgctgggcctcaacaccttcatcagcgcccagggccgcagcggcaccgccatgctcagcgtggccatcggcgcggtgctgaacatcgtgctggaccccgtcttcatctttgtgttcgatatgggggtcaagggcgcggccatcgccaccgtgctcagccaaacggtgagcgccgtgtgggtgctggcctttctgctgtcgggccgcagcaccctgcgcatccgcagaaagaacctgcgttttcgtgccccggtgctggccagcgtggccgcgctgggcgtttcgcccttcatcatgcagagcaccgagagccttgtgaccatcaccctgaaccggggcatggcccaatacggcggcgagctctacatgggcaccatcaccatcctgcagagcgtgatgcagctgatcgtgctgccgctgcaggggctgacccagggcacccagcccatcatcagctacaactacggtgcgaagaacctggaccgggtgcgcgccaccttcaagcgggtgttcctcatcagcatgatctacaccatcagcgcctttgccctggtctgcctgctggcatggccgctgtcccgcatgttcacctccgacgcggcgctcatcgacctgacggtgaaggccatgccggtgttcttcggcggcatctgggccttcggcgcgcagatgagctgccaggcggccttcatgggcctgggccaggcgaaggtgagcctgttcctggcgctgctgcgcaaggtcatcctgctcatcccgctggccatcgttctgcccatggtgctgggcggcgaccccttcgccatctatctggcggagcccgcatcggacttcatcgccagcgccaccaccctgaccattttccttttgttctacaagcgcacgctgaaccgccccgcagactga

SEQ ID NO: 1016 - DNA, 1272 bp, Unknown
  Artificiall/Consensus sequence
ccggacatcgccggcctgatgggtgccttcggcgctgctctccacggccgcgccaccgccaaacccggccagaagagcaccgtgctgggccccgaggaactggcggctttcagccagaccacccgcaccgtgcagtgcaacggctgcaccaaccactgccagctcaccatcaacaccttcgccggcgggcggcggctcatcagcggcaaccgctgcgagcatccggtgagcggcggggccgccggcggcggcgactccctggacctctaccgctacaagcagaacctgctggcgggctacaagccggtggagggcccccggggccgcatcggcatccccctgtgcctgaacatgtacgaactgctgcccttctggcacgccttcttcacctccctgggctttgccgtcgtcaccagcccggcctccgaccgggcgctctacaccgccggccaggccagcatccccagcgacacggtgtgcttccccgcaaaactcgcccacggccatatcaaggccctgagcgagatgggcgtggacgccatcttctacccctgcatgagctacaacatcgacgagcacctgggcgacaaccactataactgcccggtggtggcctactaccccgaagtgctggaggtcaactgccccgagctggcaaacatccccttcatcaacgacttcgttggcctgcaccgcccggcggacttcaaaaacaagatgtattttatccttaaaaaatactttaaggatattagcaaggaagaggtggccaaggccgccgacctgggctacgccgagtatcacgaccacatgcagcgcctgcgggacaagggcgcccagatcatcgccgatgcccgtgcggcgggcaagcgcatcatcgtgctggcgggccggccctaccacgtggacccggaggtcaaccacggcatcgacggcctcatctgccagcacggcgcggcggtcgtcaccgaggacagcgtggcctggcacatggagaaattccccaccaccgtgctcaaccagtggacctatcactcccggctttacgccgcggccaaatactgcaccacccagccggacatggacctggtgcagctggtgagcttcggctgcggtgtggacgccatcaccaccgacgagacccgcagcatcctgcaggcggggggcaagctgtacacccagctgaagatcgacgagatcaccaacctcggcgcggtgaacatccgtctgcgcagcctcttcgccgcgctggacgaaaaggacagaaagggg

SEQ ID NO: 1017 - DNA, 1155 bp, Unknown
  Artificiall/Consensus sequence
atgctggtaccccttcgcgcgatcctggaagccaccgagaaatatcactacgcccagggcgccttcaacgtgaacgccgtggcccaggccaaggccgccatcgaggtgcatgagatgttccgctccgccgccatcctgcagggcgcggacctggccaacggcttcatgggcggccgcaccgacttcatgaacgccaccctggaagacaagatcaagggcgcggccaacatcggcgcggcggtgaagaagtacggcgagggcagccccatccccgtggccctgcacctggaccacggccgcaacttcgagagctgcaaggcggccatcgccggcggctacacctccgtcatgatcgacggttccagcctgccctttgaggagaacatcgagatcacccgcgaggtggtcaagtacgcccacgagcggggcgtcaccgtcgaggccgagctgggcgtgctggcgggcgtggaggaccacgtgttcagcgccggctccacctacaccaaccccctggacgcggtggagttcatcaaaaagaccagggtggacgccctggccatcagctacggcaccatgcacggcgccaacaagggcaagggtgcgaagctgcgcaaggagatcgccatcgccaccaaggagtgcctgctgcatgagggcatcttctgcgccctggtgagccacggctcctctaccgtgccccagtacatcgtcaaggagatcaacgacctgggcggcgacatccagaacgcctacggcatcgagctggcccagctgaaggaggccgcccgctgcggcatcgccaagatcaacgtggacaccgacatccgtctggccgtcacccgcaacatgaaggagctgttctacaaccgccccgagctgcgggaaagcccctccatcggcggcatctacaagctgctggaagagaagaagagcgccttcgacccccgcgccttcctgccccccatcatggacaccgtcatgtacggcaacgtgcccgacgcggacgtgggggccatcgtggactgcatcgagaagggcgtgcgcgaggtcattggcaccctcatcgtggagttcggcagcgtgggcaaggctccgctggtggagaaggtcaccctggacgagatggccgagcgctaccgcaaggaaggcatctga

SEQ ID NO: 1018 - DNA, 1065 bp, Unknown
  Artificiall/Consensus sequence
atgaacgcagagttttttgaggccctgaacatgcttggcaaggagcggggcctctccccggaatacctgatcgagaagatcaaggctgccatcgtcatcgccgtcaagaaggactacgaggtggaggacgagaacgttctggtggagatcgacccgctgaacgggcgcttctcggtgaacctggtgcaggacgtggtggaagaagtggagaacccccacacccagctgagcctggagcaggcccacgccatccgcaagacctatcaggtgggccagcgtgtggtgacccccctcaagaccaaggagttcggccgcatcgccgcccagaccgcaaagcacgtcatccgtcagggcatccgcgaggccgagcgcagtcagctgtacagcgagatgcagtccaaggcccacgagatcgtcaccgcccaggtggtgcgcatcgacagcgaaaagggcatcgtggtgctggacatgggcaagggcgaggcggtgctgccccgctccgagcaggtgcccggcgaggagttctacgagggccagcacgtgcaggtctacgtcaaggacgtgatcgtcaccgagcgcgggccccgcatcatcatcagccgcaccagcgagcagctggtcaagcggatgttcgagatggaagtgcccgaaatttttgacggcaccgtggagatccgcgccatcagccgcgaggccggcgtgcgcaccaagatggccgtctggtccaaggacgagaacgtggacccggtgggcgcatgcatcggcgcccacggcgcccgcgtcaaccagatcgtggagcagctgcacggcgagaagatcgacgtggtgcgctggagcgaggacatcaccgagttcatcggcgcggccctcagccccgccaaggtgctgaaggtcgaaattctcgagggcgagcgcaaggcctgccgcgtcaccgtgcccgaccatcagctgagccttgccatcggcaacaagggccagaacgcccgcctgtgcgcccggctcaccggctacaacatcgacatccgccccgagagcggctactacggcgaggacaccgaggactga

SEQ ID NO: 1019 - DNA, 987 bp, Unknown
  Artificiall/Consensus sequence
atgaaaaaagttttggctttggtcatggtcctggctctggctctgagcttcaccgcttgcggcggctctgccaagaaggtcaagaccggtatcgccatcgtctccagcctgagcggcaccaacgcttccgctgatgagaccggtctggctcaggtggacagcactgtcgccgccgtgaccgttgacgaggacggcaagatcgtttcctgcaagatcgacgtggctcagaacaaggtgcctgtgaacgctgacggcagcttcgacacctccctgaccttcaagtccaagcaggagctgggcaccgactacggcatgacccctgccagccccatcggcaaggagtggaacgagcaggccgacgcctttgccgcctatgtggtgggcaagaccgccgctgaggtggaggccatcggcgtgaccggcgagcacaacgcccccgacgtggccgacctggctgcttcctgcaccatgaacgtggtggacatcaaggccgccatcgtggaggcctgcaacaacgctcaggatctgggcgcttccgccgaggataccctgggcctgggcctgtccaccgagatgagctcttccaagctgcccaccgctgacgaggctggtctggtccagaccgacaccacctacgccgctgtcacctacgacaaggacggcaaggtcaccagcaccctgctgaactgcacccaggccaagttcgacgtcaccaccgacggtaccgtgaccccgaagagcgagaccatcgttcccaagatggagcagggcgacgactacggcatgcgcgctgccagccccatcggcaaggagtggaacgagcaggccaacgccttcgctgcttacctgaccggcaagcccgccgctgaggtcagcgctatcggcgtgaccggcgagcacagcgctcccgacgtggccgacctggctgcttcctgcactatgaacgtggtggccttcatcgacgcggtgggccgcgccatggcctga

SEQ ID NO: 1020 - DNA, 867 bp, Unknown
  Artificiall/Consensus sequence
ttggccggggcgggcagccttggctttgctgccgcgccatttgccgccttttccggcagtttgaccatcgcctggcgcgctgccctgttcacttgttccaaaagatgtttggccggcccgccggccccaaagcatttcaggaaaggagagaagcccatgatcagcatcgccattgtggaggacgaggactcctgcgcgaagcagatggaggagtatctggcgcgctatgccgatgagagcggcgaggcgtttgcgacggcgcgcttttgcgacggcgacgagattttggagaactaccgcgcccagtacgacatcatcctgatggatgtgcagatgaagttcatggacggcatgaccgccgccgaggagatacgcaaggtggacccggaggtggtgatcatcttcatcaccaacatggctcagtacgccatccggggctacgcggtggacgcgctggactatgtgctcaaacccgtgagctacttcgccttcagccagcggctggagcgtgccatcggccggatgaagcggcgggcaaggcgctacatgaccatcgccatccggggcggggcccgcaagctggacatctcccgcatcctctatgtggagagccagggccacagcctggtgtttgtcaccgagggggaggagcacaccaccaccggcaccatccgggaggtggaggaaaagctggaaagctacggctttttccgctgcaacaagggctgccttgtgaacctggaacatgtggacggcgtgcgggacggctgcgccatcgtgggcggacatgccctgcccatcagccgggggcgcaagaatgagttcctggcggcgctgaccgactatgtgggcgaggtggtcaaatga

SEQ ID NO: 1021 - DNA, 924 bp, Unknown
  Artificiall/Consensus sequence
gcgccctttctgcgccagatgataaacagcgtgctggcccagagctaccagcgctgggagctggtgctggcggacgcctccgacgatgcccattccgacgtgggccgcatcgcgcaggggtttgcccaaaaggacagccgcatccgctacctgaaactggaggaaaacggcggcatcgccgccaacaccaacgcggcgctggccgccgccaccggcgactggctcactcttctggaccacgacgacgtgctctatgccaacgccctctaccgggtggccaaggaggcgctggccggggcggatttcgtctattccgatgagatcgtcctctcggcggacctcaaacatctggtggactaccccttcaagccggactttgagccggactatctgcggagctgcaactacatcacccatctggccgccttctcccgggcgctctttgagcgggcgggcggcggcgagcgcagcgagtacgacggcagccaggactttgaaatcatcctgcgcctcaccgagcacgcccaaaaggtgacccacatcccctatgtgctctacatctggcgcagccattccggcagcaccgccagcggcatggaggccaaaccctacgccctggcggcgggggagaaggccatcgacgaccacctgaaacgggtgggcctggaaggaacggcgaagcgcatcgagggctgccccggcgcttaccgggtgaagtacgccctcaccggcacgcccctcatcagcgtgctcatcccgaacaaggaccacatcgaggacctggaccgctgccttgccagcctttacgccaaggcgggctacgacaactttgaggtcattgtggcggaaaacaactccgccgcccccgccacctttgaatattacgaggcagcgaagaagaagttcccccggctgcaggtggtc

SEQ ID NO: 1022 - DNA, 1947 bp, Unknown
  Artificiall/Consensus sequence
atgaagaactacgccaacacaaacatccgaaacatcctcgtcgccggccacgccggctgcggcaagaccactctggtggaggctctgctgtacaccaccggcgcgctggagcgcatgggccgcgtggaagacggcaacaccgtcagcgactttgaccccgaagaggcaaagcgccgcgcctccctgaatctggcagtggctcccgtggagtacgaagacgtgaagctgaatttcctggacacgccgggcctgttcgactttgagctgggccagtatgagggcatccaggccgccggcagcgtgctcatcaccgtttcggcacgttcgggtgtgaccgttggcgcggagaaggcctaccgcctggccgaaaagctgggccgcagccgcatggtgttcgtcagcaagatggacctggagaatgccaacttctataaaattctggaagagctcaagaccaagttcggcccctcggtgtgcccctgcgtggtgcccacccgccaggaggacggcacggtggtgtatgtgaacctgttcagccagaaggctttcaagtatgagagcggcaagcaggtgcaggtgcccctgcccgacatgggccaccgcctggacggcctggtggaagccatgagcgaagccgtggccgagaccgacgacgctttgatggagaagtttttctccggcgaggccttcaccaccgaggagatcgtggaaggtctggccaagggctgcaagagcggcatgatcacccccgtgttctgcggcagcgccgtgaacctgcaggcgctggacatgctgctgtataacctcaaggtcctgctgcccagccccgccgaggtgcccgcccccgtggccctcaccgccggcggcgacgaggtcaagctggaatgcgaccccgcggcccccgtggcggcctatgtgttccgcaccgtggccgaccccttcgtgggcaagctgagctacgtcaaggtgttcagcggcaccctcaccaccgccaccagtctggtgaacgcccgcaccggcgaggccgagcgcttcggcaagctgctgaacatgcgcggcaaaaagcagaccgatgtggattccatcaccgccggcgacatcggcgcggtgaccaagctctccgccgcccagaccggcgacaccctgtgcgaccccgcccgtgtggccgccctgcccgccgccgccttccccaaccccaccctgtccatggccatccgcgtgaccaagaagggcgacgagggcaagatcggcgcggcgctggcccgcctgatggaagaggaccgcaccctggcctaccgcgtggacgcggagaccggccagcagatcatctccggcctgggcgagcagcatctggacgccgtggtggccaaactgaaggccaagtttggcgtggatgtggagctcaccgccccccgtgtggcctaccgtgagtcggtgcgcaaaaagtgcaaggcccagggccgccacaagaagcagaccggcggccacggccagttcggcgacgtgtggatcgagttcgagccctgcgacagcgaagaactggtgttcgaggagaaggtgttcggcggcagcgtgcccaagaactacttccccgcggtggaaaagggcctgcgtcaggctgccaagcacggcgtgctggcgggctaccccgtggtgggcctgaaagccaccctgctggacggcagctatcaccccgttgactccagcgaaatggccttcatcatggccgccaagctggcctacaaggccgccctgcccgaggccggccccgtcatcctggagcccttcggcaccctgcgcgcccacgttcccggcgacaacaccggcgacatcatgggcgacgtgaccaagcgccgcggccgcgttctgggcatgagccccgacgaggacggcctgcaggtggtggaggcggaggtgcctctggccgaaatgcaggatttcaccacc

SEQ ID NO: 1023 - DNA, 1185 bp, Unknown
  Artificiall/Consensus sequence
atgatccatcaataccagctcaacggctacaacatcgtgctggacacctgctccggcgccatccacgtggtggacgaggtggcctatgacctcatcgccggctataaaaacgagccggaagaggagctcatccgccgcgtgtgcgaaaaatacaaggaccgcgagggcgtcaccgaggcggaagtgcgcgcctgcctcgacgacgtgaagggcctcgaggccgcgggcaagctttacagcccggacacctttgccgaccttgccggccagttcaagggcaagcgggagaacgtcatcaaggccatgtgcctgcatgtggcccacacctgcaacctcaactgctcctactgctttgccagccagggcaagtaccacggcgagcgggcgctgatgagcctggaggtgggcaagcgcgcgctggacttcctcatcgagaactccggctcccggcataacctggaggtggacttcttcggcggcgagccgctgatgaactgggacgtggtcaagcagctggtggcctacgcccgccagcgggagaaggagtgcggcaagaacttccgcttcaccctcaccaccaacggcatgctcatcgacgacgacgtcatcgactttgccaaccgggaaatgaacaatgtggtcctcagcctggacggccgcaaggagatccacgaccgcctgcgggtggactacgccggcaacggcagctatgaccgcatcgtgcccaagttccaggagttcgtgcgccgccggggcgacaaagagtattacatgcggggcaccttcacccacgcgaaccccgacttcaccaaagacgtgttccacatggccgacctgggcttcgaccggctgagcatggagccggtggtctgcgcgccggacgaccccgccgccctcaccgacgaggacatccaggtggtgctgaaagagtacgagaagctggccatcgagatgatcgagcgcaaaaaggcgggcaagcccttcgtgttctaccactacatgctggacctcaccggcggcccctgcatctacaagcgcctctccggctgcggcagcggcaccgagtatgtggccgtcaccccctggggcgacctctacccctgtcaccagttcgtgggcgaagaggcctacaagctgggcgacatctggcagggcgtgaccaacgaggctgtgcgggaggagttc

SEQ ID NO: 1024 - DNA, 1302 bp, Unknown
  Artificiall/Consensus sequence
tccggcgtggacaaggtggtgagccgcgccgtcaagggcggcgtgctctccatggcggaactgatggaggtggcgggcgcgctgcgcaacttccagaacctagtgtcctggtacggccttaccgagcacgacatgctgccggtggacgatttgttctacgccctcagcccccagcccgggctggaaaagcagataagctccgccatcctctcgccggaggaaatggcagacaccgccagcaacaccctgttcgaggtgcgccgcaagatacaggccaccgaaaactccatccgggacaagttggacgccatcatcaaaaacagcaccaccaacaagtttttgcaggacgcggtggtctccatccgaaacggccgcttcgtggtgccggtgcgggcggagtatcggggcgaagtgggcggcgtcatccacgacgtgtccagcagcggcgccaccgtgttcgtggagcccaccgctgtggtggaggccaacgccaagatcatgcagctgcgcagccaggagaaggcggagatcgagcgcatcctcatcgccttcaccgagcaggtggcctccatcgagccgatgttcaacttcagctataaggccatgctggacatcgacgtgctgctggccaaggcccatctggccctggagcagaaggcctggatgccccaggtggcggacgacgtgcattttgacctgaaaaaggcccgccaccccctcatcgaccccgacaaggtggtgcccatcgacgtggccctgggcgaaaattacgacaccctggtcatcaccggccccaacaccggcggcaagaccgtcaccctcaagaccgccggcctgctctgcgccatggctcagcacggcctgctcatccccgcccacgagcacagcaccgtctgcgtgttcaccgactatcttgtggacatcggcgacgagcagagcatcgaacagagcctgtccaccttctccggccacatgaaaaagatcaccggcatcctggacaacgccttcaagggcagcctggtgctgctggacgagctgggcgcgggcactgaccccgccgagggcgcggcgctggcggtgagcatcatcgagcagctgcgcatccagggcgcgctggtcatggccaccacccactattccgaactcaaggtgttcgcactggagacggcgggcgtggtgaacgccagctgtgagttcgacgtggagagcctgcgccccacctacaaactcagcgtgggcgtgccgggcaagtccaacgccttcctcatcagcgaaaagcttggcctgcccgcccgggtcatc

SEQ ID NO: 1025 - DNA, 2616 bp, Unknown
  Artificiall/Consensus sequence
atgttagccatcaacattcaagacgtgatcaacgtcctggccagcgtcaagacccacttgatcgtgctgggcgttgctctcgtcgtcgctctggcggtgatcattgcctgcaaggctctgcccgtcgccaagagaaagctggcccgcagcagcgccctggtggcgctgggcctggccgtcatcatcgtggtgaacaccatctgcttcggacccatgttcaccatgatcaacctggccatgggcggcggctccatcaccgaggagagcatggccgaggcctacgaggtcaacaccgagctggtgagcgaaggcgtgaccctgctggagaacaacggcgccctgcccctggccagcggctccaacgtgaacgtctttggctgggcttccaccgcccccgtttacggcggcgtgggttccggcgctctgaacgaccagtacgccgtgaccgacctgatcaccggcctgaccaacgccggcctgaacgtcaaccaggatctggtggacttctacgaggcctatcaggccgagcgtcccagcgtgggcatgtgggcccaggactggaccctgcccgagcccaacgtcagcgcctacaccgatgaactgatggcctccgccaaagagttcagcgacaccgcgctggtggtcatctcccggcccggcggcgagaacgccgacatgcccaccgacatggccgccgtcgtggacggcacctggaaggagcgggacgctctgaccggcaactcctacttcaacggcgtgtacgacgacaccctgaacgagggcaacgactgggatgaaggcgaccattacctgcagctgagcaaccgcgaggaagagatgctgcagatggtgtgcgacaacttcgacaaggtcatcgtgctcatcaacaccaacaacgccatggagctgggctttttggaggagtacggtgtggacgccgctgtctacactccctgccccggccagaacggctttgacgctgtgggcctggtgctggccggcgcggtgaacccctccggcaagaccgtggacaccttcctctacgacctgttcaacacccccatcgccaacaacttcggccagttcatgtacgacaacatggacgagttcaccgtgaccagcgtggacttcggcagcggcgaggagaagcccggcgtgcccagcttcgtgaactacgtcgagggcatctacgtgggctacaagttctacgagaccgccgccgccgagggcctgatcgactacgactccaccgtggtgtatccctttggctacggcctgtcctacaccacctttgagcagaccatgagcgacatcaccgtggacggtgataccctcagcttcgacgtgaccgtcaccaacaccggcagcgtggccggcaagaacgtggtggaggtcttctacaacccgccctacaccaacggcggcatccagaaagccaccgccaacctggtggccttcgacaagaccgacatcctggagcccggcgcttcccagactctgaccatcagcttcaaggctgaggagatggcttcctacgacacctacggcgaggctgcctacgtgctggaggccggcgactacatcatcagcatcaactccgactcccacaccgtgctggacagccgcgtgtacaacgtacccgagaccatcgtctacgatgagggccgttccaacgacctgaccgctcccaccaaccagttcgagaacgtggagggcgacgttacctacctgtcccgtgccgaccacttcgccaactacgccgaggccactgccgctcccgccagcatgtccatgagcgaggagcacaaggccaccttcctgaacaactccaactacgaccccaacaactacaacaacgccgacgacgtgatgcccaccaccggcgcccagaacaacatccaactggtccagatgcggggccttgattatgacgacccccagtgggacaccttcctggaccagctcaccgtctctgagatgagcgagctgatcgccatgggcggctatcagaccgctcccatcaacagcatcggcaaggtgcagacctacgactgcgacggccctgcctccatcaacaacaacttcacccagcagggctccatcggctttgccggcaccgtgatgatggcttccacctggaacaccgacaccgtttacaagttcggcgcttccatcggccgcatggccgacgacctggatgtgtccggctggtacgctcctgccatgaacatccaccgctccgcgttcagcggccgtaacttcgagtactactccgaggacggcgtgctcagcggcaagctggccgcccaggccgtgcagggcgccgagagccacggcgtgtactcctacatcaagcactacgctctgaacgaccaggagaccaaccgcaacaccatgctctgcacctgggcgagcgagcagtccatccgcgagatctacctcaagccctttgagctggccgtgaaggaaggcggcgccgacgcggtgatgtcctccttcaactatatcggcaccgagtgggccggcgcttccaacgccctgtgcaacaccgtcctgcgggacgagtggggcttcgtgggcatggtcctgaccgactacttcggcgtctacggctac

SEQ ID NO: 1026 - DNA, 1482 bp, Unknown
  Artificiall/Consensus sequence
atgcggatcggatttgacaacaagctttacattcaaaaacagaccgagaacatcctggcccggatcgacaagttcaagggcaagctgtatctggagttcggtggcaagctcttcgacgactaccacgccgcccgggtgctgcccggctttgacgtgaacggcaaaattcgccttttgcacgagctgcgggacaaggccgaaattatcttctgtgtctccgccggcgacatcgaaaagaccaagatgcgcgcggacctgggcatcagctacgacatggaggtgctgcgcctcatcgacgacatcaccgccatggacatcgcggtgaacagcgtggtcatcacccagtacaccggccagcccgccgctgacgcctttgccaaaaagctcaccagccggggcgtgaagaactacatccaccggcccatcgccggctaccccatggcggtggaccacatctgctccgacgagggctacggctccaacccctacatcgagaccaccaagcccctggtggtgctcaccgcccccggccccggcagcggcaagctggccaccgccctgtcccaggtgtaccacgagtacaagcggggcgtgatggcgggctacgccaagtttgagaccttccccatctggaacctgcccctgaagcacccggtgaacctggcctacgaggcggccaccgccgatttggacgacgtgaatatgatcgaccccttccacctggaggcttacggcgagaccaccgtgaactacaaccgggatgtggaggccttccccatcgtgcagaacatcctggcccgcatcaccggcgacaagaacttctaccgcagccccaccgacatgggcgtgaacatggcgggctacgccatctttgacgacgaggcggtgcgcgaggcggccacccaggagatcctgcgccgctactacaaggccgcctgcgacgcgaagcagggcaaggccagcgaggcctccctgcacaagatcgagaacatcctgcagcagctgaacgtgcacaccgacagccgggccgtggtggctccggcgctggaaaagcagaaggcggcgggcaagcccgcggcggccctgcagctgccggacggccgcatcatcaccggcaaggccagcgacctgatgagcgcctccagcgccaccgtgctgaacagcatcaaggtcctggcgggcatccccgacgaggtgctgctcatcagccagcaggtgctggtgcccctgctgcggctgaaaatcgactatctccacagccgtgccagcgttttgaaggtggacgacgtgctggcgggccttgcggtgagcgccgccaccgacgagaccgccgccaaggccctggccgccctcaaggacctgcgggactgcgacatgcactccacccagatgctgcacagcggcgacgagggcaccctgcgcaagctgggcgtgcggctgaccatggagcctgtctaccccggcaaggacctgttcttctaa

SEQ ID NO: 1027 - DNA, 2295 bp, Unknown
  Artificiall/Consensus sequence
atgaagaagaaaaaattgatctgcgtggtcatcgcgctcgtcatactgctcggcggcgtggtcatgggctatctcggcctgcgcgggcagggcgaatacaaccacgtttcggagatgctgggcaccggcaagcccgagaccatcaactacatccaggatcccgccctgctcacctccatctcctacgagcaggaccccgaggcgctgcgcgcctttatggtgggcgatctggggcttgacgaggcgagcgtggacgccgccatcgaggcccgccaggtctacgccgagaagcaggccgagtcccaggcgttcgacaccttctccgcctacctcaaggagcaggaccccaccctcaccgacgagggcgtgcaggacctgattaaggaccgcgagacctccgacccgatgcgcgcggagatgctcaagcagtccgtgatgaccgagctgggcatcgacgaggccgcctatgaggcgctcgcctccgacaccgccatcctcgatctgatgcgcgaaggtctgcccaacctgatgatcggcgaccgcgagaagttcgacgccatcaccgccgcctgcggctggaccaccgccgacaccatgcgcgccatctgcctgcccgacgaagtgaccgcgcttcccgaggcgctcaccgccgacggcgcgctgcgcagcctgctggtggacgtgcttggcaaggacggcggcaccgtggatagcgagcttgccgaccgcgagacctataaggccgccgcggagaccgccgccgccaccgccgccgccatcgaccttgcgccgctgacttccgccttcacggccgtacagaacggcgccgttcccggcgtgacgctggaagagggcgaggagaccgccgaggcggacctgatcgcctacgtggccgagaccctcggcgtggaagcgggcagcgcctccaccgcgcgcgagctgctcatcagccatctctccaccctgctgggcgtggatgtgaccgacgccgcctatgacgtcatcgccagggacggcaagctcgacgccgccgatttggagaaggccatcgtcaccgcctccaccggcttcagccccgagcgctacgatgtcctcaaggcggacccggacggcctccagctggcgcttgacagcatggacggcatgaaggccaacaacctgttcaacaatgccatcacctacctgttcatcggcatcgtgctgatcatcttcggcggcgcgtggctgttcatcctctcgctggaccgctcgcgcagcaagggcgtcaagaagcccatgagcgccagccagcgccgcacggtggacttcctgctcaactacgcgctgtacatcatcctgctgatgatcctcgtgatcgtctgcatcatccgcccgaccttcctggacatcaccaacgtgctgaacatcgtcaagcaggcctccaccaagggcattctggcgctgggctgcgcgggcctgatcgtcctggccggtacggacctgtccatcggccgcgtgcttggcctgtcggcggcggtcacggcctccatcgtgcagtcctcgcagtatgcctcccgtatgttcccgcagatcaccaccccggtgatgctgttcgtgccgctgctggcctccatcgccgtggcctgcctgttcaccttcatcaacggcttcggcgtttccaagctgcacctgcacgccttcatcgtcactctgggcacgcagctgatcgcgcagggcgcgacctgtatctacatcgagtcccagccctcgggcacggcgcaggccctctccacctttgacaaccagttcctcgacgtggctgccggcaacctcaccatcggcaccatccgcatcccgctggtcgtgatctacttcctggccatcgcggtgatcatgtggttcgtctggaacaagacccgcctcggcaagaacatgttcgccgtcggcggcaacgaagaagctgctgcggtctccggcgtcaacgtggccaagaccatcatgctggtctacctcatcgccggcgtcctctacggcatctccgccttcctcgaggctgcccgtatcacctcggtcggcgccaacaccggtctgaactatgagacggacgccatctccgcctgcgtggtcggcggcgtgtccttctccggcggcgtcggcaccatccagggcgtcgtcatcggcgcggtcgtgctgcaggccatcaactacagcttgcagttcctcggcgtcaacccctacctgcagtacatcatccgcggtctgatcatcatcctcgccgtctccatcgacgtgcgcaagtacctggtgaagaagtaa

SEQ ID NO: 1028 - DNA, 1071 bp, Unknown
  Artificiall/Consensus sequence
atgcaggacattcgctttgaacaggcgacttccttcaagcagaagccgcaggatgagagcaagatgggctttggcaagctctttaccgactacatgtttgaaatggactacaccgtggaaaagggctggcacgatccccgcgtggtgccgtaccacaacttctccatggatccggccacgtccgttttgcactacggccaggagatcttcgagggcatgaagtgctatcgccgcaaggacggcggtctgcagctcttccgcccccgcgacaatttcaggcgcatgaaccgctctgccgagcgcatggccattccccagttcgatgaagatgtggccatggccggccttgaaaagctcctcgaggtggagaaggactgggtgccgcacacccagggcgcgacgctctacatccgccccaccatcatcgccatggacgccatgctcggcgtgcacgcggcgcacacctacaagttctacatcatcctctcgccctcgggcgcgtactacgccggcggcctcgccccggtggacatctacgtggaggacaagtacgtccgcgccgtgcgcggcggcatcggctttgccaagaccggcggcaactacgcggcctccatccgcgccggcgagatcgctgaggaaaagggctacacgcaggtgctgtggctggacggcgtggagcagaagtacgtcgaggaagtcggcgccatgaacatgatgttcgtcatcgacggcaagatcgtcaccccgatgctcaacggctccatcctccccggcatcacccgcgattccatcctcaagctggccaagcacctcggctatgagaccgaggagcgccgcatcgccattcaggaggtcttcgacgccgcccacgccggccgcctcaacgaggcctttggcaccggcaccgccgccgtggtctccccggtgggcgcgctgtgctggaacggcgagaagctcatcatcaacaacggcgagatcggccccatcgcccagaagctctacgataccctcaccggcatccagtatggcgaactgcaggacgatttcggctgggtcatgaagctgaactga

SEQ ID NO: 1029 - DNA, 828 bp, Unknown
  Artificiall/Consensus sequence
gtgtccgagggcgcgatcatcaccgtgggcgcggtctccggcctgaacgtgggcgcggaaaaggcgtgggatatgtgcgacaagacccacacctcgcgcatgatcgtcatcaaccagatggaccgcgagaacgccaacttcagccgcgcgcttgccaccatcaccgacaagtacggcagccacatcgcgcccattgaggtgccgatcgtggagggcggcaagttcaccggcgttgtctgcgttctggagaacaaggcctacaccggcgagggcaagaccctcaaggagatcgacattcccgccaatatggccggcgacgtcgagagcgcccgcgaagccatcatggaagccgcggccggcgccgaggacgaactgatggaaaagtacttcgaggaaggcgagctttcccaggaagagatcatgcacggcctgcgtcagggcatcaaggacggcacggtggtgccggtggtgtgctgctcttcgctgacgcgcgtgggccttgccaagctgctggacaacctcatcgacctcatgccctccccggcgggctccacgctcgagggcgtcaaccccaagagcggcgataccgaggagcgcgtctgcgccgacgatcagcccttctccgcccgcgtgttcaagacgctggccgacccgttcgtgggcaagctgtcgcttctcaaggtcacttccggcacgctcacgtccggcacgccgctttacaacgccaacgcggaaaaggccgagaaggccggcaacatctacttcctgcgcggcggcaagcagaatccggcgcagaaggtgtgcgcgggcgacatctgcgccatctcc

SEQ ID NO: 1030 - DNA, 1344 bp, Unknown
  Artificiall/Consensus sequence
atggcattcgagggcttgaccgataaactgcaaaatgcgttcaaaaagctgtccggcaagggcaagctcagcgaggcggacgtcaaagccgcgatgcgcgaagtgcgcatggcgcttctggaagccgacgtcaacttcaccgttgtcaaggatttcatcaaaaaggtcaccgagcgcgccgtggggcaggagatactgggcagcctcacgcccggccagcaggtcgtcaagatcgtaaacgacgaactgacccagctgatgggcggcaccaacgccaagttgacctattccccccagccgccgaccatctacatgctctgcggtttgcagggcgcgggcaagaccaccatggccgccaagctcggcaacctcatcaaaaagggcggcaaaaagcccctgctcgtcgcctgcgacgtctaccgccccgcggccatcaagcagctgcaggtcgtcggcggacaggtgggcgtggaggtctttgaaaagggccagggcgacccggtgcagatcgccaaagaggccgtggaatacgcgcgctactatggccgcgacccggtcatcatcgacaccgccggccgtttgcacatcgaccagaagctcatggaggagctgcgcgagatccgcgccacggtcaagccgaaggagatcctcctcgtcgtcgacgccatgaccggtcaggacgccgtcaccgtcgccgacaccttcaacaaggaactgggcgtggatggcgtcatcctcaccaagctcgacggcgacacccgcggcggcgcggccatctccgtgcgcgcggtcacgggcaagcccatcaagttcgccggcgtcggcgaaaagctcaccgacatcgagcctttccacccggaccgcatggcctcgcgcatcctcggcatgggcgatgtgctgagcctcatcgaaaaggcgcaggagaatttcgaggaggaaaaggccgtggacatggtgcgcaagatgcgcaccaacagcttcaccctcgaggattacctcgatcaaattcgccagatcaccaagatgggcagcgtctccagcatgctgaagatgatccccggcctggccagcaagatcaaggaatccgacatcgacgaggaaaagatgatgaaggcccagaagaaaaacgaggccatcatcctttccatgacgcgcatggagcgccgcaacccggatatactcaacgcctcccgcaagcgccgcgtggccgccggcagcggcgccaccgtgcaggacgtcaacctgctgctcaagcagttcgaccaggcgcggcagatgatgaagcagatgatgggcggcggcaaaaagcgcctgcgcataccgtttggcaagttcaggggataa

SEQ ID NO: 1031 - DNA, 1449 bp, Unknown
  Artificiall/Consensus sequence
atgctggaaaaaatagtcattctcgatttcggcggccagtacaaccagctcatcgcccgccgcgtgcgcgaagccggcgtctactgcgagatcatgcactacgccacgcccatggagacgtgggcaggcgatgacctgcgcggcgtcattctcactggcggccccaacagcgtctacgaagagggcgcgccgcgcctgggcaaggagctgttttccctcggcgtgccggtgctgggtatctgctacggcatgcagctgatcaactacatcctcggcggcacggtcgaacacgccgacgccggcgagtacggccataccgatctgaccgtgcgcggcggcaggctttttgcggccgtctcccccgagaccgtggtcttcatgaaccacaccgaccgcgtggcgcaaatgcccgagggcttccagtgcgacgccagcaccgaccattgccccgtggccgccttctcctgcccggaaaagggcatctacggcgtgcagttccaccccgaggtgcgccacaccgtggaggggacgaccattctgcgcaacttcgtgcttggcgtctgcggctgcaagggcgattaccgcgccgaggacatgatcgagggcatgctgcgcgatatccgcgcgcaggtgggggagggcaaggtcgtggccggcctctccggcggcgtcgattcctccgtggcctgcgcgctggcggaaagggcgctttccaagggccagctcacctgcgtgttcgtcgatcacggcctgttgcgcctcaacgaggccgagagcgtgcttgatacctaccgcgacgtcatgggcctcaacgtcgtctacgtggacgcctccgagcgcttcctcgccgcgctttccggcatcaccgacccggagaaaaagcgcaagatcatcggcgaactctttgtgcgcgtctttgaggaagaggcgaaaaagaccggcgcgcagttcctcttgcagggcaccatctacccggaccgcatcgagagcggcatgggcggctcggccaccatcaagagccaccacaacgtcggcggcctgcccaaagattcgctgttcaggaaggaaaacatcgtcgagccgctcaaatcgctgttcaaggatgaagtgcgcgccgtcggcgaagcgctgggcatcccgcgccgcatggtctggcggcagccgttccccggccccggcctcgccgtgcgcgtggtgggggagatcacccgcgaaaagctcgacatcctccgcaagagcgacgccatctatctggaggagctggaaaacgccggcctttccgaaagtatctggcagtccttcgccgtactcaccggctcgaagaccgtcggcgtgatgggcgatggccgcacctacgcctactgcgtcgccctgcgcgccgtgaccagcgacgacgccatgaccgtggaagccgccgaacttccctacccggtgctgaaaaaatgcgtc

SEQ ID NO: 1032 - DNA, 1635 bp, Unknown
  Artificiall/Consensus sequence
atggcgctgaccgccgtgttggcggtgctgctctttgccatactttccatggcgcttctgtacagcgttttcaccgcgcgcacggagcgcgagctggaccacgaggccaacatggtcgccgcggccatggagggcggggcggagctttccacgctcgccgccacccacccggacggccgcatgacccacatcgcccaggacggcagcgtgctttttgacagcgacgccgaggccggcgagatggagaaccatctggagcgcccggagatacagcaggcgcttgcaagcggcgtgggcagcagcacgcgccagtccgacacgctgggcgagatgaccatctaccgcgccatcaagttggacgacggcacggtgctgcgcgtttccggcacgcagaagaacgtgctgggcatggtgttgcagctcatcccggcgtttctggcgctgatcgtcgtgaccgtcatcctctcggcgctggcctcgcggcaggcgaccaagcgcatcgtcgccccggtgaacgccctcgacctcgaccatccgctggacaacgacgtctacgaggaactttccccgctgctcaagcgcatggacgaccagcgcaagcgcatcgacgagaccgtgtccgcgctcacggcgcagcgcaacgagttcgccgccgtcaccagcaacatggccgaggcgctggtgctgctcaacgcgcgtggcgaggtattgtccgtcaaccgcgcggcggaaaagctgctgggcctgccccgctccgtctgcgagggcaagtatctgctggcgctcaaccgcaatttccagctctccgaggccatggaagccgccctgcgcggcgaaaacgccgaacaggagatggagatgaacggccgccactaccgctgcgtggccagccccgtcaaggacgaggggcgcgtcagcggcgcggtgatgctcattcccgacgtcaccgaccgcttcctcgccgaaaaggcgcgccgcgagttcaccgccaacgtctcccacgagctgaaaacgccgctcacctccatcctcggctatgctgagatcatgcaaaacggcgtcgccggcgaggacaaattgcgccagttcgccggcctcatccacgccgaggctacgcggctgattcaactggtggaggacattctgaagctctcccgcctcgatgaaaaccgcctgcccgccgaccgccgccgcgtgtcgctcaagggcctttgcgaggaggccgcttcgcgcctcgcgccggaggcggagaagcgcggcgtatccatcaaggtggagggcggcgagtgcgccatggatggctcgccctcgatgttgggcgaactggtctacaacctcctggacaacgccgtcaagtacaaccgtgaaaacggctccgtcgtcgccctgctggaagaaaacgccgacggcagccgcagcctcaccgtttccgacaccggcgtgggcatcgaccccgccgaccaggagcatgtgttcgagcgcttcttccgcggcgaccgcagccgttccagcgagggcggcacgggtctgggcctctccatcgtcaagcacgcggcgctcgcgcacggggcgaaggtgtccctcagcagcaagggcggcaagggcaccagcatccgcgtggattttcccgcgtaa

SEQ ID NO: 1033 - DNA, 1173 bp, Unknown
  Artificiall/Consensus sequence
gaagcggcggaaaaggacttcgacaggcgcaacgaggagctttgccacaacacctcccgcgccaacggctacggcaatatgctcatgccggtgatggtgagcctgagcagcctgctctacgtactcatggccatcatcggcggctcgctggccatcgccggcgtgcccaacttcagcctcggcggcgcgggcgcgttcacgctgggcaccatcgcctcgttcatgcagctttcgcgcagcttcacccagcccatcaaccaggtctcccagcagctcaacagcgtggtcatggcgctggcgggcgcgggccgcatcttccagctcatggacgagcccagcgagagcgacgagggctacgtcaccctgcaaaagaacgcaaacggcgacggctgggagtggctgcatccccatcacgatggcaccgtcaccaccacgccgctcaggggcgaagtgcgcatgttcaacgtcgatttcgcctacgagcaggataaggaagtgctgcacgacatcaccctctacgccgaacccggccagaaagtggccttcgtcggcgccaccggcgcgggcaagaccaccatcaccaacctcatcaaccgcttctacgacataaaagacggcaagatccgctacgacggcatcaatataggcaagatcaaaaaggccgacctgcgccattcgctgggcgtggtcttgcaggacgtcaacctcttcaccggcacggtgatggacaacatacgctacggcaagctggacgccaccgacgaggagtgcatcgccgccgccaaactggccaacgccgacagcttcatccgccgcctgcccaacggctaccagaccatgctcgaaggcgacggcggcgggctttcgcagggccagcggcagctgatctccatcgcccgcgccgccgtggccgacccgccggtgatgatcctcgacgaggccacttcctccatcgacacccgcaccgaggcattggtgcaaaagggcatggacgcgctgatgaagggccgcaccgtgttcgtcatcgcccaccgcctctccaccgtgcagaactcggacgtcatcatggtgctggaccatggccgcatcatcgagcgcggcacccacgaacaattgctcgaggaaaagggaacctattacaaactctacaccggcgctttcgagctttcgtaa

SEQ ID NO: 1034 - DNA, 1032 bp, Unknown
  Artificiall/Consensus sequence
gtgtttattttggaacagcagcttcaaacgatccgggagaaggcgcttgcgcagctggcggaggcgcaggacaccgccgcattggagcagttgcgcgtcagcgtgcttggcaaaaagggcgaactgaccggcatactgcgcggcatgggcaagctgcccgccgaggagcggccgaagatgggccagatggtcaacgagacccgcgccgccatcgaggaggcgctggaggcgcgcgcggccgtgctgcgcgaaaaggaaaaggaagagcgcttgaagcgcgaggccatcgacgtgaccatgccggtgcggccccgttccgccggcgcgcccaaccccctgtacaccgtgcaggacgaattggtggagatcttcgtgggcatgggctatgaggtggtcgaagggccggaggtcgagtacgaccactacaactttgagctgctcaacctgcccaagaaccatcccgcccgcgacgcgcaggacaccttctacatcgacgacaacatcgtcttgcgcacgcacacctcgcccgtgcaggcgcgcatcatgaccacgcgcaagccgcccatccgcatcgtctgccccggccgcgtctaccgcgccgacgaggccgacgccacccattcgccggtgttccaccagatggagggcctggtcatcgacgaaggcgtgaccatgggcgacctcaagggcacgctggacgcctttgccgcgcgcctgttcggcgagggcgtgaccacgcgcttccgcccctcgttcttcccgttcacggagccgtccgcggaggtcgatctcacctgcgccagctgccacggcaagggctgccgcatgtgcaagggcacgggctggatcgaggtgcttggcgcgggcatggtcaaccccagggtgctcgacatgtgcggcatcgactcgaagcgatacaccggcttcgccttcggaatgggccttgagcgcatcgcgctgctcaagtacaacattcccaacctgcggctgatgtacgaaaacgacctgcgcttcctggcgcagttccgctaa

SEQ ID NO: 1035 - DNA, 675 bp, Unknown
  Artificiall/Consensus sequence
tccatcggccgcatggtgccgccgctgacggcggaggagaaggccaaggacagcctgctcatctgcgtggagccgtactgccagctgccggtggacaaggccgccttcaagggcgagatccccgatctggtgggcctggtcccctacacgcccttcggcttctacatcaagcgcaagctctttttgcacaacatgggccacgccatggtcgcctacttcgcctatcagcagggcatcgagtacatctggcaggccgtggaacacaaggaggtctacgatctcgcccgcaaagccatgaagggcagcggcgaggcgctgatccgcgaatacggcgaggagatgcgcgcaaacgtcgaggaaaacatcgacgatctgctcttccgcttcggcaacaaggcgctcaaggacaccgtggcccgcgtcggcggcgacctggtgcgcaagctgcgccgcaacgaccggctggtgggcgcggcgctgtactgtatcgagcagggcgtcgatcccgagcccatcgtcgagggcatccgcgcggcgctgaagttcgaccgcgccgaggatgtctccgcgccggaactgcaaaaggcgctcaaagaacagggcatcgactacgtgctggagcattacatgggccttgagccggacgagccgctgttcaagatgatcaagggctaa

SEQ ID NO: 1036 - DNA, 1962 bp, Unknown
  Artificiall/Consensus sequence
atggcaaagacctattccgccaccgacatacaggtactcgagggcctcgacgcggtgcgcatgcgcccgggcatgtacatcggctccaccggcgcgcgcgggctgcatcacctcatctgggagatcgtcgataacgccatcgacgaggcttccaacggcttcgccaccgagatcaccgtgacgctgaaaaaggacggctcctgcgaggtgacggacaacggccgcggcatccccgtggacatccacccgcaacttggcgtctccggcgtggaggtcgtctacacgcagctgcacgccggcggcaagttcaacaacaagaactatgcctattccggcggcctgcacggcgtgggcgcgtctgtggtcaacgccctctccgagtgggtgacggtggacgtgtaccgcgattacagccactaccacatccgcttcgagtcctatgaggacagaaagaccggcaagatcgtctccggacacgccgtcgcgcctctggaaaaggtgggcaacacccgcaagcgcggcacgcaggtctgcttcaagcccgacccgcgcgtgttcgaggacacccacttcaacggcgataccgtgcgccgccgcgtgcgcgaattggcctacctcaatcagggcgtgcgcttcgtctttaccgacgagcgggaaaaggacgagacgcgccgccgccgcgaatactgctacgagggaggcctggccgactttgtgcagtacctcaacacggacaagcagaccatcaccggccccatcaccttcgagggccggcgcgagggcacgcttctgcgcgtggccatccagtatacggattcctacacggaaaacatctattcctttgtcaacaatgtgcccaccggcgagggcggcacgcacgagacgggcttcaaggccgccgtcaccaaggcgttcaacgactacgcccgccgcgtgggcctgctcaaggagaaggacaacaacctctccggcgaggacttccgcgagggcatgaccgccgtggtctacgccggcgtgcaaaagccgcagttcgagggccagaccaagggccggctgggcaacacggaagtccgccccatcgtcgaggccatttgcctggaacagctctcgctgtacctggacgacctcaaaaatcaggaagtcgccacccgcatcgtcgaaaaggcggtcaaggccgccaaggtgcgcgaggcggcgcgcaaggcgcgcgacgtggcgcggcagaaaaaccagctcgaggccgcgccgctggtgggcaagctctccagctgcaccggccgcaactggaaggagaacgaactgttcatcgtcgagggcgattccgccggcggcagcgccaagcagggccgcgaccggcgctttcaggccattctgcccctgcgcggcaagcccctcaacgccgagaaaaagcgcatcgaccaggtgctggccaacgaggagttccgctccatcatcaccgcgctgggcacgggcatcggcgaggagtttgacttatcgcacctcaagtacaaccgcgtcattatcctttcagacgccgatcaggacggcgcgcacatccgcgccattttgctgaccttcttcttccgctacatgcgtgaactggtcaccgacggccatgtctacatcggcatgccgccgctctactgcgcgaagaagggcgcggagcacatctactgcttcgacgaaaaggaactggcgaaagccacgaagaaactcggccgcggttacagcgtgcagcgctacaagggccttggcgaaatgaatccggaacagctctgggagacgaccatgaaccccaacggccgtaagatggtgcaggtcaccatcgaagacctcgccgaggccgagcgccgtgtcaccgtgctgatgggcgacaaggtggagccgcgccgcgagtacattcaggaatacgccaatttcaaccacgtggacgactttgaacccgttcgggaaggggagtaa

SEQ ID NO: 1037 - DNA, 1062 bp, Unknown
  Artificiall/Consensus sequence
gccggcgtcatcatcggcatcacttcggacttctttaccggcgatgacaaaaagcccgtggccaaggtggccgagtcctgccagaacggcccggctttcaccatcctcaacggcttcagctacggcctgctctcctgcctgccggcgctgctgggcatcggcctcaccgccctgatctcctacaagctgggcgagtccatcggcccggaatatgcgatgatgggcatctccaccgccgccatcggcatgctctccatcatcggcatgattatctccaacgacgcctatggcccgatcgttgacaacgcccgcggcgttgccgaaatggccggcctcggcgacgaagtgctggagatcaccgacgaactggacgccgccggcaacaccgccaaggccatcaccaagggcttctccatcggcgctgcgggcctgacggtcatctcgctgctcggcgcgttcctcgagcttgtcgagggcgcgggcgcgacggtcgtgttcgacgtgatgaaccccatggtcttcttcggcatcctcgtgggcgcggcgatccccgccgtgttctccgccatgctgatgaacggcgtcaaccgcaactcccaggtcatggtcaaggagatccatcgccagttcaactccatccccggcctgcgcgagggtacgtccaagcctgactacgccaagtgcatcgacatctccacccgcggcgccatccgcgagctgatccccgccggcctgttcaccatcctcatgacgctggtggtcggcttcatcggcggcccggaggccatcggcggcttcctcgtcggcaacatcgtcaccggcctgttgatggcgctgctgatgtccaacgccggcggcctgtgggacaacgccaagaagttcgtcgagtccggcaacttcggcggcaagggctccgacgcgcacaaggcggccgtcatcggcgataccgtcggcgatcccttcaaggataccgcgggcccgtccatcaacacccagatcaccgtggtctcgctcgtcagctcgctggccgcgacgctgttcgtgaagttccacctgttctaa

SEQ ID NO: 1038 - DNA, 1107 bp, Unknown
  Artificiall/Consensus sequence
atggactggctggactggctgcttgtaaacattctggacatcgagtggcagatggcggtcatgtgggtgatcggcggcgcgctgatctactgcgccatcaaaaaggaaatggagccgacgctgctcctgcccatgggtctgggcgcgatcctcgtgaacctgcccatgaagggcgcgctcaaggagctgcagatcctctacgacgcgggcatcgttaccgagcttttcccgctgttgctcttcatcggcatcggcgcgatgatcgactttggcccgctgctttccaaccccaagatgatcctctgcggcgcggcggcccagttcggcatcttcttcaccctgtcgcttgcgcgcctgctgggctttactttgcaggacgcggcctccatcgccatcatcggcgcggcggacggcccgacctccattttcgtggcgcagcactttggcacgcagtacatcggcgccatcatcgtggcggcctattcctacatggcgctggtgcccatggtgcagccgccctgcatccgcctggtcaccaccaagaaagagcgcatgatgaagatggaatacaaccccgccaacatctcgcgcaccacgcgcatcctcttccccatcttcgtcaccttcatcgccggcatcgccgcccccaagagcgtggcgctggtcggtttcctgatgttcggcaacctcctgcgcgagtgcctggtgcttgattcgctctccgagacggcgcagaaggtgctggccaacctcatctcgctgctgctgggcctgtccgtggccccagtgatggtgtggtcgaagttcctcaacatcaacaccatcgtcatccttgccctgggcctggtggccttctgcttcgacaccattggcggcgtgttcttcgtcaagttcctcaacctcttcctcaagaagaagatcaaccccatggtcggcgcggcgggcatctccgccttcccgatgtcctcccgcgtggtgcataagatgggcctcaaggaagacccgcagaacttcctgctcatgcacgcggcgggcgccaacgtggccgggcagatcgcctcggtcatcgccggcggcatgatcatttccctcatccccacgctttaa

SEQ ID NO: 1039 - DNA, 681 bp, Unknown
  Artificiall/Consensus sequence
atggactggcagttttcccggcgcgcgctgcgctttcagcccaacatcttcaacgtcctcaaagacctgaaaggggagcggcttgcgcgcggcgaatgggtgtgcgacctctccgtgggcacgccggactttcccgtggccgaacatatccgcgcggcggccgcgcaggcggcgctcgacccggagaattacaagtactcgctgggcgatctgcccgaacttacgcaggcggtgcagcgctggtacgcgcggcgctacggcgtcacgctggcggaaaatgaagtgatgagcgtgtacggctcgcaggagggcatcgcccacatcgccatgacgctgtgcgaccccggcgacatcgtgcttgtgcccgacccctgctaccccatcttcgccatcggcccctcgctgtgcggcgcggaggtggcctattacccgctggacgaaaaaagcggctatctgcccgaccttgccgccatcgacgaggaaattgcgcgccgggcgaagatgatgatcgtctccttccccgccaatcccgtgggcgcggtggctccacgcgccttttatgacgatctggtggccttcgcgcgcaaatacggcatttgcgtcgtccacgacaacgcctattcggagatcgtctttgacggcaacgagggcatatcgtttttgagcgtgcctggggccatg

SEQ ID NO: 1040 - DNA, 1572 bp, Unknown
  Artificiall/Consensus sequence
ggcggggcgtacatccttctgcgcgtcatcgacgcggcctccaactactacatgcagtccatcggccacgtcatgggttcgcgcatcgagacggatatgcgcagggacatgttcgcccatctggagcgcctgtccaattcctattatgacaacaccaagatcggccagatcatgtcgcgcatcaccaccgacctgtttgacgtgacggagtttgcccaccacacgccggaggaggtgttcatcacctcgttgaaagtggtggtggcgtttgtcatccttctgaccatcaacgtgcccttaacgctgatcatcttcgccatctttcccttcatgatctacttctccatccgcttttcccggcgcatgcgctccacctacaaggagtcccgccaccagttgggcgaactcaacgcgcaggtggaggacacgctctccggcatccgcgtggtcaagtcctttgccaacgaggagttggaaaaggagaagttcgccgagggcaaccgcggctttctgcgcatcaagcgcatgatgtaccacaacatggcgggcttccactcggtgacgcggctgtttgacgggctgatgttcatcgtcgtggtgcttttgggcgcgctgttcctcatccgcggcgagggcggcatcaccgccgcggactacatcgcctacatactgttcgtgcagacgctgctgacctccatccgccgtctggtcgaattttccgagcagttcatgcgcggcctgaccggcatcgagcgcttcatcgaggtgatggaagtgccggtggagatcgacgacgcgccgggcgctgtggacgttgcaaacgtcaagggcgacatcaccttcgaccacgtcagcttcacctacgaggaaggccacgagaacgtgcttacggacatcaacctgcacgtgcccgccggcgagagcgtggcgctggtcgggccttccggcagcggcaaaagcacgctgtgcagcctcatcccccgcttttacgaggtcacgtccgggcgcatcctcctcgacggcgaggacgtgcgcaagtacacgctgcactcgctgcgcgggcatatcggcgtggtgcagcaggacgtgcatctcttctccggctcggtgatcgacaacatccgctacggccgccccactgccacggacgcggaggtggtcgaggcggcaaagcgcgccggggcgcatgagttcatcatggggctggaaaacggctataacacctacgtcggcgagcatggtttcaagctctccggcgggcagaagcagcgcatctccatcgcccgcgtgtttttgaaggatccgccggtgctgatcctcgacgaggccaccagcgcgctggacaacgagagcgagcgcatcgtgcagaagtctctggaagaactgatgcgcgggcgcaccaccttcaccatcgcccaccgcctgactaccgtccgcaacgcgcaggtcatcctcgtgcttacggaaaagggcatcgtcgagcagggcagccacgcggaactgatggcgcggcgcggcgtgtattacgatttgtacaagctctataccgacgaggaggaagaggacggatga

SEQ ID NO: 1041 - DNA, 1872 bp, Unknown
  Artificiall/Consensus sequence
cgccgcggcgtggatgcgagcaccatctgcaaccacacgcagatcgacatgctcttcctcgactgcgtgaaaaaggtggtcgattacgagcgcgtgcttgccgcccatcccggcgaccgcgattgccttgtcaaggccaagcgcatgggctttgccgacaggtatatcgccaaactgtggaacacggatgaagacgccatcttcaatttgcgccgggggatgaagctcttccccgtctacaagaccatcgacacctgcgccggcgagttccccggctacgtgccgtacttctactccacgtacgaggaagaaaacgagtccatcgtcgaggaccgccgcaaggtgatcgtgctgggcagcggccccatccgcatcggccagggcgtggagttcgactattccaccgtccacgccgtcaagaccatcaaggaaagcggctacgaggccatcatcatcaacaacaacccggagaccgtctccacggactacaccaccagcgacaagctctactttgaaccgctcacgcccgaggacgtgatgaacgtcatcgaactggaaaaaccggaaggcgtcatcgcctcgctgggcggccagacggccatcaacctcgccgagcccctgatgaagcgcggcgtgcgcatcatcggcacggactttgaggccatcgaaaaggccgagaaccgcgacgcctttgaaaaggtgatgcagtccctcggcatcccccagccgcgcggcgaggccgtgaccgacatcgaggaaggcgtgcgcgtggccgcgcagatcggctacccggtgctggtgcgccccagctacgtgctgggcgggcgcgccatgcagatcgtctccggcgaggagatgctgcgcgcctacctgaaaaacgccgtggagatcaacgaaaagcagccggtgctggtcgataagtacatcgtcggccgcgaactggaagtggacgccgtctgcgacggcagggaagtgttcgtgcccggcatcatggaactggtcgagcgcacgggcatccactccggcgactccatcagcgtctatcccaccttctcggtgagcgaccgagccaaggagaccatcctcgaatacacccgccgcctggggcttgccatcggcatcgtcggcctttacaacatacagttcatcgtcgacgcgcaggagaacgtctacgtcatcgaggtcaacccccgctcctcgcgcacggtgccgttcctctccaaggccagcggctggcagcttgccgacatcgccacgcgctgcatcctcggaaagagcctcaaggagcagggcatcacctgcctctacccgccggagaagaagcgctggtacgtgaaggtgcccgccttctcgttcaccaaattggccgggctggacgcctacctctccccggagatgaagtccaccggcgaggccatcggctacgacgacagcatgacccgcgccctctacaaggccctgcaggcttcgggcatggcggtgatgaactacggcaccatcctcgtctccctcgccgaccgcgacaaggaagaggcgctgccgctcgtccgccgcttctacaacctcggcttcaacatcgaggccaccagcggcaccgcggcgttcttgaagagccacggcatccgcacgcgcgtgaaaaagaagatcagcgacggcagcgaggaaattctcgattccatccgtcagggctacgtcagctacgtcatcaacacgcgcgacatgaactcgctcgatcagctatccgacggctacgagatccgccgctgcgccgtggaaaacaacgtgaccatgtttaccgcgctggacacggtgaaggtgctgctcgacgtgctggaagagacgaccctgaccatctccaccatcgacgcatag

SEQ ID NO: 1042 - DNA, 2061 bp, Unknown
  Artificiall/Consensus sequence
aagcgctttgacgccgacccgcaaaagggcctcaacgaggcgcagctggagcaggcgcgcgaaaagtacggcaaaaacgtgctgcgcgagcagaagaagccttcgcttctgatgcgcttcctcgcccagttcaaggacacgatgatcatcatactcatcatcgccgccatcatctccttcttcgtcgccgcgcagagcggagagacgcgggagttcctcgagccggcgctgattctggccatcgtcatcctcaacgccatcatgggcatgatgcaggagagcaaggcggaaaaggccatggaggcgctcaagagcatgtccgccccgcacgcgcgcgtgctgcgcaacggccgtgaggcggtcattgacgccagcgacttggtgcctggcgacgtgatcctcgtggaggcgggcgatttcgtgcccgcggacgcgcggctgatcgagtcggcgagcctcaagagcgaggaatcggcgctcaccggcgaatccgtgcccgtggaaaaggacgcgcaggccgccgtggccgagggcgcgccgctgggcgaccgcgtgaacatgctctattccggctgctccgtgacctacgggcgcggccgcgccatcgtcaccggcacgggcatggacacggagatgggccgcatcgccgggctgctcgaaagcgccgacgacacgcagacgccgctgcagcacaaactggcgcgcatgggcaagctgctgggtatcgtcgccctcgccgcctgcgcggtgatcttcatcatcggcctgctcaacaacatccccgtgttggagatcttcatgaccagcgtctcgctggcggtctccgccattcccgagggcctgcccgccatcgtcacggtggtgctttccatcggcatacagcgcatggcgaagaaaaacgccatcatccgccgcctgcccgctgtggaaacgctgggcagcgcctccatcatctgctcggacaagaccggcacgctgacgcagaaccgcatgaccctcacccgcgcctacgccgtggacggccggcgcacggaggagatcagcgccaactgctcggacgcggtgcgccgcctgctctccatggccacgctctgctgcgatggcagcatcgagatggagaacggcaaggaaaagcacatcggcgaccccacggagacggccatcgtcgccgccgcggcgaaaaacggcatcaccaaggcggcgctcaaccgcaagtatccccgcctggccgagatcccctttgactccgaccgcaaactgatgaccaccgtgcataagatcgacggcgagtatgtcgccatcgtcaagggcgcgttcgacgtcatcgaagatcgctgtgtcaagggcggctgcccggaggaggccgaggacatcgtcaatgacatgagccagcaggcgctgcgcgtgctggccgtggctacgaaaaagctcgaccatctgccggagaaccccacctccgaggaactggaaaacggcctgacgctcatcggtctggtgggcatgatcgacccgccgcgccccgaagtgcgcgaggcggtgaagatctgccgcaaggccggcatcaccccggtgatgatcaccggcgaccatgtggtcaccgccgccgccatcgcccgcgagctgggcatcctcgtggagggcaacgaggcgatgaccggcgcggagctggccagcctttctgatgaagaactggccgcgcgcgtgcgcaacatctccgtctacgcccgcgtgtcgcccgaggataagatacgcatcgtgcgcgcctggcagagccagggcgagatcgtttccatgaccggcgacggcgtcaacgacgcgcccgcgctcaaggccgccgacatcggctgcgccatgggcatcaccggcacggacgttgccaagggcgcggcggacatgacgctgaccgacgacaacttcaccaccatcgtcgacgccgtgcgcgagggccgcggcatctacgacaacatcaagaaggtcgtgggcttcctgctgggcacgaacatcggcgagatcctctgcgtgttcttcgccatgatcctctggcaccgcacgccgcttctt

SEQ ID NO: 1043 - DNA, 969 bp, Unknown
  Artificiall/Consensus sequence
gagcgtgtataccccatgtccaagcaactgtttgtcgacccgaatgtgatccgcaagcccggtcaggtcacctttgagcccatcccctgcaaccagtaccagaagaaggtcaaggacgagctgggcaacttcaccaaggaacagttcctcaacatttaccgcgatatgctggtcctgcgtgagtttgagaccatgatccagaccatcaagaccaccagcgaataccgcggcgtgtcctacacccatcccggcccggcccatctgggcatcggtcaggaggcggccgctgtcggcgaggccttccacctcgacgtcaacgacttcatcttcggctcccatcgcgcccactgcgacatcctcgccaagggcctgtccgccatcgaaaagctctccgatgacgaactgctcgacatcatgaagaacttcctcggcggcaagacgctctccgtggtggaaaagggcgaacacgccaccgtcaaggatctggccatcgacttcctgctctacggcgcgatgagcgagatcttcgcccgcgagaccggcttcaaccgcggcctgggcggctccatgcataccttcttcacgccctttggcatctaccccaacaacgccatcgtcggcggcagcggcaccatcgccatgggcgcggcgctctataagcgcgtcaaccgcaagggcggcatcgtcgtggccaacatcggcgacggcgcgctcggccgcggccccgtgctggaggccctgaacatgtccggcatgggccagctcaacaccctctgggaggagggcatgcgcggcggcctgccggtgctgttcaacatcttcaacaaccagtatggcatgggcggccagaccagcggcgagaccatggcctacgacatcctcgcgcgcatgggcgcgggcttcaaccccaaccagatgcacgccgagcgcgtcgacggcttcaacccgctggccgtcatcgaggcctat

SEQ ID NO: 1044 - DNA, 912 bp, Unknown
  Artificiall/Consensus sequence
atggctgagatcagcgcaaagatcgtaatggagctgcgcggccgtacgggcgcgggcatgatggattgcaagaaggctctcgccgccgtcgaaggcgatatggaaaaggccatcgactacctgcgcgagaagggcctggccgccgccgccaagaagcagagccgcatcgccgccgaaggccttgtgggcagcttcgtctgcaaggagtgcgccaccggcgccctcgtcgaagtcaactgcgagaccgacttcgtggccaagaccgacaagttcaaggccctcgttgccgacgtggccgagcaggtcgccaagaagaaccccgccgacgtggacgcgctgctcaagcagcccttcttcaaggacgaaaataccaccatcgagcagatggtcaccgccgccaccgccgagatcggcgagaagatctccatccgccgcttcgtgcgctacgagggcggcatcgtggaaagctacatccacatgggcggcaaggtcggcgtgctggtgcaggccgagggcacgcccaatgaggaagtcatccacgacgtagccctgcagatcgccgccgcgtccccggtcgctcccgagtacgtgcgccgcgaggaagtcgatccttcccacctcgagcatgagaaggagatcctcgtcgcccaggcccgcaacgagggcaagcccgagaagatcatcgagaagatggtcgaaggccgcatcgtcaagttctacaaggaggtctgcctcctcgagcaggcgttcgtcaaggacgcggacatcagcgtcggcaagatgatcgagcagaaggccaacggcctcaacatcgtccgcttcacccgctacaagatgggcgatggcctcgagaagaaggtcaacgacctggccgccgaggtcgccgagcagatcggctccatgcagaagtaa

SEQ ID NO: 1045 - DNA, 2091 bp, Unknown
  Artificiall/Consensus sequence
accgagctggccatttccgaatcgcaggagcgcatggccgtggtgctcgcacccgaagatgtggatgcgttcatggcgctggcgcacgaggaaaacctcgaagccacggtggtggccaaagtcaccgaggaaaagcggctggtgatgcgctggaacgggcgcgtcatcgtcgacgtctcccgcgagtttttgaattccaacggcgcgcccaagcaggcgacggcgctggtggaggcgcagaaggcgctttgggaagaagaaccggcgttcgcggacggcctgcgggcgatggcgggcgacctcaacatgtgttcccgccgcggcctatgcgagcgctttgactccacaaacggggcgatgagtctgctgatgcccttcggcggcaagcggcaactgaccccggcgcaggcgatggcctcgctgctgcccgtgcgcggcgccgagagccgaaccgcctcggtgatggcctacggctttgaccccttcgtaatggaaaagagcccctacgtgggcgcgtatctgtccgtggtctcgtccatggccaagctggtggcctgcggcgcgggctggcgcggggcgcacctgaccttccaggagtacttccagcgcatgaccggcgaggcggagaagtggggccggcccatggcggcgttgctcggcgcgctgatggcgcaactcgacctcgaggcggcggccatcggcggcaaggactccatgagcggttccttcgagcagatgcacgtgccgccgacgctggtctccttcgccgtggccgcctgccgcgcggagaacatcgtctccaacgagttcaagcgctccggcgcggacgtggggctgcttttacccgagtacggcgaagacggcctgcccgtggcagagagtctgcgcgcgctgttcgaccaggtgacggcgttaatccgcaggggcgagatcgtctccgcgcaggcgctgggcatgggcggcgcggctgaagccgtgttcaagatgggtctgggcaaccgcgtcggcttcgcctttgacgagggcgcgaaagacctgttcaagcgctgctacggcggcttcgtggtcgaatacgccgcgggcgcgaaggccgaacatcttctcggccggacgacggaggactacgcgctgacttatcgcggcgagcgcgtggactgcgagggactggaaagcatctacgacgcgaagctggaggatgtgttccccgtgcgcgccgcgcagggcggggagaaggtcgaggccttccgctccgagcgcaccgctccggcgaaggcttgcgtgaagatcgcccgcccgcgcgtgcttatccccgtgttccccggcacgaactgcgaatacgacaccgagcgcgccttccagctggccggggcggagacgcagaccattgtggtgcgcaacctctcggccaaagacgtgcaggaatccgtggaagcgttcgcgcagagccttaaacaggcgcagatcgtctttatccccggcggcttctccggcggcgacgagccggacggctccggcaagttcatcaccgctttcttccgcaaccccgccatccgcgagggcgtgatggagctgctcaagggacgcgacgggttgatgggcggcatctgcaacggcttccaggcgctcatcaagctggggctggtgccctatggcgagatccgcgagccggacgcgggcgcgccgacgctgacgttcaacgtcatcggccgccaccagtcgcgcatcgtgcgcacgcgcgtggcctcgacgctctccccgtggctgatgcacgcgcgcgtcggcgacgtccacatcgcgcccatctcccacggcgagggccgcttcatcgccgacatggagaccgtgcgcgcgctggcaaaggccgggcagatcgccacgcagtacgtgaacgccgcgggcgaaccgaccatggacatagacgccaaccccaacggctccgtgtgcgccatcgagggcatcacctcgcccgatggccgcgtgtttggccgcatggcccacgcggagcgcaccggcgcgcagctgtacaggaacgtgcccggaaatcaggacagcggcatcttccgcggcgcggtggactattttagagactga

SEQ ID NO: 1046 - DNA, 1023 bp, Unknown
  Artificiall/Consensus sequence
atgggtttctgggaaaacgtcaagcagttcaacgagcgctggaacgacctgccgcgccgcggggccatcgtgctgatggtgctgctggcgcttttggcgtttgccggtctgttttcctacatcgccccctcggtgatcgccatggtgctggcgtgggtcatccacccggtggccaaacggctggaaaatgtctttcgcaagatcaaattgccggccaagctggccagcctcatcgccgtcatcgtcatgtacggcatcgtctccttcatcctcttctggatcggcgcgcgggtggtggaggagatgcgctcgctgatcgccgccctgcccggctgggtcagtcaggccagcgagttcattcagcaatggacggcggagggcggcttccagaccttcggcgtggagatgttcggttggcaggtgttcgacgtgccgccggagatcacggactttatcaacgccgtggtcaacgaggggctggagtttgtcaagaacttctctttgagcatggtgggcacggtgagcaactggacgatctccacggtgatgaacctgccgcagatcatcctcttcatcgttctgaccatcatgggcacgttctacatggtggccgaccgcaagcgcatcttcgccttttttgagcgctggataccgcagcgcgcctcgggcaaattgaaactgctcaaggacacggtgtttcgcggcatcgccgggcagatcaagtccgcgctgatcatgatggcgctgatcgccgtggaactgtccgtgggcttcgtcatcctgcgcgtgccgtattcggtgctgctggcgctgctcatcggcatcatggacgcgctgcccatcatcggcgcggggctgtttttgatccccatgtccgcctttggcttcatcactggcgacatcggcctgggcgtgggcgtggcggttttgtacatcctcaccatcgtcacccggcagatcgtcgagccgcgcgtggtcagcgtgcaattggggctgtacccgctggtgaccatggccgccatg

SEQ ID NO: 1047 - DNA, 1998 bp, Unknown
  Artificiall/Consensus sequence
atgatggaagaactttcccgcctgccgggccttggccccgcgcgcgtgcgggcgcttgagaaagcgggcgtgcgcacattgcgcgatcttgtctcgcgcctgcccgccgcctaccgcgacctcaccgcgcccacgccgctttgcgaggcccgcccgggccttgcgtgcgccgtggccgcgcgcgtggtgggcgaaccgaccgagcagttcgcgccgcgcctgcgcatcacccgcgcccgcatcgccgacgaaagcggcgacgccgtcgccatctggtacaatcagccgtggctgaaaaaacagctctatcccggccgggagcttttgctctacggccgttttgcgctgcgccggggcgaattgcaattgcaaagccccaccatcgaacaggagcgcggcatcgtgccggtctaccgcgccatcaccggcgtgccgccgcgcgccatgcgcgatgccgtgcgcgcggcgctggagatgggccgcggccagtggccggacgaactgcccgagggccttcggcggcgctacggcctttgcgagcgcaacttcgccctctacaacgcccattttcccctcaaccgcgaatctctcgccgccgcgcgcaggcgcatcgcctttgaggaactgctgctctatcaggtggcgctctcgcttttgcgctcggacgcgcgcgcgggcgtgaagctgtcctttgccgatgaggacatcgaggatttctggaaacttttgccctttccgcccaccaacgcccagaaacgcgcactctatgaaatggcgcgcgatctgcgcatggacgcgcccatggcgcggcttttgcagggagatgtgggcagcggcaagaccgccgtggccttcggcgccatgtacctcgcctggaagagcggctttcaggcggcgctgatggcgcccacggaagtgctggcccagcagcactatcaggacgcgcaggcgctctttgcccccttgggcgcgcgcgtcggcctcctcaccggctcgctgacgaaaaagcagcatgcgcaggcgcacgaggcgctttcaaacggcgaatgggacatggtcgtcggcacccacgcgctcatcaccgagggcgttgcctatcatgatctcggcctcgtcatcaccgacgaacagcaccgcttcggcgtgcgccagcgcacccagctcagccaaaagggcgaaagccccaacgtgctggtgatgtcggccacgcccatcccgcgcacgctttcgctcatcgtctacggcgacctcgacctttccattctggacgaactgcccccgggccgcacgccggtgaagacccgcgtggtgccggaggcaaagcgcgccgccatgtacggctttgtcatggaaaaagtgcgcgaagggcggcaggcctacgtcatctgccccttggtggacaagagcgaggccgtggaggcccgcgacgcgcaggaattgtacggcgaactgtgcaagctgctgcccgaggcccgcttatccctcgtccacggccgcatgaaggcggcggaaaaggacgcgcgcctcgaagccttccgcaggggcgaaacggacatactcgtctccaccaccgtggtggaagtgggcgtcaacgtgcccaacgccagcgtcatggtcatcgaaaacgccgagcgcttcggccttgcccagctgcaccagctgcgcggccgcgtggggcgcggaaaatacgaatcgtggtgcttcctcgtcgccgagccgaccgagcggctgcgcctgctcacccagaccacggacggctttaagatcgccgaaaaggacatggaactgcgcggcccgggcgagatgtttggcgagcgccagagcggcatgctctccaccggcctttccatgctcgcgggcgacacgcagcttttgaagctcacccacgacgaggcccgcgctttgatgaagcgcccggacgatgcagagaccaaacaggtcgtcgccttcgcgcgccgccccttccgcgagcgtttggacgaagtggcgctgaattag

SEQ ID NO: 1048 - DNA, 1710 bp, Unknown
  Artificiall/Consensus sequence
atggaatatgaggaggtatacaccatgaaggtcatcatcgtcggcggcgtggccggcggcgcgtcgtgcgcggcgcgcctgcgcaggctggatgaaagcgcgcagatcatcgtctttgaaaagtccggcttcgtctcctacgccaactgcggcctgccctactacgtgggcgggacgatcgcggaaaaatcggcgctgacgctgcaaacgcccgccagcttccgcgcccgcttcaacgtggacgtgcgcgtgcgccacgaggtggtggccatcgaccgcgcccgcaaggtcgtgaccgtgcgcgatctggaaaatggacgggagtttgcggaaagctacgacaaattggtgctgtcccccggcgcgcgccccgtggtgccgccgctgccgggcatcgacggaaagaacatcttcaccctgcgcacggtggaggacgcgctgcgcatccgcgagttcgtggatgaaaagcggcccgcctcggcgacggtggtcggcggcggcttcatcgggctggaaatggcggaaaacctcgccgagcgcggcgcgaaggtgaccatcgtggaaaagatggagcagcttttgagcccgctggacgcggacatggccgcctttgtccacgccaagttccgcgccgaggggctttcgctgcggctgggctgcgccgtgaccggctttgcggaaaaggacgggcaggtggtcacgaacgtggacgtcggcccggccatcgccgcggagatggtcatcctcgccatcggcgtttccccggacagcggccttgccaaagcggcggggctggcgttgggcgcgcgcggcagcatcctcgtggacaagcacatgcgcacctcggacgcggacatctacgccgtgggcgacgcggtgcaggtggaaaacggcgtgacggggcaggcagcgctgatcgccctcgcggggccggccaacaagcagggccgcgtggcggcggacaacatcgccggtctggacagcgtttaccgcgcctcctggggcagctccgtggtcaagctctttgacatgacggcggcggccaccggcctcaacgagcgcgccgccaaagccgcgggccttgcctgtgacaaggtggtgctatctccggccagccacgcctcctactaccccggcggcagggccatgaccatgaaggtgctgtacgaaaaaggcacgctgcgcctcctcggcgcgcagatcgtcggcttcgacggcgtggacaagcgcatcgacgtgctggccacggccatgcaggcgggcatgaacgccgtttccctcaaggacctcgacctcgcctacgccccgccctattcctcggccaaggacccggtgaacatggccggtttcatgatcgagaaccttgagacgggcaaggtcaaacagttccactatgaggacatcgaccaactgccggaaaacatcacccgtctggacgtgcgtacccccgccgaatacgcgggcggctgcgcggacggctttgtcaacatccccgtggacgaactgcgcgggcggataggcgagatcgaccccggaaagccggtgtacgtgatgtgccagagcgcgctgcgcagttacatcgcctgccgcatactcgcccagcacggctacgattgctacaacttctccggcggctaccgcttctacgaggccaaccgcaaggaccgcttccgcgaggacgtgaacacgccctgcgggatgggggtgtag

SEQ ID NO: 1049 - DNA, 945 bp, Unknown
  Artificiall/Consensus sequence
atggaaggagaggcgaccatgatcgtcaacaccggcgcgcgcacggacaccgtgcagtattataccgactggcttttgcggcgctttgccgagggctatgtgctttcgcgcaacccgctgtttccaaacaaggtgacgcgctatgagctgacgccggagaaggtggactgcgtagtgttctgttccaagaactacgcgcccattttgccgcgtctgcacgagatcaccgagcgcttccccacctacttttactataccatcaccgcctacggcaaggacgtggagccgggcgtgccgtccatcgagcagagcatggaaacgctgatggcgctgtccaggcaggtgggcaaggggcgcgtcgcctggcgctacgaccccgtgctgctcacgcgcaagtacaccattgaacgccatatggagacgtttgagcgcatggccgcgacgctcgcgccgcacatcgaccgctgcatcttcagctttgtggagatgtacaaaaaactggagagcaacatgccggaaatcatccccttttcggactgggagatggacgaggtggcgcgtggactgggcgccatcgcccggaagtacggcgtttctttgcagacctgcggcatcaacggggattattcccgctacggcatccatccctcgggctgcatgacgctggatattctcggcagagccaacggcattgaattcaaggatctcaaacacaagggctcgcggcagggctgtcactgcatcgagagccgcgacatcggcgcttacgacacctgcttaaacggctgcaagtactgctacgccaacaaaaatccccttttggcctttcagaactacaagctgcacgaccccgcctcgccgctgctgcttggacatttgcggccggaggacaccatcgcgcagggggcgcaaaagtcgtttcgcaaggaggcgcggcatggctga

SEQ ID NO: 1050 - DNA, 1329 bp, Unknown
  Artificiall/Consensus sequence
atgcagatattcaacaccatgacgcgcaaaaaggaagagttcgtccccgtccacgagggcaaggtaggtatctacgcctgcggcccgacggtgtacaactacttccacatcggcaacgcgcgcccctttatcatcttcgataccctgcggcgctttctcaagcacatgggttacgacgtaacctttgtgcagaactttacggacatagacgacaagatgatccgccgcgccaatgaggaacacaccaccgtggacgccatcgccgaaaagtacatcggcgaatacttcaaggacgccgaggcgctgggtgtgatgaaggcggacgtgcatccccgcgccaccaagcacatcggcgagatcatcgccctgatcaaaaagctcgagaacaaaggccttgcctatgaggtcaacggcgacgtctacttcgacacgcaggcctaccgctccagctacggcaagctctccggccagaacctcgacgatctggagagcggcgcgcgcgtggaggtgggggacttaaagcgccatcccatggactttgccctctggaaggcgcagaaacccggcgagccggcgtggaagagcccgtggggcatgggccgtcccggctggcacatcgaatgctcggccatgagcatgaagtacctcggcgagacgtttgacatccactgcggcggcgtggacctcatcttcccgcaccacgaaaacgagatcgcccagtccgagggcgcgacgggcaagccgttcgccaaatactggatgcacaacggccacatcaacgtggacaacaaaaagatgtccaagtccgcgggcaacttcttcaccgtgcgcgacattgtgcaggagttcgaccccgaggccgtgcgcctgttcatgctctcggcgcactaccgcagccccatcaacttctcgcgcgacctcatcattcaggcgagcaattctctcgaacgcctctacacggcgcgcaacaccgccctgttcaaccgcgaccacgccccgcagcgcccgctcaacgaggccgagaccgccttcaaggagcgctgccaaaaggccgtggaagccttcgacgccgccatgtcggacgatctcaacaccgccgacgcgctggccgccatctttgagcatgtgcgcgacatgaataccaccctcaccgccgacagcgccgtggaagccatcgacgccggcctcgacgcgctgaaaacgatgacggacgtgctgggcatcctccgcaaggactacgatgccacccccgccgaggtcaaggaactggtggaaaagcgcgccgccgccaagaaggccaaggacttcgccgaggccgaccgcctgcgc

SEQ ID NO: 1051 - DNA, 852 bp, Unknown
  Artificiall/Consensus sequence
atgagcatgcgcgcaacaggccgcccgcgcggcggcgtcagcctcaagaacatggaccgcgcggcgctcaagcggctggtgggctacatcctgcgccgcaagggcatgctggcggcggtgctgatctgcatcgcgctcagctccatcgccaacgtcgcctcctcgctgtttttgcagagcctgatcgacgattacatcgccccgctgctgctggacgccgccccggtgttcaccggccttctcaaggccatcgtcaccatgggctgcatctacgtggtgggcatactctcctctttgtgctacaaccgcctgatggcgacggtggcgcagtccaccctcaaggacatccgcgacgacatgttcgcccacatgcagaccctgccgctgcgctactttgacacccacacccacggcgacgtgatgagctattacaccaacgataccgacaccctgcggcagatgatctcccagtcccttccgcaggtggtctccgcggcggtgacgctcgtcaccgtgctggtgagcatgctctctttgagcctctacctcaccgctttcgccatcctctacgtctgcctgatgctggtcgtctcgcgcaagatcgccgcgcgcagcggcaagtacttcgtgcgccagcagaagtccatcggcgacctcaacggctatgtggaggagatgatcaacggccagcgcgtggtcaaggtcttctgccacgaggaagcggcggaaaaggacttcgacaggcgcaacgaggagctctgccacaacacctcccgcgccaacggctacggcaacatgctcatgccggtgatggtgagtttgagcagcctgctctacgtgctcatggccatc

SEQ ID NO: 1052 - DNA, 1212 bp, Unknown
  Artificiall/Consensus sequence
atgaagcagtataagaagatcgttctggcctattccggcggtctggacacgtccgtcatcatcccttggctcaaggaacactacgagggctgcgaagtcatcgccgtggccgcggacgtggggcagggcacggagctggagggcctggaggaaaaggccatcaagaccggcgcttccaagctctatatcgaagatctgagcaaggagtttgtcgaggattacatcttccccaccctcaaggcgggcgcgaagtacgagggcgagtacctcttgggcacgtcgttcgcgcgccccatcatcgccaagcgcatcaccgagatcgccctcaaggagggcgcggacgccatcgcccacggctgcaccggcaagggcaacgatcaggtgcgctttgaactgtccatcaaggccttcgcgccgcagatgccggtcatcgccccgtggcgcgtctgggagttcaagagccgcgatgatgagatcgactacgccgaatcccacaacatccccctgcgcatcagccgcgagaccaactattccaaggacaagaacctctggcatctctcccatgagggccttgacctcgaggacccggccaacgagccgcagtacgaaaagatcctcgaaatgggcgtgaccccggagcaggcccccgacgcgcccgagtacgtgaccatcgactttgaaaagggcatccccgtggccgtcaacggcgagaagctggacggcgtggccctcatcgaaaagctcaaccagctgggcggcaagcacggcgtgggtatcctcgacatggtggaaaaccgcctcgtgggcatgaagagtcgcggcgtgtacgagacgcccggcggcgccatcctctatttcgcccatgagatgctcgagcagctctgcctggacaagaacacccagcacatgaagcagaagctggcgctggactttgccgacctggtctacaacggcctctggtacacgccgctgcgcgaggcgctctccgcctttgtcgacaagacgcaggagacggtcaccggcacggtcaaggtcaagctctacaagggcaacatcaccggcgcgggcatgaccagtccctactccctctacgatgaggagatcgccaccttcggcgaggacgcggtctacgatcaggccgacagcgcgggcttcatcgccctctacggcctgcccatcgccgttcaggccatgaagaagctgaagaagtaa

SEQ ID NO: 1053 - DNA, 834 bp, Unknown
  Artificiall/Consensus sequence
atgaacaacaacgctctgatccccaccatcggcgtggttacgtccatccgccgcgatacgccggacgtcaagaccttcacggtcgtgcgcgcggacacgggcacgggcgtgtgcttcaagcacatgccgggccagtgcgccatgctgtccatcccgggcgtgggcgaggcgatgttctccatcacctcgtcgcccacctgcaccgaccacatggagttctccatcaaaaagtgcggctgcctcaccagctggctgcaccagatggacgtgggccagcaggtcaccgtccgcggcccctacggcaacggcttcccggtgaccaccgaactcaagggcaaggatctggtcttcatcgccggcggcatcggccttgcgcccctgcgcagcgtcatcgagtacatgctcgccaaccgcgcggactacggccatatcgacatcgtctacggttcccgctccaaggaggatctggtggacatcgacatcatccgcgatgtgtggatgaaggccccggatgtggacgtacacctgaccatcgaccgcccgcaggacgactgggacggccacgtgggcttcgtgcccgcctacgtcaccgagctgggctttgaccccaacaagacggtgctggtctgcggcccgccgatcatgatcaagttcaccctgcagtcgctgggcgaactgggctttgaaaagacgcaggtctacaccacgatggagcttcgcatgaagtgcggcgtgggcaagtgtggccggtgcaacatcggcaccaagtacgtctgcaaggacggccccgtcttccgctttgaccagctcgacgagctgccggacgaatactga

SEQ ID NO: 1054 - DNA, 1383 bp, Unknown
  Artificiall/Consensus sequence
acccgcgaggagtgcgacgcgctgctcgcgcgcgcccgcgagggggcgtacagcgtgcgcgccatcaaaaagagcgagcgccgcaaaatgcccgccgcgccgttcaccacctccaacttgcagcaggaggcctcgcgcaagctcaacttcaacaccggcaagaccatgcagatcgcccagcagctctacgagggcgtggaactggcgggcgagggcctgcagggccttgtgacctatatccgcacggactccacacgcatctccgacgaggcgctcttatctgtgcgcgaaatgatcaaaaacacctacggcgagcccttcctgcccgccgagcccaacatctacaagagccgcaagaccgcgcaggacgcccacgaggccatccgtcccacggacatttcgcgccgccccgaggccatcaaggcttccctgacgcgcgaccagttccgcctctaccgcctcatctacgaccgcttcgtctccagccagatgaccccggcggtgtttgacaccctttcggcggacattgccggcgaaaacggccttaccttccacctcgccgggcagaagatgaagttcgccggtttcaccgtggtctacgaggaagtgcttgacgacgccgtggaggaaaaggacatctccctgcccgaccttgaggagggcatgagcgcctccctgctggacgtcaccggcgaacagcgctttacccagccgccgccccgctacacggaggcttcgctggtgcgcgcgctggaggaaaagggtattggccgcccctccacctacgccccgaccatctccaccatcatcacccgcggctatgtggcgcgcgagaacaagcgcctcatccccacggaactgggcaagatcgtcaacgacctgatgtgcaagaacttccccgacatcgtcaacatacagttcaccgccgacatggaggagaagctcgacgacgtggaaaagggacaggtggactggcacgccatcgtgcgcgacttctacgggccgtttgaaaaggatctggaaaaggccgaggccagcatcgaaaaggtctccattgaggatcaggtgtccgacataccctgcgaaaagtgcggggcgatgatggtctacaagatgagccgctacggcaagttcctcgcctgccccaacttccccgcctgccgccacacgctggcgctgcccaagagcatcggcgtggcctgcccccagtgcggcgcgcagctcctggagcgcatcagccgcaaggggcgcaagttctacggctgcgagcgctatccggagtgcgatttcgtctcctgggatcgcccggtgaacgacaagtgccccgtgtgcggctcgcgcatggtctacaagcgcggcccaaagaacacgcattaccatgtg

SEQ ID NO: 1055 - DNA, 834 bp, Unknown
  Artificiall/Consensus sequence
atgaagaagctgtttgccatcgttctggctctggcgctcacctgcgcggtcgcgttcgcggctgagggcaccatcaccgtcatgtcccgcgaggacggttccggcacgcgcgtcgcgttcgtcgagctgaccggcgtcgagcaggacgatgttgacatgaccaccgtggacgcggtcatcaccaactccaccgccgtcatgctcacctccgtggccggcgaccccgccgccatcggctacgtctccatgggctccctgaatgagaccgtcaaggccgtctccgtcgatggcaacgccgccaccgtcgaaggcatcaaggacggctcctacacgctggcccgtcccttcgtcgtgaccacctacggcgaggtcggcgagatcgcccaggacctgctcaactacatcatgtccgctgaaggtcaggccatcatcaacgaggaaggctacatcgccatcgacgacgccgccgaggcctacaccgccgctggcgtgtccggcgagatcaccgtgggcggctcctcttccgtgacccccgtcatggagaagctggccgaggcttacatggccctcaaccccgacgtgaccgtggtcgtgcagcagtctgactccaccaccggcgtcaccggcaccatcgaaggcaccgtggacctgggcatggcctcccgcgccctcaaggctgaggaagaggagcagggcgtcgtcggcaccaccatcgccatggacggcatcgccgtgatcgtcaacctcgagaacgacaccgagaacctcaccaccgagcagatcatgaacatctacaccggcgccatcaccgattggagcgagctggccgcgtaa

SEQ ID NO: 1056 - DNA, 2394 bp, Unknown
  Artificiall/Consensus sequence
atggccatcaagatcgccctggcgggcaacccgaactgcggcaagacgaccatgttcaacgacctgacgggtctgaaccagttcgtgggcaactggccgggcgtcaccgttgaaaaaaaggaagggcgcctcaagggcgcggacgacgtgatcattcaggacctgccgggcatttacagtctttccccctacacgctggaggaagtggtggcgcgcggctatctggtcaatgagaagccggacgccatcctcaacatcgtcgacgcgacgaacatcgagcgcaacctctacctgaccacgcagctggcggagctgggcatccccatggtcatcgccctgaacatgatcgacgtcacgcgcaagaacggcgacgtcatccaactgcgcaaactgggcgaggcgctgggctgcgaagtggtggagacctcggcgctcaagggcgtgggcagccaggaagtggcgaaaaaggccgcggaactgggcagaaagggcggccaccgcgagccgccgcacgtgttcgccggcagcgtggaacacgcgcttgcgcacattgaagacctcatcacccacaaggacgggcaggagccggtacaccaccatcacgcggacggcagccggcacgaaggctccatcgtcgaaccccatctggcgcgctggtacgccatcaagctctttgagcgcgatgaaaaggtgcaggcggaactgaacttgcccaagggcattcaggaggccatcgaaaaggccatcaaggactgcgaaaacgagatggacgacgattccgagtccatcatcaccaaccagcgctacgcctacataagcaagctggtggcgacctgcgtcaaaaagggcaagcccaagggctctttgaccacctcggacaagatcgaccgcatcgtcaccaaccgctggctgggtcttcccatcttcgtggtcatcatgtggttcgtctactgggtgtccatccagaccatcggcgacatcgtgacgggctttaccaacgacgtgttcgtcggcgaatggatacaggccccggtgatggcgtggctggagagcatcggcaccgcgggctggctggtgggcctcatcggcgacggcatcatcggcggcgtgggcgcggtgatcggctttgtgccgcagatgctgatcctctttatcatgctgggcatactggaagacgtgggctacatggcgcgcgtggcgttcatcatggaccgcatcttccgcaagttcggcctctcgggcaagagcttcatccccatgctgatcggctcgggctgcggcgtgccgggcgtgatggcctcgcgcaccatcgagcaggaccgcgaccgcaagatgaccatcatgaccaccacgttcatcccctgcggcgcgaagatgcccatcgtcggcctgatcgcgggcgcgctgtttggcaactccggctgggtgtccacgggcgcgtacttcatcggcgtggcggcggtcatcgtcagcggcatcatgctgaaaaagacgaagatgttcgccggcgaccccgcgcccttcgtcatggaactgcccgcctaccacgcgccggtggccggcaacgtgctgcgcagcatgtgggagcgcggctggtcgttcatcaagcgcgccggcacggtgatcctcgtttccagcatcttcatctggttcacttccagctacggctgggcgcccgcgccggtggaacctgccgctgctgaaacggaagcggcgcagacggacgtgagcgcggaggaactgaacgcggccgccgaagccgccatcgccgaggccgaaggccccgtggtgttcggcgcggtggagaactccgaccagtccatcctcggcaagatcggcggcgcggtggcgcctgtgttcgagccgctgggctttggcaactggcagtccaccgtggccacagtgatgggcctggtggccaaggaagaagtggtcggcgtgttcggcgtgctttacggcgtcaccgacgaagagggcgaggacgcggccatgggcatcgtcgaggacgaagatatgagcaacgaggaaaagagcgcggcgctctcccccatcgcccagagctttgacgaatccagcggcggccacgggcagctggcggcgttcgccttcctcatcttcaacctgctgtgcgcgccgtgcttcgcggccatgggcgccatcaagcgcgagatgaacaacggcaagtggacggccttcgccatcggctatcagtgcctgttcgcctacgccgtggccctgaccgtctaccagctcggcctgctctttgccggcgcgggcttcggcgtgggtacggcagtggccctcctgctggtggcattcttcctctacatgctgctgcgcaagaatcgctacgacgacaaccgcctgacccagaaggtcaaggtgggcgcgtaa

SEQ ID NO: 1057 - DNA, 1596 bp, Unknown
  Artificiall/Consensus sequence
atgcgcatggaatttctcggcgccgcccatgaagtcaccggcagccagacgcttttgaccgtcaacgaccgccccttcctcgtcgattgcggcatggaacagggcgcgaaccgctttgaaaacaagccccttcccgtgcggcccgaggcgctgctctgcgtcctcgtcacgcacgcccacatcgaccattccggcaacctgccgctgctttacaagcgcggcttccgcggccccatctacgccacggaggagacctgtgaccttctgcagatcatgctgcgcgacagcgcccacatacaggtctcggacgcggagtggaagacgcgcaaggcccagcgcgccggcggtcctcccgtggagccggtctacgacttggaagacgccgagggcgcgctctcccttctgcgcccctgccgctatggcgagcgcctgcccgtgctggaaggcgtggagatacgctttacggacgtcggccatctgctcggctccgcggccatcgaactgtggctgcgcgagggcgatgcggagcgcaaggtggtcttcagcggcgacgtgggcaacacgaaccagccccttctgcgcgacccgcagcgcgttgaaagcgccgatgtgcttatcatcgaatccacctacggcgaccggctccacgaaaaggtgcgccttgactacccccgcgccctcgccgaagtgctgcagcgtacgctcgaccgcggcggcaacgtcgtcatcccctccttcgccgtcggccgcacgcaggagatgctctactttttgcgccagatcaagctggatgctctcgtccatggccacagcgatttccccgtctatgtcgacagccccctcgccaacgaggccacggcagtctttttgcaggcaaaccccgcttcgctcgacgacgaggcgcgcgccctcatccgcgcgggcgtcaaccccctctggttcgacggcctcaagaccagcgtcaccgccgaggagagcaaggccatcaacttcgacaagacgcccaaggtcatcctctccgccagcggcatgtgcgacgccggccgcatccgccaccatttgaagcacaacctctggcgcaaagagtccaccatcctctttgtcggctatcaggccgagggcacgctcggtcgccagatcgtcgagggcgcgaagaaggtcaagctctttggcgaggacatcagcgtcgccgccgaggtgcgcgccctccccggcgtcagcggccacgccgaccgcgacggcctgctcgcctggctggaagacttcgcggaaaagcccggccgcgtgttcgtcaaccacggcgacgacgcttcctgcacctcctttgtggaaacgctcaagcgcctcggccacaacgcctccgcccccttcagcggcgcgacttacgacatcgccgccgatgaagtcctcgactggccggagggcgtgccggcgcaaaaggccaaggcccgggccaaaagcaacgtctttgcccgcctgctcgccgccatcgagcgcctcatgcgcgtcgcccgcagctgcgagggcatggccaacaaggaacttgccaagttcgccaaccaggtggatcgcctcgccgacgagtgggagcggtag

SEQ ID NO: 1058 - DNA, 918 bp, Unknown
  Artificiall/Consensus sequence
atgaagaaagtacttgtcctgatccttgctctggcactgttgtgttccaccgccatggccgccgagatcggctttttgccgccggccatgaccagccccttctacgccagctgcatcgagggcgcgacccccgttgccgaggcgaatggctatgacctcctggtcatgtccccgccgaccgaggacgactacgccacccagatgtccatgatggaggacatgattacccgcggcgtggccggcatcgccgtttgcggcatcaacctcgacgcgctgatccccggcattcagaaggccaatgaggccggcatcccggtggtcatgttcaacaccatcaccgagctggaaggcgcggacgtgtacgcctactccggctacaaccagtacggcggcggcgccaagatcgccgactgggtcaacgagcagaccggcggcgaagccaaggtcgccatcatcgagggcctgccctctgacttcaccacccagcgcatgggcggcttcgtggaccgcgccgccgaggcctatccgggcatcgaagtggtcgccacccagccgggcgactgggtccgtgagaccggcatgaacgccgccatggacatgctccaggcccatcccgagatcaacgtcatctacggcctgtctgacgaaatggcgctgggcgccgtgcaggcctgcaagcagctcggccgcgacgacatcatcgtggtcggcctcgacggcaaccccaacgcccttgagagcgtgaaggccggcgagctggacgccacgctggactgcggcccggtcgccatcggcgccaacgccgtgcaggccatcatcgacgccatcaacggcgtggagcgcgaggagaaggtcatcgaggcggagaccaccgtcgtggacatcacgctggtcgatgagttcctgcccgaggcgtaa

SEQ ID NO: 1059 - DNA, 1074 bp, Unknown
  Artificiall/Consensus sequence
atgaaacggatcggacttctgaccagcggcggcgattgccaggcgctcaacgccaccatgcgcggcgtggtgaagggcctgagccacaacctcacggagcttgaggtctacggcttcatggatggctacaagggcctgatctatggcgactaccgcatgctgacctcgcgcgacttttccggcatcctcaccaggggcggcaccatattgggcacttcccgccagcccttcaagatgatgcgcgtgccggacgaaaagggcctggacaaggtcgaggccatgaagcagaactactacaagctgcgtcttgattgtctggtcatcctcggcggcaacggcacgcagaagacggccaacctcttgcgcgaagagggcctcaatatcatccacctgcccaagaccatcgacaacgacatctacggcaccgacatgaccttcggcttccagagcgccgtggacatcgccaccgaggccatcgactacatccacaccaccgccgcctcgcacaaccgcgtattcatcgtcgagatcatgggccacaaggtcggctggctgacgctgcacgcgggcatcgccggcggcgctgacatcatcctcatccccgagatcccctacgacatcgacaagatcatcgaagccatccagcaccgctccaaggagggcaagggcttcaccatcctcgccgtggccgagggcgccatctccaaggaggacgccgccctttccaagaaggacctcaaggaaaagcaggccgactacaagtacccctccgtctcctacgagatcgccgaaaagatcgccaagaagaccggcatcgagatccgcgtcaccgtgccgggccacatgcagcgcggcggcagcccctgcccgtacgaccgcgtgctttccacccgcctgggcgcggaggccgccaacctcatcctcaaggaccagtacggctacatggtgggcatcatcaacggcaaggtcaagaaagtgccgctgggcgaagtggccggcaaattgaagggcgtctcgccggacgatcagctcatccagcacgccaagctcatcggcatcagcttcggcgactga

SEQ ID NO: 1060 - DNA, 2040 bp, Unknown
  Artificiall/Consensus sequence
atgacggagagaatccaaacgttgctgaactggatcgtcgagggcgaacacaaggcgctgcgcgccccgctggacgaggaaacgctggcaaacatccgcgcgcagatacagcgcgaggacatgcccctgagcaggcgcgccgcgcgcaggctgcggctgcttctggaaaacgagcgcgtgcatgtgcgcgaggatgagcgcatccccggcatccgcaccattcccgagtttcccgacatctacgccgagggcgagaaggagcgcctcttcgccgggcatttcatccacgagcagggccgcgtgtgcaacatttcctccgattacgagggcgttttgcgcgagggcctgctgccccgccgcgcgcgggcggaacagacgcttgccgaggggcgcggcgacagagacttcctcgaagccgccatcgagaccatcgacgcggtgatcgcctttgccgaccgctacgcggaggcgctgccggacggcgaagggctgaaagaggccatgcgccacggcgcgaaggatttcctcaacgccctgcgcatgctgcgcatgctgcatctggcgctgtgggcctcgaacgtctaccacaacaccgtggggcgctttgaccagtacatgtggccgtacctgaaggccgatctggacaggggcatgagccacgacgaggcactggaactcctggaggaatttttcctcaccttcaaccgcgacagcgacctctacaccggcatgcagcagggcgacaacggccagagcctgatgctgggcggctgcgacaaagacggcaaggacgccagcaacgacctgaccgtcctctgcctcaccgccagtttggagatgcgccgtatcgacccgaagatcaacctgcgcgtcaatagggatacgccgctggaagtgtacgaatactgcaccaagctcaccaagcagggcctgggcttcccgcagtacgccaacgacgatgtggtcattcccggccttgtcaggctgggctacgacatcgaggacgcgcgcaactacaccgtagccgcctgctgggagttcatcatccccggcgtggccatggacatccccaacatcggcgccatgccgctggcggaggtggtgcgcgaggcttgcgaggaagggctggagaccgccaaggactttgagagcttcaagtcgcgcgtcgtgaaggttttggaccgcaaggccaaggagatcaccgacggcgtaaagaacatcttcatcgagcccgcgccgtggcagagcgtgatgatgcgcgactgtctggccaccggccacgacatcagcgaaggggccaagtacaacaactatggcatccacggcaccggccttgccaacgccgtggacgcgctggcggcggtgcgcaggttcgtattcgaggaaaagagcgtcgcgcccacgcagctgctgcgggacatggacgaggacttctccgaggacgcgcagcttctgcacacactgcgcacgcgcgccccgaagatgggccgcgacgaggagtgcgacgaactggccgactggctgctggaggcgttcgccgcctcgctgaagggcatccgcaacgagcgcgggggcattttccgtgccggcaccggctcggcgatgtactatgtatggcacgccgaccatctgggcgcgaccgccgatggccgccgcaagggcgagcgcctgccggcgaacttctctccttcgctgatgctctcggacgccggcccgctctcggtgatccgcgcctttgcccggcccgcgctgacggacgccatcaacggcggcccgctgacgctggagttgcacgacaccgtgttccgcaacgaggagggctcgaagaaggtggcgcagctggtgcgcacgttcatccagctgggcgggcatcagttgcaactcaacgccgtcgaccgcgacacgctcatcgacgcgcagaagcacccggagaagcaccgccaactcatcgtgcgcgtatggggctggagcggccacttcgtgcagctggacaggatgtatcaggatcagatcatcgcccgcacgtcgtacagcatttag

SEQ ID NO: 1061 - DNA, 1398 bp, Unknown
  Artificiall/Consensus sequence
atgaaaaagacaggctcgctgacaaagcgggcgatcctgttcacggcgatcatcgcagcgacgatggtcgtcgtcgccttgctggtgtacctgctcgccttcgggcgcgggcaggacggcatgccctttgtctggtcgctgctggtggggctgggcgcggcggccatcgccttttacccgcttttgcgggcgctgatcctgcccgtttccgagcatatcggcgcgctgcgcgacgtggccgtggccgtgggcaagggcgacttggacgcgcgcgcggacgaacgcgccccgggcgaactggggcaggtgggcaaggcgctcaacgacctgtcctatcagctctcgcgcaacatgtatctgctcatcatcgagcgcaaccgcttaaagcagatgctcaacggcctgtctgagggcatcgtggccgtcaacgccaagggccgggtgacgcaccgaaacccggcgctggaaaggatgttcgacgcgccggcgcaggagcatcccccgcgcgacgagcgcctcaagctcatcccggaccgcgacatctgggccgatttcgaccgcgtggtgcgcgagggcaagaccgtgacccgcaatctggaaatgccggagcgcgttttgcgcgtggtcatctcgcctctggtggacgagatcggcaccacggcgggcgcggtgggcctgttttccgacatcacgcagatggagcggctggagcgcacgcggcgcgactatgtggccaacgtctcccacgagatgcgcacgccgctgaccgccatgcgcgccctcatcgagcccttgaaggagggcatggtcaagaccgaggacgcgcgcatgcgctattacgacatcattttgcgcgagatcatgcgcctttcgcgcctcatcaacgacctgatggagctttcgcggctgcagagcggcacgctggccatccgcactgagcgcatgaagctggcggagctggtgggcgatgtgtgcgagcgctaccgctccatcgccgaggatcacaacatcaccttccgcgaggaaacggacttttccaaggtgcccgccgttgtttccaacccggaccgtgtggagcagctgttggtcatcctgctggacaacgccatcaagtacacgcccggcggcggcacggtctctttggacgccacctgggacgacgcgcgcgtgacgctcatcgtcaaggacacgggcatcggcatttccaaggaagatttgccctatgtgttcgaccgcttctacaaggtggacaaggcccacagcggcatgggcagcggattgggcctctccatcgccaaagagctgctcaagtggatgggcgaggacatctgggtcaagagcgaggtgggcaagggcacgcagttcggcttcacgctgcgccgcgaccccacgccgtaa

SEQ ID NO: 1062 - DNA, 1917 bp, Unknown
  Artificiall/Consensus sequence
atggacacgttccccgaaaaaccaaggaaaaaggagaatgtgcccatgaaaaagctcaccgtcctcctggcgctcgcgctgagcgtcctcctcccggcgctggccgtggccgaagaggccgagccgacgcccgcccccgtccccgccgaggagatcatggcctacgcgcaggtgtacgagccggagacttccttcgtgctttcctccaccgtggcctggaacgccgacgccagcgtactcgacgtggccaacgcggatgtccgccccgccaccgccctggtctacgtggacgccgacctgcgcgtgctggacgctgccggcaacgtcatcgccgaatccctcgacgagtacgtggccgccaccgccggcaccatcatccccgcgctgtacatctccgacgcggagaccgccgcggcgctgaagttctacctcatcgagtccggtctgggcgacgtgttcgtggccgcctcctatgaaaacgcggcgctggtcaaggacgttgccgacctcaaccccgtgcgcggcctcatcgacttccgcggcctcaccgaggccgacgaggacacgcttgatgagatcatcgccaccaccaacggcagccacgccaaggtctgcctgatctccgagcagatcgccaccgaggaaaccgtgcagtacctgcagggccgctgctccaccgtgtgggtggccacctcctccaccgaagcggcgctgctcacgcagtacaccaacggcgcaaacggcgtgctggtggacgactatcaggccgccatcgacgaactgggcttctttgccgacggcgcgccctcgctgctgcgtccctcgctgatcgtcggccatcgcggcatgcccagcgagtacgtggagaacaccaccctctccgccattggcgcctacaccgccggcgcggactccatcgagaacgacatccacctcaccgccgaccgcgagatcatcatcaaccacgatgaatccctcgcccgcctctttggccgcgaggacatcgaaaacctcaacatcctctccctgaacgagatcctcgccatgcccttcgtgaacgaaggcgaggagggcgtgcaggccgccaacaaccagagcgcggacgaatcccgctacggctacatccgctacctgtcctcccagcgcatgcccactttgcgcgagttcttcgagctgttcaaggatagcggcgtggtgcacgataccgagatcaagaccaacgaccccgccatcgtcatcgccctgcacaacctcgtggatgaatacgacaactttggcgaagtgttcaccatctccttcaacgtcaacatccttgaggaaatgtatgcgtcctggccggagatgagcgtcggcgcgctgggcatggagggctacgccgatcccgagtccaacctgcccatgtacgagtcctacggcgagatgatcgagagcggcgaagccaccgtggaagagtgcgtggccatgctctacgccgaactggacaagtggaacgccacctacaaccccgccagcggcttctcctacgacgtggtctccgccggccgtcatcgcggcctgaccgtgtggccgtggacctacaacgacgccgccgccttcgccgaggcctacctgaacggcatctacggcctgaccaccaacttcgcctggtgggcgagcgacttcatcgtcgacatcgacgcgaccgacgccaccatcgccgtgggcggcgagctgcccgccccgaccgtcaccacccagaacggcgagcaggtgacggtggacggcctggaagccatcattgtcagcggcgcgctggacagcgagggcgaggcgctggtcatctaccgccttgcgcaggagctggtcatcgacggcgcttcctacggcgaatactacctctactccaaccccttcaccgtcaccgtgacggcggcgtaa

SEQ ID NO: 1063 - DNA, 918 bp, Unknown
  Artificiall/Consensus sequence
atgagaaagcataatgttttgaagaaggtcagcctcttcctggcgctggcgctgtgcgtgggctttgccggcggcgcgcttttgaccagaaagaccgaggccatggctgaaacggcggacgccacggtcggctacgacgccgtgtattcctccgacaaccccgtgcccgagatcgccgcgaacgtgcgcccctcggtggtgcaggtgatcaccagcgccgccacgtgggaccagcgcacccgtgaagtctccaccgaggagattggctacggctccggcacctacttccgcacgctggacggcggcgagggcggctacatcctcaccaacaaccacgtggtggacgagggcgagacctaccagatcgaatggctggacggcaccatcatggacgcgacgctggtcggcgcggatgagggcaccgacatcgccgttttgcagttcaacgagcctgcgcccgaaggcgccacgcccgttccgctgggcgattccgacgcattgcagatcggcgaactggccatcgtcatcggcaaccccggcgacagcgaggaagtgctgtttggcaccgtgaccgccggcatcatctccggcctggagcgcgagggcgtgtccgcgcagggcagcttcaaccgccccgtttccaccattcaggtggacgcggccatcaacaccggcaactccggcggcgcgcttctgaacgcgcagggcgaactggtgggcatcccgactttgaaaatgaccgccagctacaccaccatctatgaaggcctgggcttctgcatcccgatcaacaccgccaaggacatcatcgagcagctgatcgagaacggcgaggtcgtgcggccgaggctgggtgtcaccgtggtggcgcaggacggcccggatgagccgatgcgcaacttcgcgcctgccggcgtg

SEQ ID NO: 1064 - DNA, 1014 bp, Unknown
  Artificiall/Consensus sequence
atggcagtcgtgaccggaaccaactggaacgcctacgatgcggcgaccatgacctcccgcgagatctacggccgcacgctggccgaactgggcaagcacaacgaaaagatcgtcggcctcaccgccgaccttgccaagaccacggccatcgtccatttcgccaaggccttcccggaccgcttttacaacgtgggcatcgccgagcagaacatgttcggtatcgccgcgggccttgccaaggcggggctgatcccctttgcctccaccatggccatcttcgcctgcatgcgcgccggcgagcagatccgcacggacatcgcctaccagaacctgccggtaaagatcatcgccacccacgccggcatctccttcggccacgccggcaccacccaccactgcaccgaggacttcgccatcatgcgcgccatccccaacatgacggtcatctgcccggcggacggcatcgagacctccaaggcggtgcaggcctgcgtggacacgcccggcccggtctacatccgcatcggccgcggctttgagccgccctgctacgaaagcgacaactacacctacgagatcggcaaggccatcaccatgcgcgagggcacggacctgaccatcatctgctgcggcatcgccgtgctgcaggcgatgaacgccgcccgcgtgcttgccgagacggacggcctctccgtgcgcgtggtcaacatgcacaccatcaagcccatcgaccgcgaggccattttgaaggccgtcaccgacacgcggcgcatactcaccatcgaggaacacaacgtcatcggcggtctgggcgacgcggtgggcagcgtcatcgccgagtccggcaagggctgcgtgttcaaaaagcacggcctgcaggacaccttcgccgccatcggctacgccgaggacctctacgcctactacggcctcgacgccaacggcgtggtggacaaggtgcgcgagatgatgggcatggaatttgaacccgacgaggactggaacgacgaatag

SEQ ID NO: 1065 - DNA, 561 bp, Unknown
  Artificiall/Consensus sequence
gtgtacaacgccgtggccaacggcgtcggcccgagcatcatcttcaactatgcctccaccgccgcggactacatcgaggacaatctggtcgtggacatgagccagtacatcaacgaagatcccgagatgcaggagatctacaactccctgcccgaggccatcaaggctgagactgtcggcttcgtcgatggcggcatgtacgccctgcccgccgtcaccaccggcccgatcttcttctacaacaagaccatctacgacgagatgggctttaccccgccgacgacctgggaagagctggctgagcagtccaaggccatctatgaaaagtacggcatccccggcttcgccgcggactcgctgaccgaccttatgcacatgctcatcatgcagtccggcaacgagtacatcgacatggagaacaagtgcgttctctttgacaccgactccacccgcgaatggctccagtggttcgctgacaacgtgcaggcgggctacttcggcctgcgtcccaccggcgactactggtctgacgacttcaacgccaagctggtggcctcctac

SEQ ID NO: 1066 - DNA, 1266 bp, Unknown
  Artificiall/Consensus sequence
gtggctaacaaacgttcgatcggcgagtgggtgcgtcaaaacatcgtcaccgtcatcttcatcatcctctgcgccgtctgcttcatcctctcgggtgaaacgcccgcctacgtggccatggagctggtcaaccgcctggcgcgcaacgccttcatcgtgttgtcgctgatcatccccatcgtcgccggcatgggcatcaacttcgccatcaccatcggcgcgatggcggcgcagatcgccatcctctgggtgttggagtggcagatccccggcatcggcggcttcctcgtcgccgcgctgatgaccattcccatcgccacgctgttcggcttcctcatcggcaagctgctcaacaagatgaagggccaggaaatgatcggcagtatgatcctcggctactttgccaacggtctttaccagctgctcttcctcttcatcttcggcaacctcatccccctgcacaccgacggcctggtcatcaagggctccacgggcgttgccaacacgctggatatgtccggccccaccggcatccgcaaggcgctggataacctgcggtcgctggaatttgcgccggcgctgtacctgttcgcgggcctcatcaccgtggtgatggtcatcctctacctgcgcaagagtaccacgctgcgccgcctgatcgtcgtcgaggcggttctggccgcctgcgtcatcgccgtgcagttcccggctgtgaacgagatcttcttcctcgtgcgcgtgccggtggtcaccttcctggtggtcggcctgctgtgcctgttcaacgtggtcatcatgaagacccgcctcggccagcagttccgcgccgtcgggcagaaccgcgtggtcgccaacgccgcgggcatcaacgtggataagacgcgcatcatcgccatcatcttctccaccgtgctggccggccttggccacctgatcttcgcgcagaacctcggctcgttgcagacctatggcgcgcacgagcaggtcggcctctacgcgggcgcggccatcctcgtgggcggcgcgtccatcgtcaaggcttcgaacggtcaggcgctgcttggcgcgttgctgttccacctgttgttcatcgtcgtctccggcgcgggccgcaccgtgttcggcgacgctgccatcggcgagtacttccgcgtgttcatctcctacggcgtcatcgctgtcgccctggtcatgcacgcctggagcgccgtcagcaagcgcaaggacccggaggcgcagctgcgcgccgcgtccgaaaaggcgtaa

SEQ ID NO: 1067 - DNA, 2037 bp, Unknown
  Artificiall/Consensus sequence
aagaccccgcgcccgggcatcgacttcttccccctgagcgtggattttgaagaaaagctctactccgtgggccacatccccggcagctggaaccgccgcgagggccgtcccgccgagaaggccatcctcacctcccgcctcatcgaccgcccgctgcgcccgctcttccccaagggcatgcgccacgacgtgtccgtggtggccaccgtcatgtccgtggacaccaacaacatccccgacatcccggcgatgatcggcgcttcggcctctctggccaccagcgagatcccgtgggccggccccatcggcgcggtgaacatcggctatgtggacggcgagtacatcgtcaaccccaacgatgaacagcgcgaagtttcccttctcaacctcaccgtggccggcacctccgaggccgttctgatggtcgaggccggcgcgaaggaagtctccgaggaagtcatgctcggcggcatactcttcgcccacgaggagatcaagaagatcgttgagctgatcaacaccatcgttgctgagatcggcaaggagaaaaaggaattcccgctcgttctgcccggcgaggacgtcaaggccgccgtgcgcgaatacgccatggacaaggtcaagtggatgttcgagaccttcgaccgctccgagcgcaacgcccgcgaagagcaggtcaaggccgaggtcgccgaacactttgccgagcagttcgagggccgcgaagtcgaggtcggcgacgcgctctacggcctgcagaaggaagtcatgcgccgccacatcatcgacgagggcgtgcgtcccgacggccgcaaactcaccgaagtgcgccccatctggtgcgaagtgggcgttctgccccgtccgcacggcagcgccgtgttcacccgcggccagacgcaggtgatgaccgtggccaccctcgcgcccgtgtctgaaaagcagatcatcgacggcatcggcaccgaggattccaagcgctatatgcaccactacaacttccccggctattccaccggcgaagccaagcccatccgcagcccgggccgccgcgagatcggccacggcgctctggccgagcgcgcgcttctgccgatgatcccgccggtggaggagttcccctactgcctgcggctggtcagcgaggtcatgtcctccaacggctccacttcgcaggcgagcgtctgcggctccaccttggctttgatggacgcgggcgtgccgatcaagcgccccgtggccggcgtggccatgggccttatcaaggacgtggagaacaccggcaaggtggccgtgctcaccgacatccagggccttgaggacttcctcggcgatatggacttcaaggtggccggcaccgcgcagggcatcaccgccatccagatggacatcaagatcaagggcatcgacgaagccatcctccgtcaggcgctggcgcaggcccacgatggccgcatgcacatactcgacaagatgctcgacgcgctgcccgcgccgcgcccgcacctctccaggtacgcgccgaagatcatccacttcttcatcaaccccgagaagatcggcgaggtcgtcggcccgcgcggcaagatgatcaacaagatcatcgaggagaccggcgtgaagatcgacatcgaggacgacggcagcgtcttcatcgccaccacggacgacgcggcggcgcagaaggccaggtccatcatcgagggcatcgtgcgcgaactgaaggtgggcgatgtgttcaccggcaaggtggcccgcatcatgtccttcggcgccttcgtggaatacgcccccggcaaggacggcatgatccacatctccaagctggccaacggccgcgtggacaaggtggaggacgtggtgaagatcggcgacgaactggagtgcaaggtggcggagatcgactcgcagggccgcgtcaacctcatccgcaacgacatccagtacgatgacgaatccatgcccgtgcgccgtcccccgcgccgcgatggcgaccgcggcgggcgcgaccgcggcggccgtcccccgaggcggtaa

SEQ ID NO: 1068 - DNA, 999 bp, Unknown
  Artificiall/Consensus sequence
gtggccagcgtctgttcgctgtttgtcggcgtcatcgacctgaacctgccgtcgctgtttggcggggatatggagcagctgaagatactcgtcgtctcgcggctgccgcgcctgctcgccatcctctgcaccggcgtgggcatgagcgtggcggggctcatcatgcagcagctttgcatgaacaagttcgtctcccccaccacgggcgcgaccatctcctcggcgcagttcggcattttgctagcgctgttgttcatgccgaactccacgctctgggggcgggcgctgttcgcctttgccacggcgacgctgggcacgtggatcttcgtatggttcatccagcgcatcaccttcaaggacgtggtgatggtgccgctggtgggcatcatgttcggcaacgtcatcggcggcatcaccaactatctggcctacaagtacgaaatgacgcaggcgctgtccacgtggctggtggggcatttttcgctggtgctgcgcgggcggtacgaactggtgtatctggtggcaccgctggtgattctggcttttctctttgccaaccacttcaacatcgtcggcatgggcaaggacttttccaaaaacctcggcgtgcattacaatctggtgctgttcatgggcctgaccatcgcggcgctgatcacggcgagcatcgtggtggtggtcggctccatctcctacatcggcctcatcgtgcccaatgtggtggcgatgttcaagggcgacaagatccgcggcacgttggtggacacggcgctgttcggggcgttgttcgtgctggtgtgcgacatgctggggcgcgtggtcatcgcgccgtatgaactgcccatcgagctgatcgtcggcatcctcggcagcctgctgttcatcggactgctgttctaccggctcaaacacgggcgcagggccatccgcctcaaggggccgacctttggctgtggggcgggcgcgcccgatctggaaggaggcgcgggcgaatgctga

SEQ ID NO: 1069 - DNA, 1377 bp, Unknown
  Artificiall/Consensus sequence
atgaaagttttgtttgccgcaagcgaatgcgtgccgtttgtcaagaccggcggtctggcggacgtggtgggcgctctgcccaagcgtctgcgcgacctcggggtggatgtgcgcgtgatgctgcccatgtactcggccatcgaacccaagtggcgcgagaagatggaacacgtgctgttcttctacgtcaacctcggctggcgcaggcagtatgtgggcattgaaaagctcgtctatgaggggatcaccttctacttcatcgacaacgagcagtacttcggccgcaactacatctacggctacggcgccgacgagggcgagcgctttgcctacttctgccgcgccgtgctggagagcctgccgctgatcgactttgtgcccgacgtcatccactgcaacgactggcagaccggcctcatcccgccgatgctggacatccagtaccgcaaactggagcagtacaaaaacgtcaagaccgtcttcaccatccacaacctcaagtatcagggcctgttccagatcgacgacatcgaggaaatggtctcccttggcgaactggcctacaccgccgacagccttgagttctacggcatgtgttcgttcatcaagggcggcatcgtctttgccgaccacatcaccaccgtcagccccacctacgcgcaggagatacagaccgcctactacggcgagcgtctggacggtctgctccgcgcccgcgccgattcgctcaccggcatcctcaacggcatcgacaccgtggagtacgacccggagaccgacccctccatcgccgtcaactacaccgccgatacctttgagaaaaaggcgggggacaagatcgccctccagcgccagctcggtttgcacgagaacgccgaggcgcctatcatcgccatggtcacgcgcctcaactcccagaagggccttgacctggtcgagcgcgtgcttgcggagatcatgtccaccggcgcgcagatggtcgtgctgggcatgggcgagagcaagtatgaggacctcttcaactgggcgcagtggaagtacgccggccagctctcggccaccttccagatgaaccacgagctgtcccaccgcatctacgccggcgcggacatgtacctcatgccctccatgttcgagccctgcggcctttcgcagctcatctccctgcgctacggcacgctgcccatcgtccgcgagaccggtggcttgcgcgatacggtgctgtcctacaacgagtataccggcgagggcaacggcttcagcttcctcaactacaacgcccacgacatgctccacgtcatcgagcgcgccgtgagcatctaccacgagaagaaggacgtctggaacatgctggcccgccgcgccatgcagggcagc

SEQ ID NO: 1070 - DNA, 2271 bp, Unknown
  Artificiall/Consensus sequence
cgcgcaaagcgcctgcaatcggcgctggcggcgcagaagatccaggcgcagctgccggacgagccgcccgaggcgctgccggagggcgaggcggtcatcctgcccgccacgctctcgcgcggctttatctatccggcggcgaaacttgccgtcgtctgcgaaacggacatcttcggcatgggccgccagaaggcgcgttcgcgcgccaagagcggcgaaaagctggccgcgtttaccgacctcgccgtcggcgactacgtggtgcatgaaaaccacggcgtcggccagtacatgggcacggtgcgcctcgcctcggagggcacctaccgcgattttctgcacattcgctatcagggctcggacaaactctacgtgcccaccgaccagctcgaccgcgtgcagaaatacatcggctccgagggcgagacgcccaagctcaaccgcctctccggcggcgaatggcagcggcagaaggcgcgcgtcaaggcctccatccaggagatcgccggcgagcttttgaagctctacgcccaccgcgaggccacgcccggccacgccttcgacccggacaccccctggcagcgcgagtttgaggacagcttcccctacgaggagacccccgaccagctcgccgccatcgaggagatcaagcgcgacatggaaaagccgcgcatcatggaccgcctgctctgcggcgacgtgggctacggcaagaccgaagtggccctgcgcgccatcttcaaatgcgtgatgggcggcaagcaggcggcgctgctggccccgaccaccattttggtgcagcagcactacgccacgatgatgaaccgcttccacggcttccccgtcaaggtggacaccctctcgcgcttcaagaccgcgcaggagcagaaggaggtcatccgccagctggaggcgggggaactggacgtggtcatcggcacccaccgcctgctcggcaaggacgtgaacttcaaggacctcggcctgctcgtcgtggacgaggaacagcgcttcggcgtcacccacaaggaggccatcaaaaaactcaagcgcaccgtggacgtgctgaccctcacggccacgcccataccgcgcacgctgcacatgtccatggtcggtatccgcgatatgagcctgttgcagtccccgcccgaggagcgctacccggtgcagacctatgtggtcgaatactcggacggcctcgtgcgcgacgccatattgcgcgaactggggcgcggcgggcaggtctacgtgctgaacaaccgcgtgcagaccatcgaggtggtctatgcgcgcctcaaaaagctcgtgcccgaggcgcgcatcgccgtcggccatggccagatgcgcgaacacgcgctggaagacgtgatgctcgacttctacgagggcaagttcgacgtgcttctgtgtacgaccatcatcgaagccgggctggacgtgccgcgcgccaacacgctcatcgtgctggacgccgaccgctttggccttgcccagctctaccagctgcgcggccgcgtgggccgctccaaccgcctcgcctacgcctacctcaccgtcagccccaccaaggtgcttaccgaggcggcggaaaagcgcctcaacgccatccgcgagttcaccgagttcggctccggcttccgcgtggccatgcgcgatctggagatccgcggcgcgggcaacctgctgggcgcggaacagtccggcttcatggcttcggtgggctatgacctgtacgtgaagatgatcgaggagactgtgcgcgagatgcgcggcgacgtctcccgcggcgatgtggagacgcgcgtggaactgaaggtggacgcctatcttccgcaggaatacgtgcccagcgacgtcatgcgcgtggagatgtacaagaagatcgcctccatccgcgaccgcgccggccgcgaagacctcatcgaggaactgatcgaccgctttggcgaccccaaccgcccggtgatgaacctgatcgagatcgcccacctcaaggcgctctgttcgaatctgggcatcgacaatgtgagcatgaagggcagcgagatggtgctgcgcttctccatcgccgcgcaactcaatcccatgaaattgctcatggccgtcaagccccacgaagcgcgtttgcggctggtgggcaccaacccgcccgccctgcgcttctttgacgtgaagcgcaagaccgccgaggaactgctgcccgaggccgtgcgcgtcatggaggacatacttgcccgcatggagggcaaagaggaggtgcaggcgtga

SEQ ID NO: 1071 - DNA, 948 bp, Unknown
  Artificiall/Consensus sequence
atgatccataccgacgtctgcgaccgcatcggcatcgagtacccgatcttccagggcggcatggcctgggtgagcgagcatatcctcgccgcggcggtctccaacgccggcgggctgggcatcatctcggccatgaacgcccccggcgaatacctgcgcaaggagattcgcgcctgccgcgaaatgacggatcgccccttcggcgtcaacgtcatgctgatgagcccgcacgcccccgaggtgggcaaagtcatcctcgaggaaaaggtgccggtcgtcaccaccggcgcgggcctgcccggcgtttacatgaaggaatgggtgcccgcgggcatcaaggtggtgcccgtcgtcccctccgtggccatcgccaagcgcgtggcgcgcgagggcgcgaccgccgtcatcgccgagggctgcgaatccggcggccacgtgggcgaactgaccaccatggccctcgtgccgcaggtggtggacgcggtggatgttcccgtgctggctgcgggcggcatcgccgatggccgcggcatcgcggcgtcgttcatgctcggcgcgcggggcgtgcaggtcggcacgcgcttcctctgcgccaccgagtgccaggtccaccccaactacaagaaaaagatcctcgccgcgcgcgacatcgacaccgtggtcaccggcaagcgcctcggccaccccgtgcgctgcctgaaaaaccccttcgcccgctcctttggtcagatggagtacgattcctccctcaccaacgaggagatcgaagcgtttggcgccggctcgctgcgcaaggcggcggtcgagggcgatatggaaaacggcagcatcatgtccggccagatcgccgcgctggtcaaggaagaacagcccgccgcccggatcatccgcgagatgttcgcgcaggcggagcaactgcttgcggaggccgccaaatgggtaaaatag

SEQ ID NO: 1072 - DNA, 1365 bp, Unknown
  Artificiall/Consensus sequence
atggttgaccgcctgtttgtggaaaaaaagcccggctttgacaacgaggcccgcgcgctgctcaaggacgcgcgctccttcctcggcgtgaccaatttgaccgggttgcgcctgttcaaccgctacgacgtggaggggctggacgcggcgctgcttgcgcaggcgcgatgcagcgtcttttccgagccgcagctcgacgacgtctacgacgaattgccgcaggacgagggcgtggtctttgccacggaatacctgccggggcagtttgatcagcgcgccgactccgccgcccagtgcatacagttgatggcccagtgcgagcgccccatcgtgcgcacggcgctggtgtatatcctcaagggaaatttgtccgacaaggatgtggagacgctcaaaaagcacgtcatcaaccccgtggaacgccgcgaggcttctctggaaaagccggagacgctgcgcgccgactacgccctgcccgagaccgtggcggtcatggagggcttcacgggctatggcgaggcggagctggacgccttccgccgccagtatgggctggcgatggacgacgccgatctggcgttttgccagaagtacttccagtccgagcatcgcgaccccacgctgacggaaattcgcatgatcgacacctactggtccgatcactgccgccacacgaccttcctcaccgagtttaccgacgtgcgctttgacgacgcgcgcgtggagaaggcctacgggcgctatctcgaaattcgcgccgcgctcaagcgcagcgacaggcccgtgacgctgatggacatggccacggtgggcgcgcgctatctgaagctgaccggggcgctgaccgacctcgatgaatccgaggagatcaacgcctgcacggtgaagttggacgtggagacggacaagggcgtggaaaagtggctgctgctgttcaagaacgagacgcacaaccaccccacggagatcgagccctttggcggcgcggccacctgcatcggcggcgccatccgcgacccgctctccgggcgcggctacgtctatcaggccatgcgcgtcaccggcgcggccgaccccacccagccggtggaaaacaccatcgcaggcaagctgccccagcgcatgctgaccaccacggcggcggcggggtacagttcctacggcaaccagatcggtctggccacggggctggtggatgaaatttaccaccccggctacgccgccaagcgcatggagatcggcgcggtggtgggcgcggccccggcggagaacgtgcgccgcgagacgcccgcccctggcgactgcgtggtgctgctgggcgggcgcacgggccgcgacggctgcggcggcgcgaccggctccagc

SEQ ID NO: 1073 - DNA, 2607 bp, Unknown
  Artificiall/Consensus sequence
gtgaaaacgcagaaattcaacgtcaccggcatgacgtgcgcggcctgtcaggccaacgtcacccgccgcgtgcagaagctggaaggcgtcaaggatgtggacgtcaacctgctctccggccgcatgacggtcgaatacgacgaaagcgcgctcaccgcccccgccatctgcgcggcggtgcaggagatcggctacggcgccagcgacgccgaggccccgtcgccgggcgcgcaggcgcaggctgcctccggcttccgcgaggagtggcagtcgcgccagcagcgcgccgaggacgatcaggcgtccatgaagcgccgcctcatttcttccattatcctgctcatcccgctgatgtacgtggccatgggcggcatgatgggcctgccgatgcccggctttctcaccggcatggaaaacgccctcatctcggcgctgacgcagctggtcatcaccgtgccggtcatcctcatcaaccgcaagttctacatcgtcggcttcaaggcgctcgcccaccgcgcgccgaacatggattctctggtggcggtcggctccagcgcctcgctgctctacggcattttcgccatgtaccgcatggcctacggcttcggccacgccgacatggccgtggtacacgaatacgcccacgccctctactttgagtccgcggcgatgatcctcacgctcgtcaccgtcggcaagtacctcgaggcgcgctccaaatcaaagacttcagacgcgctgggcaagctggtcgatctcgcgcccaagaccgccgtggtcgtgcgcgacggcgtggaagtcaccgtgcccgccgagcaggtggtcgccggcgacgtcgtggtcatcaggcccggcgagagcatccccgtggacggcgaggtcatcgagggctttggctacgtcgatcaggccgccatcaccggcgagagcatccccgtggaaaagcatgttggcgacacggtcatctccgccaccatcaacaaaaacggcgccttccgcttccgcgcctcgcgcgtgggcaacgataccacgctcgcgcagatcatccgccttgtggacgacgccagttcttccaaggcacccatcgcccgcctcgccgacaaggtcagcggcgtgttcgtgcccgtggtcatgggcatcgcgctcgtgaccgccattatctggatggtcgccggctacggcttcgagttcgccctttccaacgccatctccgtgctggtcatctcctgcccctgcgcgctgggcctggccacgcccgtggccatcatggtcggcaccggcaaggccgccgagttcggcatcctcatcaagagcgccgaggcgctggaaaatctgcacaacgtcgataccatcgtattggacaagaccggcaccatcacctctggccatccctcggtgacggacattgccgtgcttgagcccggccttgccgaaaacgactttctcgtccaggccgcggcggtcgaggccggcagcgaacacccgctggccgaggccgtggtggaaaaggccaaacagcagcgcctcgccgtgcccaaggccgaggccttcagcgccacttccggccgcggcgtgcaggccacgctgaacggcaaggcctacctcgccggcaacgccgccttcctcgccgaaaacggcatcgacaccgcccccgcgagcgcgcagatggagcgcttcgcaagcgagggcaagacgccgctcatcttcgcccgcgagggccgcgtcctcggcattatcgccgtggccgacaccgtgcgcgagaccagccgcgccgccatccgccgcttccgcgcgatgggcctcaacgtggtcatgctcaccggcgacaaccgcaagaccgccgaggccatccgcaaagagttggacatcggcgaggccattgctgacgtgctgcccacgcagaaggaagccgtcattcgccgcctgcaggagcagggccacaaggtggccatggtcggcgacggcatcaacgacgccccggcgctcacccgcgcggacatcggcatcgccatcggcgcgggcacggacatcgccatcgactccgccgacgtcgtgctgatgaaagattcgctggaggacgcggccacggccatcgacttgagccgcgccaccatccgcaacatccacatgaacctcttctgggcgttcttctacaacgtcctcggcatccccgtggccgccggcgcgctcttcccggcctttggcatccgcttgagcccgatgatcggctcggcggcgatgagcttaagctccgtctgcgtggtcaccaacgccctgcgcctgcgcttcttcaagcgccgcgaaagcggggccgtcgatccgtccgccccggccatggaagccggtcagcataccccgggcgacctgcccgcggaagaaacagagaaaggaatggaaacgatggaaaaggtactgcatgttgaaggcatgatgtgcgcgcactgcaaggcgcacgtggaaaaggccctgctgggcgtaaacggcgtcaccgccgccgaggcagacgtggagaacaagcgcgccgtggtccagtacaccggcgaagtctccgacgaagccctcgtcagcgccgtcaaggaagccggttacgaggcgaagatggcgtaa

SEQ ID NO: 1074 - DNA, 513 bp, Unknown
  Artificiall/Consensus sequence
ggcgtgaccattctgggccgtttgcgccgcgacccgcgcttcagcgccatccccgtcatcatgattaccgccaagggcgaggaggccgacaaggtggaggggctggagtgcggcgcggacgactacgtgaccaagccctttggcatgatggagctgatcgcccgcgtcaaggcggtcatccgccgctgcgccgggcgcggcgagggcgttttgacgctgggcggcatccgcctcgaccgcgaaaagcacaccgtggaagccgacgggaaagaggtcgtgctgaccttccgcgagttcgagcttctgtgctacctgatggaacacccggaaaaggccttcgaccgcgaccggctgctggacgaggtctggggcgcggagtacgagggcgggccgcgcacggtggacatgcacgtgcagaccatccgcaaaaagctcggccgttgcgcctcgcagatcgagaccatctacggcctcggctacaagatcggagaggggaatgttcatgcgcagtaa

SEQ ID NO: 1075 - DNA, 2046 bp, Unknown
  Artificiall/Consensus sequence
gaggaactgacgccgcgcatgttctccttcaacaacccctatggcgcctgtcccacctgctccggcctcggcgtgcttttgaagatggaccccaacatggtcatccccgaccgcagcaagtcgctggcgcagggagccattcaggtctccggctggaacagcgccgagccggattccatggcgcagatgtatttaaagggccttgccgacaagtacggcttttcgctggatacgcccgtgtgcgagctttccgacgatattgtcgataaattgctctacggcacccacggcgagaagatccacctcgaatacaagcgcgaggatggcggcggctccttcaacgccccctttgagggcatcgtcaccaacctcgagcgccgctaccgcgagacccattccgacgccatgaaacagatctacgagggctacatggcgcacgtgccctgccccgagtgcggcggcaagcgcctaaagcgcgaggcgctggcggtgacggtgggcggcaagtccatcgccgaggtctcggacatgtccatcgaccgcgcgcgcgcctttcttgccaacgccgagctgaccgagcggcagaagctcatcgccagacaggtcctcaaggagatcgactcccgcctgcgcttcctctcggatgtgggccttgactacctgacgctctcgcgcagcgccggcacgctttccggcggcgaagcgcagcgcatccgtctggccacgcagatcggctcttcgctgatgggcgttttgtacatcctcgacgagccctccatcggcctgcaccagcgcgacaacgcccgcctgctcaagacgctcaagggcctgcgcgatctgggcaacaccttgatcgtcgtcgagcacgacgaggagacgatgcttgccagcgactatatcgtcgatgtcggccccggcgcgggcatccacggcggcgagatcgtcgcctgcggaacacccgcggagatcatggaaagcccgcgctccatcaccggcgcctatctctccggccgccgcaaggtgcccgtgcccgccgcgcggcgcaagcctgcgggctatatcaccgtgcgcggcgcgcgcgcccacaacctgaaaaacatcgacgtgcgcttcccgctcggcgtcatgacctgcgtcaccggcgtttccggcagcggcaagagttcgctggtcaacgagatactcttcaagtccctctcccgccagctcaaccgctcgcgcctgcgcgccggcaaccacgacaccatcgagggcgtggagcagctggacaagatcatcgccatcgaccagtcgcccatcggccgcacgccgcgctccaaccccgccacctacaccggcgtgttcgacctcatccgcgacgtgtttgccgccaccaacgacgcccgcgcccgcggctacaaggccaaccgcttcagcttcaacgtcaagggcggccgctgcgaggcctgttccggcgacggcatccgcaagatcgagatgcacttcctctccgacgtctacgtgccctgcgaggtctgcggcggcaagcgctacaaccgcgaaacgctggaggtgcgctacaagggcaagaacatctacgaagtgctggaaatgaccgtggacgaggcgctggagttcttcgcgccgctgccgcgcatcgccgccaaattgcagactttgcaggatgtcggcctcggctatgtcaagctcggccagccctcgaccacgctctccggcggcgaggcgcagcgcatcaagctggccacggaactttcccgcaaggccacgggccgcaccatctacgtgctggacgagccgaccacgggcctgcacgtggccgacgtggaaaaactcgaccaggtgctcgaccgcctcgccggggcggggaacacgctggtggtcatcgaacacaacctcgacgtcatcaaaacggcggactacatcatcgacatgggccccgagggcggcgaccgcggcggcacggtgatcgccgaggggacgccggaggaggtcgcccagtgcgaggaaagctatacgggcatgttcctcaagaaggttctcaactga

SEQ ID NO: 1076 - DNA, 2565 bp, Unknown
  Artificiall/Consensus sequence
atgaacatggaaaaattcaccaggaaatcgctggaggccatccgcgatgcgcagcaggtggccatcgagcatcagaatatgcagatcgaccagcagcatctgctctacgcgctgaccgcgcagcaggaagggctgatcccgcagctgttcacggcgctgaacatcgagccacagcgcgtgctttccgcctgcgagcgcgagatcgagcgcatccccaaggtgtccggccccggccgcgacccggagaaggtgtacatctcccagagcgtggacgcggcgctcaatgaggccgaaaagcaggccgaacacatgaaggacgagtatgtgtcggtcgaacacatcgtgctggcgctgatggagaagcccaacggcgttttgaagcgcctgttttccgaattggggctgacgcgcgacggtttcctcaagcagttgcaggccgtgcgcggcaacgcccgcgtcaccagcgaccagccggaggatacctacgacgcgctgaagaaattcggcacggatcttaccgaccttgcgcgcaagcagaagctcgacccggtgatcggccgcgacgccgagatccgcaacgtcatccgcatcctttcgcgcaagtcgaagaacaacccggtactcatcggcgagccgggcgtgggcaagaccgccatcgccgaagggctggcgcagcgcatcgtgcgcggcgacgtgcccacttccctgaaggacaggacgcttttctcgctggatatgggcagcctcatcgccggcgccaagtaccgcggcgaatttgaggagcggctcaaggccgtgctggaggaagtgcgcaagagcgagggccggatcatcctcttcatcgacgaattgcacaacatcgtcggcgcgggcaagaccgagggctccatggacgccggcaacctcttaaagccgatgctggcgcgcggcgaattgcactgcgtgggcgcgacgacgctggacgagtaccgcaaatatgtggaaaaggacccggcgctggagcgcaggttccagccggtgatggtcaacgagccgacggtggaggacaccgtggccatcctccgcggcctcaaggagcgctacgaggtgttccacggcgtgaagatcaccgaccaggcgctcatcgccgccgccaaactctccgaccgctacatctccgaccgtttcctgccggacaaggccatcgacctggtggacgaagcctgcgccatgatccgcaccgagatcgactccatgccgcaggagatggacgacatcgcccggcagatcatcgaaaaggagatcgaggaagcggcgctctccaacgacaccgaggcgcgctccaaagagaagcttgccaaggtgcaggaagaacttgccgacatgcgcgacaagttcaaggccatgaaggccaagtgggaattggaaaagcaggacatcggcaaggtgcagaaactgcgcgaggagatcgagcagtgcaacgccgacatcgaacttgcgcagcgcgagtacgaccttaacaaggccgccgaattgcagtacggccgcctgccgcagttgcagaaggaactggaggctgaggagaagaaggccgaggccgcgcagggcaagaacaagcttttgcgcgacaaggtgacggacgaggagatcgcccgcatcgtctcccgctggacgggcatccccgtttccaagctggtcgagggcgagcgcgagaagctgctccggctgcccagcatcctccatcagcgcgtggtcgggcaggacgaggccgtggaaaaggtctccgaggccatcctccgctcgcgcgccggcatacaggaccccaaccggcccatcggctcgttcctcttcctcggccccacgggcgtgggcaagacggaactggccaagacgctggcgcaggcgctgttcgacgacgaaaagaacctcgtgcgcatcgacatgaccgagtacatggagaagcactccgtctcgcgcctggtcggcgcgcctccgggatacgtgggctacgaggagggcggccagctgaccgaggccgtgcgccgcaagccgtacagcgtcatcctctttgacgaagtggaaaaggcgcacccggacgtgttcaacatcctcttgcaggtgctggacgacggccgcatcaccgattcgcagggccggacggtggacttcaagaacaccatcatcatcctcacctcgaatctgggcagcggcattatccttgagggcatcggcccggacggcaagctctccgaggaagcgcgcggggaggtcaacggcctgctcaagcggcagttccgacccgagttcctcaatcgtctggacgagatcgtcttctacacgccgcttacgaaggaacagatcgaaaagatcgccgatctgaccctcgatgcgctcaacaagcgccttgccgagcgcggcgtgaccgtgcggctgaccgacgaagccaaggcgtatgtggtggaaaacggctacgaccccgtgtacggcgcgcgcccgctcaagcgctttatccagcgcgcggtggagacgcccgtggcccgcacgctcgtcgccgaggacgttcccgaggggagcacactggaagtg

SEQ ID NO: 1077 - DNA, 1413 bp, Unknown
  Artificiall/Consensus sequence
atgaacctgcacaagatccgggaggccgccgaaaagcacacctcccgccgcggcgcgttttccgccgcggtcaccgcgctggccgtggcagtggtgctcctcatcaatttgctggcagcccagctgccggagcactggacccaattcgatctcaccgacagcggtatttacgacatctccgccaccacccgggactacatggcggacctggaggaggatgtggtgatccacgttctggcggaccaggacagcctggacacccgcatcgtccgcttcctggccacctatgaagagctcagcagccacctgagcgtggagtataccaaccccatggtgtatccctccgttctcacggactacggtgtggacagcaataccatcgtggtcacctgcgaggccaccggccgtcaggagagcttttcgattgacgacatcatcggatatgatataatgtcttattattactacggttcttataatgagacggattttgacggcgagggacttctgacctccgctgtggacggcgtcctgaccggcgcctcccgcaccatttgccagaccaccggccatgacgaggcggctctctccagcacggtagagacgctgctgtccaaatcccacatctctgtttccagcgtgaacctgctgacggaccacagcatccccgaggactgtgacctgctgctcatcaacgatcccacccgggatctggcggcggacgaactggaggacattctggaatacctcgccgccggcggccaggtgatctataacatggcgggggaggatctgtccctgcccaacctggagacgctctgtgccacctacggcatggatgtggcgccgggcctcatcgccgatacccagcggtattatcagaataatccctactggttcttccccctggtggacaacagcgtggattctgccagcggcatttccaacgatgccacgcttctcttctgcgcgtcccggggcttcaccctgacggatcccgcccgggagagcattaccgtcaagtccttcctcaccacctccgaggagggcatggccgttaccggcgactcggcgaaagaccagacccccggcacctacgtggtggctgccacagccacggaggagatcgacgacgggatcaccggacggctgacggtgttcggctccgactccctcatcaacgacgccatcaactccaccttcaccaatctggataacctgaccctcttcaccagcgcagtcaccgtggacttcgacggcatctcctcgctctccattgagccggtgagtctggagacccccaccaataccatctccaccggaggcatctgggcactgctgctgatcttcctgatccccggtgcccttttgatctacggcttcatccgctggctgcgccgacaaaaactctaa

SEQ ID NO: 1078 - DNA, 1749 bp, Unknown
  Artificiall/Consensus sequence
atggatattttttccgtcttcacactctgcggaggactggccttcttcctatacggaatgaacaccatgtccaagagcctggagaaaatggccggcggcaagctggagcggctgctcaagcgcatgacctccaaccctgtcaagagccttctgctgggcgccggcatcaccatcgccatccagtcctcatccgccatgaccgtgatgctggtgggccttgtgaactccggcgtcatggagctgggccagaccatcggtgtcatcatgggctccaacatcggcaccaccctcaccgcgtggatcctctccctcaccggcatccagagcgagagcatcttcgtgaacatgctcaagccggagaacttttcgcccctggtggccctggcgggcatcatcctcatcatgggatccaaacggcaaaagcgccgggatgtgggccgcatcatggtgggcttttccattttgatgtacggcatggaactcatgagcgacgctgtcagtcccctggcggatatgccggaattttccagcctgctcaccgctttccagaatccgctgctgggcgtgctggtgggtgccgtgtttaccggcatcatccagtcctccgccgcgtccgtgggcattttgcaggctctggcgctgaccggttccatcacctacggcatggccatccccatcatcatgggccagaatatcggcacctgcgtcaccgcgctgctcagctccatcggcgtcaaccgcaatgccaagcgggtggcggtgatccacatctcctttaacgtcatcggcacagtcgtgtgcctggtgctcttctacggcggcaatctgatcttcgacttctccttcatggactggacggtgggtgccgtgggcatcgccttctgccacaccgtattcaatctcttcaccaccctgatgctcctgccgttctcccgccagctggaaaagctggcgcggagactcatccgcacggaaaaccccgccaaggagtttgccttcctggatcccctgctgatccgcacccccagcgtggccatcagcgaatgtgtgtctatggcctgccggatgggagaaaccgcccgggacaatgtgctgctggcaatggagcagctctccggcttcagtgaggagcgggaggcccagatcctggaaaatgaggacaagctggacacttatgaggaccggctgggcagctatctggtggacgtctcccagcacggcgtgtccatggtggacatccgtacggtctcccgcctgctccacgccatcggcgacttcgagcgcatcggcgaccacgccatcaacatccaggattccgcccgggaactgcatgagaaggaactccggttctctcccactgccgaaaaggaacttcaggtgctgggaacagcactggaggacatcctcttccaggccgtctccagtttcaaccaggatgatccggcggccgccaaggcggtggagcccctggaggaaaccatcgaccagctcaccgaggagatccgcatgcgccatatccagcgcctccagaccggtgagtgcaccatccagctgggctttgtgctcaacgacctgctgaccaacctggagcgggtgtccgaccactgctccaacatcgccgtgtgcgtcatcgaggagcgggacagctccgtggaccatcacgcctatctccaccggctgaaggtggatgacaattttgctgaggaattgcgggaggatctgagcaagtaccgcctgcccaatgcctga

SEQ ID NO: 1079 - DNA, 1386 bp, Unknown
  Artificiall/Consensus sequence
atgttcgagcatcaggacacgcagacggatttattggagcagatcgaagatctgattcatgaaaagcgatatgctcagctgcgggatcttctggttcctatggaagcgcccgacatcgcacagctgtgcgcggatctggatgagaagacattgcctctggtgtttcgcctgctgcccaaggagcaggccgcggaggtattcgtggagctggacagcgaccagcaggagatgctgatccagggcttttccaacacaaagctcaaggaagtgctggacgagctgtatctggacgatacggtcgacatcgtcgaggagatgcctgccaatgtggtcaagcggatcctgcgccactccgatccggagacccgaaaaagcatcaatgaaattctcaagtatcccgacgactccaccggcagcatcatgaccacggagtttgtggacttgaaagccaccatgacggtggaggacgccctcaagcgcatccgccggaccggtcccgataaagagaccattaacatctgctacgtgatcgacgatcagcgccatcttctgggacttttgtccatccgcacgctgctgctggcggaggacgacgacatcatcgacgacatcatggagcaccacatcatctctgtccacacattggatgaccaggaatccactgcccgggtcctgagcaagtatgattttctggccctgccagtagtggacacggaaaaccgcctggtgggcatcgtcaccgtagacgacgccatggacgttctgcaggaagaggtcacggaggacatcgaattgatggccgctatcctgcccggcgacaagccctatctcaaaaccggcgttctggagacctggaaggcccggacaccatggctgctggtgctgatgctctcggccacctttaccggcatcatcctgacccactttgaaaacgcactggccgcctgtgctatcctgacctcctttatccccatgctctccggtaccggcggcaacagcggcacccaggcctccacagctgtgatccgtgccctgtctttgggtgagcttcgcttttccgaccttccccgggtcatctggaaggaattccgggtctccatcacctgcggtctgtgccttgcggcggccaacttcgtgaaaatgatggtggtggatcgctggctgatgcataatcctgccgtcacgccgctggtggcactggtggtgtgtaccacgctggtcggcaccgtgatgtgcgccaagctggtgggctgctcgctgccgctgctggccaaaaagctccactttgatccggcggtcatggcctcccccttcatctccaccatcgtggactcgctgtcgctgctgatctatttccgctttgcgtcgctgtttttgggactgtga

SEQ ID NO: 1080 - DNA, 2226 bp, Unknown
  Artificiall/Consensus sequence
atgaaccccaaagatacacgctcccttcgcctgtatgtgctggcaggtcttttgactctggtgctgctggtgttcgcaggcattttgtacaacacgcagatcgtcaaccacgattactacgtggcccagtccatccgcaccatcgcccgggaggagaaggtggaggcctcccggggcgtcatcaccgaccgcagcggccaggtgatggtctccagccgctccacatacagcctcacctttgactccagcctcctcaaggacggcgaggaccccaacgaggccattttgcggctggtccagctgtgccaggccaacggtgtcgcctggaacgacaatctgcccatctcccagcaggccccctacacctataccctggactccatgacggacatcctcaactcccgctttttgaagtacgtcaagtccctcaagcccgccagcgaggccctgggcaattacctgctggagcacccggagatcgtgggcgagagcgccgactccatccccacccttccctcggaggtggaccaggatgacgccgaggctgtggaggccgccaggaaagaggccaaggatcgcgctgaggagcttttggatctgctgaccacggagcagctctccgcccagttgctcacggacgccggcatctccccggagacgctgatggactggatgcgggaagacctggaggtccccgaatcctttacccaggcggaggcccgcatggtgctgggcatccagtatgagctctccgtccggaaagtggtcagcaccaccgcctatgtgatggcggaggacatctccaccggtttcatttcgctgctggcggacggccagtacagcggtgccaaggtcaccgcctcttctgtgcgggaatactccaccacttacgccgcccagatcctgggccgggtcacccagatctatgccaccgacgaagcctatcaggacggcagcctgatggaacagggctacgacatggatgacaagatcggccgctccggcgtggagaaggcctttgaggagtacctccggggcaccgacggcacccgcgtggtctccaccaactccgccggcaaggtcaccggcgagttctattccaagcagccccagcccggcaacaccgtggagctgacgctggacctggacctgcagcaggcggtggaggaaaatctggcggccaccgtggcgcagatgaacgccgaggacggggacgacacccggggcgccggctgcgccatcgtgaaggtgggcaccggtgagatcctggccctggcctcctatcccacctttgatccctccacgtacagcaccaattacgcggagatctccaataatccggcccggccggaatacaaccgggccacccagggcacctacgcccccggctccaccctcaagcccctcaccgccgtggcggcgctggagaccggcaacgtgacgctgacggaaaagatcaacgacaccggcaagtggacctatcccggctctccccagagctacacctactgctgggaccgcagcggccacggccttctgaacgtgacggaggccatcaccaactcctgcaactacttctttgccaccatgggctaccgcatgggcatggataccctggtggagtacctgaaggccttcggcctggggtcccacaccggcatcgagatcggcgacagcaccggcacgctgccggagaaccctcccggtgaggaccaggctccctgggccgccttcggccagtccagccaggcctataccccgctccagctggccaactacatcgccacgctggtctccggcggcgagcactgcgacgcccatctgctcaaggccgtcaagtcctatgacaactccgaagttctgaaagtgggcgacagctccgccaaaaacaccgtctccatcaaggattctacgctggaggcagtcaaggaaggcatgctgggctacacccagcccagcggccagctgtacagctacttccgcaactgtgtggtgaaggccggtgccaagaccggtaccgcccagctgggcggcggccagaccaacaacggcgtttttgtctgcttcgccccctacgacgatccggagatcgccctggccatggtcattgagcacggcaacgccggtgccgccctggcctccaccgccgtcaacatcctcaacgcctatttctccgccgatgacatcggcaccgccgtgatcggcgaaaatcagctgctgcagtaa

SEQ ID NO: 1081 - DNA, 1368 bp, Unknown
  Artificiall/Consensus sequence
atggttaagaacctgacggaaggacagcccctgcggctgctgttcttcttttccctgcccatggtggcgggaaacctctttcagcagctctacaacatggtggataccgccgtggtgggcaaattcgtaggcgaggacgccgtggccgccgtgggctcctccttccccatcgtctttttgtccgtggcggtggccgccggtctctctatgggctgcaacgtggtggtctcccagctcttcggcgccgggcgcatccacgagatgaaatccaccatctccaccgccatcatctctttgagcgtgctgggactgatcctgatggcgctgggcaccatttctgccggaccgctgctggagctgctgggcacggacccggacatcatggccgattcccagacctatctgcggatctatttcggcggtgccgtgttcctcttcctctacaacaccctcaacggcatttacaatgcccagggcgacagcaaaacacctttgatcttcctcatgatctccagcctgaccaacatcgtactggatctgctgttcgtcatccggttccacatgggcgtggccggcgtggcctgggccacgctgattgcccagggcatctgcgccgtggcgtctctcgcggtgctcttcctgcggatgaagcgcctgccctgcgaggccggcaaagagggggaaaagatcccgctcttccacaagatcgccgtcaagcgcatcgcccagatcggtctgccctccatgctgcagcagtctttggtgtccctctccatgatgatgatgcagggcctggtcaattcctacggcaaggtgctggtggccggctacaccgccgccaccaagatcgacacgctggccatgctgcccaacctgaacttctccaacgccatgtccagctacaccgcccagaatatcggcgccggacgctatgaccgggtcaagcagggcctgaaggccagccttttcatggtggtggtgttctccctgctcatcaccgtcatcatcttcctcttcggcgaccagctgctctccctgttcctagatcccggcgacacctccggtgctctgggctgcggtctgacgtacatgcacaccgtctccctgttctatatcctgatgggactgctcttcgtctccaacggcatgctccggggctccggcgacatgggcgccttcaccctcagttccatggccaacctcttctctcgggtggcggtggcctatgccctggcgtatctcacgcctctgggcgccaatgccatctggtggtccatccccgccggctgggccatcggctctgtggtgtccttgctgcgggtcaaaagcggcaagtggatgcgccaagcggtaagtgagcgcatttga

SEQ ID NO: 1082 - DNA, 1722 bp, Unknown
  Artificiall/Consensus sequence
atgatgcagaaaagtcatgacgatcggatgctgtgggcgcagttcgattccctggaaatgggcacgggctgggacgacacggacatcgaaaagccccagatcatggtggagagcgtgtacggcgactctcaccccggcagctggcacctgaaccagctggtggagcaggcggtgtacggcgtgtacgaaaagggcggcaagcctgccaagtactatgccacggacatctgcgacggctgcgcccagggccatgacggcatgaacgtggtgctggcttcccgtgaggcgctggccaacatggtggaggtccacgcctccgcagtgccctgggacggcatgatcctgacgtccagctgcgacaagtccattcccgcccacctgaaggctgcggcccggatggacatccccaccatcttcatgcccggcggctccatgcggcccggccccaacatgaccacgtccctggtggccggcgacatctccctgcgtcagaagcgcaaggacgccatcacgccccaggaagtgcgggattataagctgaccggctgcccgtccgtgggcgcgtgcaccttcctgggcaccgcatccaccatgcagtgcatcgccgaggctctgggcatgacgctgcccggcgcggctctggctcccgccaccatgcgggacatcatccagtacgcccgctatgccggccggaagatcatggagttggtggagaaggacatcaccgccagcaagatcatgacccccgcggcgttcaagaacgccatcatcgtccacagcgccatcggtggctccaccaacgccaccatccatctgccctccatcgcccgggagctgggctatgacctgcccatcgagctcttcgacgagatcaaccatcaggtgccccacctgggcaacatcttcccctccggcgcccagctgacggagtccttctggttcgccggcggcatccccatggtgcagtggatgctgcgggatatgctggatctggacgtgatgaccgtcaccggcaagaccctgggcgagaacctggaggacctgcacaaggacaactggttcgaccggaacctgggctaccttgccaactacggcctgacccgcgaccaggtgatcttcccggtggagaaggctcccgagaagggctctgtggccatcctgaagggcaacatcgctcccgagggctctgtgctcaagtactccgcctgcgccatgaaccagcgggaagtggtcaacgccaaggcccgggtgttcaaccacgaggaggacgcccacgatgccgtggtgaacaatgagatcaatcccggcgaagtcgtcatcatccgctatgagggcccccgcggctgcggtatgcccgagatgctgatgaccaccgaggccatctgctgcgacgagcggatcaacggctccgtggcactgatcaccgacggccggttctccggtgccacccgcggcgccgccatcggccatgtcagccccgaggctgctgccggcggccccatcgcattcctggaggacggcgacctgatctcttacagcgtggagaaccgtaccatcaacatgacgggtatccacggcgtgccctgcacggtggaagaggctacggcagagctggccaagcgcgctgagaagggcatcctgccccgcgagaagcgcaagggcttctataagctctacaccgatcgtgccctctctgccatgaagggcgccggcctggaataa

SEQ ID NO: 1083 - DNA, 3573 bp, Unknown
  Artificiall/Consensus sequence
atgaaaggtatgtggaaaaaacgcctgtcagcatttttgctgactctggctctgacagcaagcctgatccccgccgccgcggctgaggagcaccattatgcctcggcctggtccagcgacggatcctatcactggcacgtctgcaccgatcaggactgtgacgcccggggagactatgagccccacgacttcggcgccaccgtcaccaccaagtcccccacctgcttccagcccggtgaggggtatcaggagtgcaccgtgtgcaagtacaaaaagacggtgtccatccccgccaccaacgcccacaaggcggcttccggctggacctgggacaccgccaagcactggcacgcctgcaccgccacctccggctgcccgcagcatctcagcgaggccagccacacctttacctccggcgagtattccaacaattccagttcccactggcagatctgcaccatctgcggcggcacgtctgccaaggcttcccataccgacgccaacggcgacggcgtgtgtgacgtgtgccaccggggcggcatgccggtgaccaaccggatcaccgtcacctttatgaacggctccagcacatacagcacccagaccatcaccaagggctctacgccctccaaccccggcacgccctccaagtccgagagcggcaagacttactccttcgtgggctggtccacttccaaccccggcagctccgcgatctatgacgggcagagctacaagagttcttcccaggtggccagcaccgccctgagcgccaacaccacctattacgccctttacaacgtgcgctccaacaacaccattacgtattccgtcaaggccggcaagagcgtctccttcgaccgcaccgatttccgggatgtttatgagaacgaattctcttccggctccctgcgctgggtggaattcgagaccgacgacaccctctcctcctcccgcggcaccatctattatgattacggcggcagcgacgagaaggctttcagcagaagctctctggaagacgagcggttttattacagctccggcgacggcgactacgatctgaacaacctgagctttgtggccggtgacgagtcccgcaccgtcacgttggacttccgtgcctgctactccagctccaagtacgccgagggcaccttgatcatcgaggtggaaggcggctccagcagctcccacaccatcacctataaggtggataccgacgatgtggtggaattcgaccgccgggacttcaacgacgtgttccagcaggagtacagcaactacaccgtcaagtacgtcaccttcgagaccgacgacaccctctcctcctcccgcggcaccgtttattacgattatgaaggcagtgacgagaagtccttctccgccagcagcctggaggatgagcggttctattacagctccagtgacggcgactacgacctcaacagcctgagctttgtctccggcagcagcgagcgcaccgtcacgctggacttccgggcctattactccagcagccgctatgtggacggcacggtgaagatcctggtgggagacagcgccgacgacggcgacatcacctacgaggtggatcccggcgaggaagtctcctttgaccgggaggatttcaacgacttcttccaggaggagtacgaggactacgacatccggttcgtcaccttcgaaacggacgacaccctctccagctccaaatccggcctcgtgtattttgactacgacggcaaaaacgagaaatccttctccgacagcaccatcgacgactatgagttctactacaaagacagcgactacggcaaatacgccctggatgatctgagctttgtggccggcgataactttgacaaggccgtcacgctgcactttaccgcctactactccgacagccgctccgtggagggcgatctggtcatccgtcccaccggctccggcacgtcccagaagaccggcgacatcacctaccaggtggacaagaacggcgaggctgcctttgaccgggacgatttcagcgacttcttcgacgatgagtatgacggcgactacgagctgcggtatgtcacctttgagaccgacgataccctctccaactccaagtccggcctcatctacttcgactatgacggcaaagacgaaaagtccttcaccgacagcaccatcgacgactacgacttctattataaggacagtgaatacggcaagtacgctctggacgagctgaccttcgtggccggcgacaactttgacaaggccgtcacgctgcgcttcaccgcctactactccagcagccgccacgtggaaggcacgctggtcatcaacccctccggcacgtccgagaccggcgacagccagggcgacatccgctattacgccacttacaccaccaatgtccagatcaacgccaacgacatcgcccgcttcttcaacaagaagtatcccacgtccacgctgcagtacgtgacgctcaaggacgtgccctccaccggcagcctgtactataactactacggcgtcagcaagtacggtacttccaagctgaagctgaccagctccaactgcggcagctacaacctgtacttcagccccagctccaccagccagtacgctctgacggagctgacgtacctgcccagcggcaccaactactgcgcacagatccccttcaccgcctacggcagcggctccaagtccctgtccggcaccattctcatcagcgtgaacctctccgccgtgtcggaggtctacggcgtcacgcccaagggcaccgccgtcaccttcccggcctcggccatgtacattgcggtctccagtgccagcggccagggcctgagcagcatccagctgctggaactgcctgacagctccgtgggtaccatctacgtgggcaccggcacttccaccaaggccaacacctccacccggtacggctactccagcggcagccagcggatggggcagctgcgcttcgttcccgccagcggcttcaccggctccgtggagatcccctatgtggcctgcaacagcagcggcacccccatcgccgccggcaagttcagcctgggcgtggtgtccaacgtgaagaagttcagcgacatgacttcctccacctggtgctataagtacgtggtggagctcagcgatgccggcgtcatcgacggctataccgacggctccttcaagcccgacaacaccgtcacctacggcgcggccctgaagctcatcatgctggcggcgggctatcccgagcagaagcccaccgattccaaccccttcagcggatacctggccaaggcccgctccgagggcatcatcacccgcagcaacgtgaatctctccgctcccatcacccgtctgcaggtggcccagatcgccgcaggtgccctgaagctggacaccaccaatctctccagcgtccagcccttcacggataccacggatccctccgttcaggccctgaacgcggccggtattgtggaaggatacttctccggcggcaagagcacttataagcccaacaacaccctgacccgcggtcaggtctccgccatcgtctgg

SEQ ID NO: 1084 - DNA, 1941 bp, Unknown
  Artificiall/Consensus sequence
atgagctattcagtacaaaacattcgtaacgtctgtctgctgggccacagtggcagcggcaagaccgccctggcagagagtcttctgtatatgaccggcgccatcgaccggatgggccgcagcgctgatggaaataccgtctgcgattatgatcctgaggagacgaagcgtcagatctccatctccaccgctgtggcgcccctggagtacaagggctgccgcatcaatgtgctggatacgccgggcgcgtttgatttttccggtgaggtgatggaggccctgcgggccgccgacgccgccgtgatcgtctgctccgccaaggacggcatttccgtgggcctggaaaaggcatggaaatactgcgaggagcggaatatgccccgctttgtatacatctccaagacggatgaggacaacagcgactacaacgccaccttcgatgcgctgcgggagcgtttcggcaagaagatcgcccccatcgtagtgcccatctgggacgagaacaagaaggtcaccggcatcatcgacgtgctcaataagcgtgccttcgagatgcaggatctcaagcgggtggagatcgaggtgcctgaggataaagcctccgtcatcaccgagttcaacgacgccctcaaagagtccgtggccgagacgtccgaggcctttatggacaagttcttctccggtgaggactttacctacgccgagatgatccagggcctgcgccagggcgtgcgggagctgagcctgttccccgtgctgtgcggctccgccgtcagctgcatgggctctttgatgctgatggacaacatcgtggacctgctgcccaaccccatggagggcaactaccacaaggctacccgtaccgatggcgagaccgaggagttcgtggtctctcccggcggcgtgcctacggcctttgtctttaagaccgtctccgaccagtatggcaagtattctttcgtgaaggtgctctccggcgccatcacgcccgacatgtctatggtcaatgcccgcaccggcgtcacggaaaagctgggccgcctgtatgtgatgcggggcaagaaggcaacggaagtcaaagagctgggctgcggcgacatcggcgccattgccaagatggaaaaggtcaagaccggcgatacgctgtgcgacgcccgtaaggtcgtggcgctgaagaatatccccttcgctgagccctgctactctgtggccatcgtgcccaagacccggggccaggaggacaagatcgcccagggcctgagccggatgaacgaggaggacccctccttcacggtcaccaacaacgccgagacccatcagatggtgctctccggtgccggcgatatgcaggtggacgtgctggtttccaagctcaagagccgcttcaacgtggaagccgagctcaagcccgtccgtgtcccctatcgtgagaagatccgcaagaccgtccagaagcagggccgccataagaagcagaccggcggcagcggccagttcggcgacgtgtggatccgcttcgagcccaatcccgaaagcgaggaaatggtcttcgccgaagaggtgttcggcggcgctgtgcccaagaacttcttcccggcggtggaaaagggcctgcgggaggcctgcgtccatggacctctggcggggtatcccgtggtgaacctgaaagccgtgctgtatgatggttcctatcatcccgtggactcctctgaaatcgccttcaagaccgccgcacagctggcctacaaggctgctatgccggaggccaaccccgtgctgctggagcctgtgggcgagctgaaggtcaccgtgcccgacagctacatgggcgatgtgatcggcgatctgaacaagcgccggggccgtgttatgggtatggatcccaccggtgacggcagccaggtgatcaccgctgaagtacctatggctgagatggggagc

SEQ ID NO: 1085 - DNA, 1521 bp, Unknown
  Artificiall/Consensus sequence
atgcgcccttttgttgaaaacctgcccttcttgtgtattttcctggcgattttgacgggcatcgtctcggccgtgatcccccggggccgtgtgtgctactggatgacggtgacggtggcgggcatcatcgcggtgctctccgctgtggtactgcaatatacctatggcggtaatctcagctttacatacagcatgggccgctttgcggccccctatggaaacgcgatccagtgcggaccgctgcaggcgctgctggccatggtgttttccgtggtgcttgcgctggcgctggcaggcggaaagcgggatcttttccacgatgtgctgccgggcaagctgcggctgtacttcaccatggtgaacctgctggaggcatcgctgctggccctggtctacaccaacgacgtctttaccggatatgtgttcatcgagatcagcaccatcgccgcctgtgcactggtgatggccaaggacaacggtcccaatctgatcgccaccatccggtacttatttatgagccttctgggctcgggattgttcctcatcggactgacgctgctcaacagcatcaccggctacctcctgatgccctcccttgcccaggcggtggcggagctggcagagagcggtgattaccggatcccgctgacggtggcggtggggctgatcatcggaggacttggcatcaaaagcgccatgttccccttccacctttggctgccggatgcccacggcggcgccaccacggcatcttcagccatgctctcgggcctggtgctcaagggatacatcgtgctgatgatcaccatgatgatgcgggtgttctccatggagctgatgggagagctgggcgtgacaaacgtgattttggcctttggccttctgggcatgatcctggggtctttggaggccatgcgggaataccacgtcaaacggatgctggcctactcctctgttgcccagatcggctatatcttcatgggcctgggcctggggacgaccgcgggtgtggtggcgtcctgcttccacatcctggtccacgcctgctgcaagccgctgcttttttgctgcgccgggcgtctgtctgcggtcagcggccatcacaagagcctcaagaacctgcggggcagtgcctatcgggacgtgagcgccggcctgggctttacggtaggcgccctttccatgatcggtatcccgctcttcggcggatttgtctccaagctgtatttggccaacgcggcgctgcccaccaaccggacggtgctggcgctggtgaccctggcgctgtccacagtgctcaacgcactttactatgtgccggcgctgctggccatctgggtgcggccgccggcggaagcggagcagcacgttctggaggataccaggccggaggatctggcctttgaccgctcctttaccactgcggcgattgcgctgatggcgggaatttttgtgctgggcattttctatcaccccattactgatgtgctcgaggcgggaatcgccttgatgggaacttga

SEQ ID NO: 1086 - DNA, 2421 bp, Unknown
  Artificiall/Consensus sequence
atggcaaatttacccagacgaaagacggacgccgcccggcgggccaatcagatcatccggacccggacggtgctggtcatggcgctgctgggtgttgttaccttcggggcgctgtttttgaagctcttcgacctgcagatccgtcagcacgacgaactgcaggaaaaggctgtggcccagcagacccgaagcaccgtcatcaccgcgtcccggggcacgatctacgaccggaacgggcatcctctggcggtgtccgctacggcggaaaacgtgttcgtggatcccaagggactgcagcagtatctggaggagcaggcggagcagggcaacacggaggtccgggacgccgaatacatcgcacggggcctgagccgtatcctggaagtggatgaggagaccatcctggagaagatggaaaaaaccagctccgcctacgagatcgtgaaaaagcgggtggaccaggaagtcgccgatgaggtgcgcaagttcatcaacggtgagatcgacgatgagggcaaccagctgacgaccgtcaacgacgatggagagaccgtgctgatctccgacccggataagagccccgtgcgggtccacggtgtgtacatggagccggactccaagcggtattatcccaacggcaccctggcggccaatgtgctgggctttgtcaacaatgacaatgtgggcggtgtgggcctggaggccaagtacgacagcgttcttcagggcaccgcgggccttaccattaccgcccgggacaacaacggcaacgacatgctctatcagtatgagcagtactatgatgcggaaaacggcaacagcctggtgctgacgctggaccggggcgtccaggcggctttggaaaagggcctttccagcatgatcaccaagttcgacgccgccaagggcggcacgggtatcatcatggacgtcaacagcggtgccatcctggccatggcgtcctaccctacttatgatcccaattcttatggtacgctgtacgatgaaaagctccagtcccagctggacagtcagctggcggagctggcccagaaccgggccgactatgagacggaggaggactaccaggcagctgtctctgcggccaagagttccgttttgagttctcagtggcgcaacaagtgcatcgattccacctatgagcccggctccaccttcaagcccatcactctggccacagccctggaagagggcgtggtggatatgaacaccaccttcaactgcaccggctccatcacggtccagggctggggacggcccatcaactgctccaagcgggccggccacgggctccagaccctgaaggtggccaccggaaactcctgcaacccggccttcgtcaccatgggcctgaagatcggcacggagacctattataagtacctcaagtccttcggcctgatggaaaagaccggcgtggacatgatcggcgaggtggcaggcattttcgccgatgaggaaagcttcaactccaacgtggtctccctggcgtcctatgccttcggccagaccttcaatgtcacgcccctggagctgatccgtgcccaggcggccaccatcaacggcggctatctgtataccccctatgtggtggagcaggtgctggacgacagcggcgccgtggtggaacagcatgagtccgtgcctgtccgccaggtcatcagcgaggagacctccgccaaggtgcgggagtgcctggagtgggtcgtctctgacggcggcggccgcaacggccaggtggccggctaccgcatcggcgggaagaccggtaccgccgataagaccggcaccaacgacgtagtggtctccttcatgtgctttgccccggcggatgatcctcagatcatcatgctgctgacgatggatacccccagccgtaccaccggcaccgccgtgttcggcggcaccatggtggcgcccaccgcaagctccatcatgagcgaggtgctgccgtatctgggcatcgagccggagtacaccgctgaagagctggccggcgccgacaccaccgtgcccaatgtagtgggcatgacgctggaggacgccaagacccggctgagcaacgcgggctttgcctgcaccaccgtaggcgacggtgccaccgtcaccgatcagacccctgccggcggcgccatcgtgcccaataacgcctccatcatcttgtatctgggagcggaaaagccggatacgccctgcactgtgcccaacgtggtgggcaagtccgcctcggaggccaataaggccctcaccaacgcgggactcatcatgcgggcctccggcgccaccacatccagttccggaaacgttcacgccatcacacaggatgtctccgccggaacacaggtccaggcaggcaccgtggtcaccgttcagttcggcgacaactccgtgctggactga

SEQ ID NO: 1087 - DNA, 1515 bp, Unknown
  Artificiall/Consensus sequence
gtggcgggcgggaacgcgaaaaagccccgggagaaaaaagcgaaaaaacccagccgtctgacacggcagcagaagatcctgatagtggtggcggtgctgctggcactggtgctggccgtggtagtggcctgccagagcctgtttgtcaagccggatctggagacgaagaagccggagacggaggaagaagagctggactatggagacggtgtgcgtccccgcagtgatggcgagcgtaagagtgaagacttttacacggtcctgatcctgggccgggacaccggcggcggcggaaatacagacaccatgctcctggcctcttatgacgtgaccaaccagaaggccactgtcatgtccattccccgggataccatggtcaatgtcaactgggacgtgaagaagatcaactccgtctacaacatgaacggcggcggagacaagggaatcaaggccctgtatcaggagatctcccagctggtgggcttcgagcctgattaccaggtggtcgtggagtgggaagccgtgggcgagatcgtggacgccatgggcggcgtgtacttcgacgttccccgggacatggattatgaggacccctatcaggatctctccatccatatcaagaagggataccagaagctcaacggtgagcaggccatgggggtcatccggttccgggacggcgtcaatggatacagcaacggcgacatcggacggatcgagacccagcaggcctttttgaaggctgtgctggagcagatgcttcagatccagaacatgaccaaaatcaaccagtttgccaaggtgttccaggagaacgttaccacagacctctctttccagaacatcttgtggtttgcgcagaaggcgatcctgggcggactgaaggtggagaacgtgaactttgtcaccatgccttataagggcgtgtccgcctggagccgctattatcagcagaatctgtcttatgtggtgccggtggcggatgagctgctggagctggtgaacaatgaactcagccccttcaaagaggtctttacgctcagtgatctggacatcatgtatgtcaactccgacggctctatcggttccaccacaggccatgtggaggactccaaggccgccaagccgccggtgaaaaactccggcagttccaccaccacaacgacacccgatcccgacacggagacggtgaccgatcccaacggcactgtcacgacgccggaaaccggtgagaccggaagcgagaccggcaatcaaggcagcacagggactggcgatcaaactggcggcgagaccggcagccagaccggcaacgagggcggcacgcagaccggcgatccgtccggtgagaccggaagcgagaccgggaatgagggcaatgcccagactggcagtgagagcggcagcgaaagcggtgcccagaccggcggcgaaaccggttccggggaatccacatcccccgaagtcccttcggagccggatatttccatcatcgagccggctcccaccgaataa

SEQ ID NO: 1088 - DNA, 1695 bp, Unknown
  Artificiall/Consensus sequence
atgtctgaagtcaaggatctggaaaatgagaccctgtcccaggcggaacccgtcttgccggatactgcggaaaagactgtgccgacatcccaaggggtaaagggaaagtggaaaaatatgccccgccagaagcggcgccgcatgatccgccgggtcattgcactggtagtggtgcttgcggtcgttgtgggactcatcaaggtattcggcggcaaaaaaacggacgatacgcagatcgtgacggataccgtacaatacggttccatcacctccaccgtagagggcaacggattgaccaaagcgaaaaagagcgagaccatcacgctcactacggcaggaaccgtgacggacgtcatggtgacggagggccagaaggtcaccgccggaacaccgctgttcacggtggattctgaggccgcccgcaccgccgtgcagaaagcccggaaggacgtggagggatatgagaagcagctcaataccctgcaaaaggacatcgcaggactgaacctggcggccggataccccggcaagctgatggacgtggtgacgctcaatcccggcgacaccatcaacaagggcgacaaggtagccaccctctcggatgacacgcgcctgcggctggagcagtattacagctatgcctatgccggcgacatcaaggtcgggcagaccgtgcaggtgtccattccctcgctgatgagcacgatccccggtactgtggaagaggtccatatggtcagccgcatcacgccggaggggtccaagctcttctccgcggagatcgtggtgaaaaatgagggcgccctgacggcggatatggcggcttccgccaccgttgccgtcaacggcgagaccgtctatccctatgaagcggggaaactggcgtattaccgcaccggagatctcacttccacggtcagcggcacggtgatctccagcagtctggtgaattatctgcaggtcaccgccggacaggtgctggtgcggattgacggcgagagcagcgagagcgagatcttcacggtgcagcagaatctggaagaggcccgcaagacgctggatactgcccagaagaatctggacaactgcaacgccgtggcaccgattgacggcacggtgatcggtcttgccattcagcccggttcggagctggaggccaataccactgtgatcaccattgcggatacctccaccatcgtggtggatgccaccgtggatgagcggaatgtgtcctatgtcaaacccggtatgtcggtggagatcgaccagtggggaaccaccttctatggcaccgtggatacggtgagcctgaactccaaggcggaaaacggtgtggccagctatcccatggtcatcagtgtggacaatccggatgggacgctgatgaccggcagctatgtcaactacaagctcactgccagtgagaatgacaactgcctggtcctgcccatccagtgcatcaaatccgtgcctctggaggatggaaccgccgcagacgtggtgtttgtcaagtccggcagccgtccggaaaacgccattgacatcaccaccacagtggagggcgtccccagcagcggcttctggcccgtgccggtggagacaggcatctcggatgactacaacgtggagatcaagtccggtgtggaggagggaatggaggtctttaccaccgcccccaccaccggaacctggtaa

SEQ ID NO: 1089 - DNA, 1947 bp, Unknown
  Artificiall/Consensus sequence
atggaaatgaagaagagagtcctgaccggtgctctgtgcggtgcactgctggtagggacggtggttcccgcgctggctgccaccgagcactacaacaacggtgcctctgtgggcggcagcgccgagtggaccgcctggacccaggactgggagagcgtggccacggattacaccaaggtgtccctgacccccggcgctgacgagacggagctgaactttgcctggtacagcaaggacgacggcaaggcagccacccccgtggtccacttcggcacggaccggaacaatctcaagacctttaccggcaaggctgccgatgtggacgcctccctgaccgacggtgtggcctatgactacaaccatgtcaccgtcaccggactgaaggagaacaccacctattactacacggtggagaaaaacggtgtccagtccgacgtggagacctaccagacccgcagcttctccacggtgaagatgctctatgtgggcgatccccagatcggcgcctccaagggccagccccagggcggcgagacgctggcggctgacagcggcgccgccaataccgcggcccggaacgacgccttcggctggaaccggacgctggaggctgctctggcacaggaccccgatgtgagcttcatcatttccgccggcgaccaggtcaacaagaccggcaagcccaaggaggaggagtacgccggctatctcagccccgaggcactgacgtctctccccgttgccaccaccatcggcaaccatgactccctgaacgccgactattcctaccacttcaataaccccaacgccacggattacggcaccacccaggccggcggcgactactattactcctatggcgacgggctgttcatcgtgctcaacaccaacaactataacgtggctgagcacaagcaggccattgctgaggccattgcctccgatcccgacgccgcctggcgtattgtcaccatccatcaggacatctacggcagcggcctggatcactccgacaccgacggcatgatcctgcggacccagctgacccccatctttgatcagtacgacatcgacgtggtgctccagggccacgaccacacttacagccgctccaagctgctctacggcgacgggcagacccacggcgcctacgagttccagctcaacgccgacggcagcgactacgactgggatcacgcctacaacaccaccaacaacacccagatccccctgtcccccgctgacggcgacactgccggcgaggccctgctgaacaacttccaggccgacaacaagtgctacaccatcgagacggctgtgggcaacaccgtcaccaaccccaacggcacgctgtacatgaccgcaaactccgcctccggctccaagtactatgagctgatctccacccagcaggactacatcgccgagcgcagccagaactggctgcccagctggtccgtcatcaccctcagcgagacctccttctccattgacacctatcagctgaccgccgacggcaagacggagaagatcgactccaccttcaccatcaacaagaccggcgacggcgagagcctcaccgctcccctgacccgcgcccaggcggtccagcgcctgtatgacgctgccggccgtcccgccgtctccaccgccgcaggctttgcggatgtgtccgccgacgcctcctatctgaaggccgtggcctgggccaaggcgcagggcatcgtcaagggtgtcaccggtaccgccttccagcccgatgagaccatcacccaggcccagttcgcggccatgctgacccgctatgccgccgtcaagggcaaggccggtgcctccgtcagcgccacgcccgcccagggcctgagctatgccaagagcaacggtctgctgaccggcactgccgtcaccgcctctactgcggattacgccctgaccaagctgggctga

SEQ ID NO: 1090 - DNA, 1155 bp, Unknown
  Artificiall/Consensus sequence
atggaatatacggaaggcgtgcggtttgacagcctgggactgtcaccggaaattatgcgcgcgatcgaaaaacggaatattaccgtgtccacgccggtccaggcgggctgcatcccccccatgatggactggcaggacgtgattgccaaggcccccaccggcaccggcaagacgtttgcctacggcatccccgttgtggagcatgtggacccggaggatgagagcgttcaggcggtgatcctggcccccacccgggagctggccattcagatcacggacgagatccgggacttggcggcgttcaagcctggtgtacgcacggtgtgtctctacggcggccagcccattggccggcagatcgacacgctgaaaaagcggccccagatcgtggtggcgactccggggcgcctcagcgaccacatgaagcgccgcaccgttcgggtggacacggtgcggaccgtggtgctggacgaggcggaccggatgctggacatgggcttcatccatgatgtgacccgcctgttggacaagatggccaatcgcaaaaacctgggcctcttctctgccaccatctcccgggaggtcatggacatcgcctgggtctaccagcgggatgccgcagagatcaccgttcgggaggacgagcagaacaagcccgacatcaagcagttccgtatggacgtctccttcaacggtaaggcggatgccatcgtcaagatcctggaggagaccggctttgaccgctgcatggctttctgcaacaccaagggctctacggagcggatcaccaagttcctgcagatgcagggcattgacgctgcctgcatccacggtgacatcccccagaaaaagcgggaggaggtcatggagcgtttccgtcagggcaagctccgggtattcgtctccaccgacgtggcggcccggggcatcgacgtggacgacgtggacatcgtgttcaactgtgatgtgcccgatgaaaaccaggactacgtccaccgcatcggccgtaccggccgggccaagcgccagggtgtggcggtgacgttcgtggcggactatccctccaaaatgcggatcgacgacattgcgcagaagacccgcaacgagatccgggaagtgcggttcgatgaaaacggccatttggcccaagtgtga

SEQ ID NO: 1091 - DNA, 1332 bp, Unknown
  Artificiall/Consensus sequence
gtgatccaaacgattcgcaaagcgtggggcatccccgagctgcggaagaagatcatctttacactcctcatcctgctgatcttccggatcggcaatgctatcaccgtcccctacgtggacgtgacggctctgaaggcccagctgaacgccttcggcggctctattctgagcctgtacgatgtgatgtccggcggtgctttctctaccgcgactgtctttgccctgagcattcagccctatatcaacagctccatcatcatccagctgctgactgtggccatccccgctctggagcggctggcgaaggacggcggcgaagagggccggaagaagatccagtccatcacccgctatacgaccgtggccatcgcgatcctgcagggcttcggctactatatgatgatgcagcgctacaacctgctggccgtcagcgagcctaccatttggcacgcgctggtcatcatcgtctccttcatcgcaggttcttccttcgtgatgtggatgggcgagcaggtgaccgagttcggtatcggcaacggtatctccattatcctgtttgccggcatcctctcccgggtgcccaacatgatctccggcatgatttccggcgtccgctactggactgccgccaatgccggcacggagctgcctgagaatgtggctcccctgcatcccgcgctgatccccgtgatcgtgatcggtgcactggctctgatggtgttcgtcgtgttcatcaacgacgccgagcgccgcatcccggtccagtacgccaagcgtcaggtgggccggaagatgtatggtggccagagcacgcatctgcccatgaaggtgaatatgtccggcgttctgcccatcatcttcgcccagagcattgcctctttgcccatcaccatctggagcttcatcggcattcctgaggacggcacggtttcccgtaccatttacgatgccattgacacccagtccatcatctatatggtggtgtatttcgtgatgatcattggcttcagctatttctactccacgatccagttcaatcccattgagatcgccaacaacctgaagaagcagggcggcttcatcccgggcttccgtcccggcaagcccactgtggatttcatccgcaaggtcctgaacaagatcacgctgttcggcgccatctatctgggtatcgtggccctgtgccccatcctgctgggtaagatcgtggatcatgcctatctgtccatcggtggtacgtctgtcatcatcgttgtgggcgtcgcactggaaacggtgaaggcgctggaatcccagatgctgatgcgtcagtacaagggcttcctggaataa

SEQ ID NO: 1092 - DNA, 1548 bp, Unknown
  Artificiall/Consensus sequence
atgaaagtaccgttcaagcgtattctggcagcggcggccattccgcttctgctattgaccggatgcaaaaacagcgggcctgtcagcagtctgcagccatcggaggattcccaggaggaagagtccgaaaacacccgggtggtcctgccggacaattttactctgccgtatgaacccaatcaaacgctggacccggtcacctgtccggacggggtgcagcagaccgtagggtccttgctctacgagggtctctttcggctggatgaaacgctgacgccccaaccgtggctgtgtacgtcttaccagtatgaccctgccacatatacctacaccttcaccctccgcagcggtgttttgttttctgatggttccgcattcaccgctgctgacgcggcagccacactgcgccgggccatgaattccgaccgctaccggacccggctttatcaggtcaccgatgtctccggaagcggcagcactctgacggtggtcctctccggtcccaacacctccttccctgccctgctggatattcccatcgtcaaggccggcacggagacctccctcacgcccatcgggaccggcccctaccagtttacctccggagagtccagcagccgcctgacggtcaatcccaactggtggaacggcggaacactgccggtccagcagatctttctctccgccgcagaggatcgggatacgctgctctatcagttctcctcccatgacatccagctgctcactgcagatctcaccggtacggatcccatcaccgccaccggcaacaccagctttcaggatgtggacaccacggttttgcagtatgttggaatcaacgtcaaccgtgccccctttgacaacgctgccctgcgcaaggcgctgaacctgggaatcaaccgggcctccctgatcagcgcgtttttgtccggtcacggctctgcggcgcagttcccggtctctccggtgtcccccctctatcccagtgaactggagtccgtctattcctacgatgcctttgcatctgccatgtccgccgcgggatataacaccggcagttccagccgtacagtcaaattgctggtcaatgaggagaatagtttcaaggtctccatcgccaattatctggctgaatcgctgtctgtctttgatttgaagatcgaggtggaaaccctaccctgggatgagtatatcgctgcactgagcgcaggaaattttgatctctattacggagaggtgaagctgactgcggactggaatcttatccgccttctgggtacctccggctcgctgaattacggccgctggtccgatgcccagaccgatcagcttcttgccgcctatgcttcctctacggaccaggctgctgccatgaagaccctgtgcgcctacttgcaggagcagtctcccattctgccggtatgctttaaatccaattcggtcctctatcagaccggtgtggtagaaaatctctcccccaccatgacagagcccttttataatctttcaaattgcatcatccatctcaaatccaattccatcacataa

SEQ ID NO: 1093 - DNA, 1764 bp, Unknown
  Artificiall/Consensus sequence
atgttgaaaacgctttggccacatgcgcggccatattccaagtggatctgtctcggcgtgctgtgcagcgcggcagaggcggtgtttgagctgctgattccactggtcatgagtgatattgtggatattggcatcgcaaacggcgatcaggactttattctgcgcaagggcatccagatggtcatcatggccatggtgtctttgtgcttcggcctgggcgcggcggcctgctcttccatcgcaggcatgggcttcggcgccaatttgcggacggcggagtatgaccatatccaggattatgccttctccaacatcgagaagttctccaccgcttcgctggtgacccggctcaccaacgatgtcaacaacctgcagatgacgctgatgtttgccatgcgtctgctggtgcgggcaccggtgatgctggtggcggcgctgtttttgtctgtgcgcatcagctatcagctcagcaatgtttttttggtggcattgccggtgctgatcgtgtcggtggtactgatccttaccaaggcaagcccccgcttccgggccatgcaggaaaagaccgatgcgctgaacctggtggtccaggagaacctgacggggatccgggtggtcaagtcctttgtgaaggaggaccacgagcgggagaagtttgccaagagaaatctggacctgaagtccaacgctgaaaaggctttcggtatggtggtcatcaacatgcccatcatgatgctcattgtttacggcaccatcattgccgtcatgtggttcggcggccagatggtgtatgccggttctctggaggccggcaagctcatcacgttcttcacctacattacccagatcatgatgtctcttatgatggtctccatgatcttcatgatgatgacccggtccattgcctgcgcccgccggatcgcggaggtgctgcgggagaagcccgccaccaccaatgacgacgccaagatggataccggcgccgacggcagcaagacgcctgctgaggtaaagaacggcagcatcgacttcgaccatgtttccttcaaatatgacctcacaagccccgagtggattctgcgggatgtggatctgcacatccgctccggccagacagtgggcatcctgggcggtaccggctccgccaagaccaccctggtgtccctgatcccccgtctttacgaggccagtgagggcactgtcaaagtgggcggccgccctgtggcggactacaccatggagcatctgcgggacgcagtgagcgtggtgctgcagaagaacaccctcttttccggtaccatccgggaaaacctcctctggggcgatccccatgccacggaggagcagctgtgggcggcctgccgggcggcctgtgccgatgagtttttggagcggatgccagacggactggacacggacctgggccagggcggcgtcaacgtctccggcggccagaagcagcgtctgtgcattgcccgggccattttgaagcagcccaaggtgctgatcctggacgattccaccagcgcggtggataccgccacggacgctaagatccgcaaggcctttgccaatgaactgggggacaccaccaagatcatcatcgcccagcgggtgacctccatctgcgaggcggatctgatcctggtgatggacggcggccggatcgtggcccagggcacccacgacgaattgatgaacagctgtgacatttaccgcgaggtctatcagtctcagcaggaaggagtgagcatcggtggctga

SEQ ID NO: 1094 - DNA, 1728 bp, Unknown
  Artificiall/Consensus sequence
atggacttcatgaaagaatacgaaaagtggctggcaagccccgctctgtctcaggaggagcacgcagagctggaatccatccgcagcgaccccaaggagatcgaatcccgcttctatggccctctggaatttggcaccgcaggtctccggggcaccatggccgtcggcctgcataacatgaacatccatgtgatccgctgggccacccaaggttttgcggatgtcatctctgccgagggggaagaaggcaagcgccggggcgtggccatctgcatggactgccgcaaccactccatggagtttgcccgggccgccgcagaggtctgcgccgccaacggcatccatgtccgcatctttgagtccctgcgccccacacccgagctgagctttgccgtgcgggagtatcactgccaggcgggaatcaatgtcaccgccagccacaaccccaaggaatacaacggctataaggtctactgggaggatggtgcccaactgccgccccaccatgccgacgccatcgccaaacgtctggaagagatcgacgtatttgccggcgtaaagtccatggactacgacgaggcggtgaaggccggtctgatcgaagtgctgggcgaggagacggaccagcggtttatggccaatgtcacctccatgatcaacgacaaagagacggtagccaaggtggcagataccttcaagctggtgtacacgcccttccatggctgcggctacaagctggtaccggaggcgctgcgggctctgggcatcaagcacctgatctgcgaacccaagcagatggtaatcgacggcaacttccccacggtggcctctcccaacccggagaatcccgagggcttctatctggccattgacctggcccgtgaaaacgatgtggacttcatcctgggtaccgatccggacagcgaccgtgtgggcatcatgatccgggaccacagcggcgaataccgccccgtcaccggcaaccagaccggcgtgctgctgctggattacctgatcggcgccatgaagcgttccggaaagctgccggaaaagccggtggctctgaaaaccattgtgaccacggagatggcccgtaaggtggccgaggccaacggcgtggcctgctacgatacctttaccggcttcaagttcatggcagaaaagaagaatgccctggaagagagcggccaggggaaggtcatcttctcctacgaggagtcctacggctacatgttgggcgattacgtccgggacaaggacgccgtcaccgcctccatgatgctcacggagatggccgcctggtatgccgcgcagggcacgaccctctttgacgctctggaaaagctgtatgaaaagtacggctactacgccgaaaagacccacaacctggtgatgcccggactggacggtctgaaggacatggcagagctgatgaagaatctgcgggagaatccccctgcggacatcggcggcgtaaaggtcgtcacccgcaaggattacagcaacggttccgtagtggactgcgccaccggtgaagcctccaccatggagctctccggctccaatgtgctgcgcttcgagctggccgacggtaccagcgtgatcgtccgcccctctggtacggagcccaagatcaaggtctacatccttacccgtggcgccgatgccgctgcctgcgccgccaatctggagaagtacggccagtgggtcgccggactgaaaaagtaa

SEQ ID NO: 1095 - DNA, 2004 bp, Unknown
  Artificiall/Consensus sequence
atgaaacttgcacagaaatcccccgctgctccggatgccgggcatccgcaggaacgcagggcgttcctgtatgtctttttgctggcggtggtactgacactggtggtggagctgttcaaccacaaggcgtttaccagcggggcggactcgtttttggaatttgtgtgcggaaatcctctggccgctgtcgtcaatgtggcactggtactggctacgttgtctccggcgctgtttctgcgccggcgggccttctggtgcgcgctgatttcctttatctgggtcgtgggcggcgcggtgaacggattcatcctgctcagccgtatgacgcccttcaccgtggcggatctcacggtgttcaacaccggcctggacaccctgcccaactacctctccaccaaatatattgtcatgctggcggctgcgctggtgattttggtggtgggactgatcctgctgttctggaagggcccccgcaatgactatcccctgcgccaccggatggcagccggactgctggcggtggtgctgtgcggcggactgctgggcggcagctgggccctggccttccgcctgggatacctctccaatacctttgccaacctggcttttgcctatgaggactacggcttttcttactgcttcctgcagacctggctgaacaagggcatccgccggccggagaattacaatgccgagtcggtgcagaaactccgccagcaggcggaagacgctgccgctgcggtaaacgcagatccccagacggatgtgaacgtgatctacgtgcagctggagtccttcattgatcccaaggagatcacggacctggagctgtccgaggacgcggtgcccacctggaccaggctcacggaggagtactcctccggctacctgacggtgcctgtggtgggtgccggtaccgccaataccgagtgcgaggtgctcaccgggatgagcaccaagctgttcggccccggcgagtacccctaccagacccgtctgatggaccggacggtggagtccgtggcctatgacctcaaggagaacggatacgccacccacgccatccacaaccaccgggctgccttctacaaccgcaacgacgtgtatgccaacctgggctttgacgacttcacctccatcgaatatatgcccaaggcggagcggacccccaagaactgggccaaggacagcatcctcaccgatcagatcatcaaggcgctggatgtgacggaggaccagtcggatctggtgttcaccgtttccgtgcagggccatggtaagtatcccaccgagcaggtgctggaggaccccgccattacggtgaagtcctgcccggacgaggaataccactatgccatggagtattacgtcaaccagatccatgagatggatcagttcatccagacgctgaccgacgagctgtcccagcgggatgaaaagaccgtcctggtgctctacggcgaccatctgcccgcattgaacctggaggccagcgacatgaaggccggtaccctctaccggacccgctatgtgatctgggataacttcggcctggagaagcaggacgagaacctcaccgcctaccagctctctgccgcggtgctggggcgtctgggcatcaccaacggcgtcatgaaccagtaccagcagttctgccgggatgagagcacctactggaacggcctgtggacgctgcagtacgacgtgctgtacggccagaagtacctctatgatggggagtctccctatgagcccacggatatgaagatgggcatggcgcccattaccatccgctctgtgacccacggtatggacgcctggtatatcaacggcgagaacttcagtccctactgtaaagtcaccgtgggcggcaaggaactcaagaccgcctatatctcgccctggatcctgcaggtgcaggagaacccgggcaccatggatgtggaggatttcaacatccgggtcatcgatacccacaaggagatcctcagcgatacggaataa

SEQ ID NO: 1096 - DNA, 2568 bp, Unknown
  Artificiall/Consensus sequence
tggcagaagaaccggatggagctgttccgggacctgaaatgcggagaggacggcctttccgcccaggaggcaaaggcgcggctggaaacctacggccccaatgaactccacagcggcacgaaaaaaagcgtgctgcggatcttcctggagcagtttgcggactttatcgtcatcattttgatcctggcggcactgatctccgccgccatgggagatgtggagagcacggcggtcatcctggcggtcatcactatgaacgccatcctgggtaccgtgcagacggtgaaggccgccgcttcgctggacagtctcaagcagatgtccgctcccacggccaaggtggtgcgggacggcacggtgctccaggtaccgggccgggacgtggtgcccggtgacgtggtggtgctggaagccggcgacgccgtgtgcgccgatggacggctgttggagtgcgccagcttgaaatgcgcggaaagcgcccttaccggtgagagcctgccggtggaaaaggaactgggagagatcggcggcgaagtggcgctgggcgaccggaagaacatggtgttctccggcagtttcgttacctacggccgggcccggttcctggtcacgtccaccggcatgaacaccgagatgggcaagatcgccacgctgctgaaaaacacggaggagaaaaagacccccctccagatcagcctggatcagttcggcaaaaagctctctgtgggcattctggtgatctgcgcggcgctctttgccgtgagcgttttcctgcggggcgagaatatcatgaacgccttcctcttcgccgtggccctggcggtggcggcggtgcctgaggcgctgagttccatcgtcaccatcgtcctctccttcggcacccggaagatggcccgggaaaacgccatcatccgcaagctccaggcggtggagggcctgggcagcgtttccgtgatctgctccgataagaccggcacgctgacccagaacaagatgaccgtcaaaaagctctataccggcggcaagatcgtggacgccgaccaggcggacttcagtgatcccatccaggagccgctgctgcggacggctcttttgtgcagcgacgccaccatcaatgaaaacggcgaagtgggcgatcccacggagacggcactggtgcggctgggtgaggccaacggctttgatgaggaagtcacccgtggcaagtatccccggctgacggagatcccctttgactccgaccgcaagctcatgagcacggtccaccgtctctccggcggtctggtgatggtcaccaagggcgccgtggacgtgctgctggaccggtgcgtgatctccgacgccgagcggaaggagatcgagcaggtcaacgaggaattttccagccagggtctgcgggtgctggcctttgcctgccggacggtggaggataccgccgtctctctggaggatgagaacggcctggacttcctgggcctcatcgccatgatggacccgccccgggaggagtccaaggccgctgtggcggagtgtatcgccgccggtatccggcccattatgatcaccggcgaccacaaagtcaccgccgctgccatcgccaaggagatcggcatcctgacgccgggcaccgaggcggtggagggcggtgccatcgacgccatgagcgacgaggagctgcgagaattcgtacccaaggtctccgtctatgcccgggtgtccccggagcataagatccgcatcgtcaaggcctggcaggaccggggcaacctggtggccatgaccggagacggcgtcaacgacgcccccgccctcaagcaggcggacatcggcgtggccatgggcgtcaccggcaccgaggtggccaaggacgccgccggcatggtgctgacggacgacaactttgccaccatcgtcaaggcggtgaaaaacggtcggaatgtctatgccaacatcaagcgggccattcagttcctgctctccggcaacgccgccggcattctgacggtgctctatgcgtcgctgctgggtctgccggtgccctttgcagccgtgcatctgctctttatcaacctgctgacggactccctgcccgccatcgccctgggcctggagcctcacaccgaccgggtgatgcacgagaagccccgcccccggaacgagggcatccttacccggcccttcctcaccagcgtggccatcgagggctttgtgatcgctgtggcgaccatcgtggccttccacatcggtcttgccaatggcggcgcggcccttggaagcaccatggcgttttccacgctgtgtctgagccgcctgttccacggcttcaactgcaaagcagaccggccggtgctcttcacccggaccttctggaacaacagcttcctgctgggcgcctttgtcatcggcgcggtgctgctgggcgcggtgctgctgatcccgcccctggagccgctcttccaggtggcgcctctctccgccagcctggtggggaccatcgtgggccttgcggccggcagcatggtggtgatccagctgctcaaggccatccggacccgtggggaaaagtaa

SEQ ID NO: 1097 - DNA, 1416 bp, Unknown
  Artificiall/Consensus sequence
atggaaactctggagaaaaagggaaaaggttccgcattgcttccgttcctgctgttcatcatcatctacctgggcgccggtttgtattaccaggccaagggggtggaaatggccttctaccagttcccctccgtgaccgccatgttcatcgccgtgctgctggccttctgcatgggcaagggcagcatcgatgagaagtttgctgtctttgccaagggtgctgccaatgaaaacgttttgaccatgctcatcattttcatcctggccggcgccttctccaccgtggccagtgccatgggcggtgtggattccaccgtgaatctgggactgagcgtggtccccgtccacttcctggcggcgggcgtgttcgtgatctccgcctttatgggcaccgccaccggcacctccgtgggcaccatcagcgccatcgttcccatcgccgtgggcgtggcggacaagggcgggctgagcctgccgctgtgcgtgggcgcctgcgtgggcggcgccatgttcggcgacaacctgtccatgatctccgacaccaccatcgcggccacccgtacccagggctgccagctgcgggataagttccgggtgaacttcttcatcgccctgccggcggcgctggtcaccatcgtgctgctgctgattttgggccggcccgagaccgtggtccccatggatgagctgaccttcaacatcatcaaggtactgccctacctggcggtgctgatcctggccctcattggcctcaacgtctttttggtgctggtcatcggcatcttctccgctggcatcatcggcctggcgctgggagatctgaccatcgccacctttgcccagagcgtctacagcggcttcaccggcatgaacgaggtgttcttcctgtccctgttctgcggcggcatgtcggagatgatcgcccacaacggcggcatcacctggctgatcgaaaagctcagccggatcatgaagggcaacaagtccgctcaggtgggcatctctgcgctggtgtccatggcggactgcgccaccgccaacaacaccgtggccatcatcgtcagcggcaacgtggcccgggatatgagccggcagtacaaagtggatccccgccggaccgcttcgctgctggacgtgttctcctgcgtattccagggcctgatcccctggggtgcccagctgctctctgctgccagcctgaccaccgtgaccagcggcatcgtcatgagccctgcggaatttttgccctacatgtggtactgctggatcctggcggcgttcggcgtgctgtccatcttcatcccctatgccgacggcatctgccgcaaggacccctggaactgggagtatgatgtggcggagtccggtgtggcggcgaagaaggctgccatggaggctgccggggagaaaaactga

SEQ ID NO: 1098 - DNA, 2247 bp, Unknown
  Artificiall/Consensus sequence
atgccgaagaaaaaacagagcgacgaaaccaaacccaaagtgaataaccccaacgtgatggggctgcacgcggcagtggtggagcagcccatcaccgatacgctggagctcaactacatgccctatgccatgagcgtcatcgtctcccgggccatcccggagatcgacggcttcaagccctctcaccgcaagctcctctacaccatgtatcagatgggacttttgaccaagccccgtacgaagtccgccaacatcgtgggccagaccatgaagctcaatccccacggcgacgcggccatttatgataccatggtgcgcctctcccggggctacggggcgctgctgacccccttcgtggattccaagggcaacttcggcaagtgctattcccgggacatgtcctgcgcggcgccccggtacacggaggccaagctcacccccatctgcgcggagctgttccgggacatcgacagcgataccgtggactttgcggacaactacgacaacaccatgaccgagcccacgctgctgcccaccacgttccccaacatcctggtctccgccaacagcggcatcgccgtgggcatggcctcccagttctgcggcttcaacctcaaggaggtctgcgagaccaccatcgcctatctgaaaaacccggactgtgacctgacggaaaccctgctggcgccggatttccccaccggcggcgagctgatctgcgacccggacgccctgcgggagatctatgagaccggccggggcagcgtccgggtccgggccaagtaccggtatgtcaaagcggaaaacctcatcgagatctacgagatcccctactccaccaccgtggaggccattctcgacaaggtggcggagctcatcaaggccggtaaggccaaggagatcgccgacatgcgggatgagacggacctctcgggcctcaagcttgccatcgacctcaagcggggcgtggatccggacaagctcatgaccaaactctataagctcacccccctggaggacgcctttgcctgcaacttcaacgtcctcatcgccgggatgccccgggtgctgggggtgcggcaggtgctggaggagtggaccgcctggcgcacggagtccgtccgccggcggaccttcttcgtcatgaaccagaagaaggacaagctccacctgctcaagggcctcaagcggattttgctggacattgacaaggccatcaagatcatccgggagacggaggaggaaaccgaggtcatccccaacctgatgatcggcttcggcatcgaccagacccaggcggagtacgtggcggagatcaagctgcgcaacatcaacaaggagtatatcctcaagcgggtgcaggagaccgccacccttcaggacgagatcgcggacctggaggacatcgtggccgatccccggcggatccggaagatcctggtgtcggagctgacggaggtggccaagaaatacggcgagccccgccgcacctccatcgtctacggacatgagatccaggtctatcaggaggagtccgaggtggaggactatcccgtccatgtcttcctctcccgggaggggtactgcaaaaagatcaccccggcctccctgcggatgaacagcgagcagaagtacaaggagggcgacggcctgctccagacctttgagaccaccaacaatgcggagatcatgttctttaccgatcactgccaggtctacaagacccgcctgagcgaatttgacgacaccaaggccagcgtcctgggcgattacctgccggcaaagctggccatggaccccggcgagaatgtgatctgcgccgtgctgccgggcccggattacgcgggggcgctgctgttcttctttgaaaacggcaaggccgcccgggtggagatcaagtcctatcagacttcctccaaccgccgcaagctcaccagcgcctattccgacaagtctcccctgcggtgcatccgccgcatcgacgcggactgcgaactggcggtgtactccacggagccccgggtgctgatcttccacacggcgctgctggcgcccaagaccacccgcaccacccagggggtggcggtgatgaccctcaagcccaagtaccgcctggacaccgtcaaggccctggaggagaccgccatcaccaaccagagccgctaccgggtgcgggccatcccggcggcgggggccctgctgcgggaggcggactccgaggagcagcagatcggtcttctggagtaa

SEQ ID NO: 1099 - DNA, 1323 bp, Unknown
  Artificiall/Consensus sequence
atgaaacggattcacaagcgatttcagggactgtactggcgccagctgttcgtcacggccggcatggtgatgctgacgctgtttctgctgggcacgtccttcttctccctgagctataactatgcccgcagccagcagagcgacgagcttttggaccgggcggagatcatgagccggttatccgtggactatctggagagcggccggtatctgaatattgaggacctgcgcaacgaccccggctttcagcagctggcatccttcggtgccacggtgtcggatgtgcagtttatgatctgcgacacagaggggcatgtgctcctctccaccgacgaaaatctcagcggcaaggtggtcaccatgccggaggagatgacccgggagatcctggaggaagggtccacttcccatcgggacgatctggacgggctgtacgagcaaaagcggatggttgtcggcgttcctgttgtgaaccgggacacggaccggaccgtgggagtggtgtatgccgtgtccctctccacgtcggcggacaccatgtggcagggattcgtgggactcttcttcatgacggcatttgtggtgctgatgatcgccttcatggcctcctccatcaccgccatgcggcaggtccagcccattcgggagatggtgcaggccacgcggcagtacgccgagggagactttgacgtacgcatgaaggattacgggcagcgggacgagatgggagagctggcagcctccttcaacaacatggcggagtccttccagcagacggagcggcagcggcgggagttcatcgccaacatctcccacgagctgaaaacccctatgaccaccatcgccggctacacagacggcatcctggacggcaccatcccgccggaaaatgagcggcagtacctgcagatcatctccgacgagagcagacggctgagccggctggtgcggcggatgctggacgtgagccagctgcaggtgatggatccgctcaaaagcggcagccatttcgacatctgcgaaagtatgcgccgggtgctgatctccatggaaaagaagatcacggaccggcatctggacgtggatgcggacattcccgaggagcccattctggtgcggggcgacaacgatatgatcacccaggtgatctacaatctgttggaaaacgccaccaaatttgcccgggaggggacgacgctgtatctgggcgtcaccaccatcgacggtaaggcccgggtcacggtgcggaatctgggggataccatccccgcagaggagctgccgctgctgttcgagcggttccataaaagcgacaaatcccgc

SEQ ID NO: 1100 - DNA, 2154 bp, Unknown
  Artificiall/Consensus sequence
gccgtggccatcgaggacgagcggtttttctcccaccacggcgtggactggatgcggacggtcaaggccacgctgaacatgttcaccaacaatgataccttcggcggatccaccatcacccagcaggtgatccgcaacatgacccaggacaacaagtccactgtcaaccggaaggtccgggagatcttccgggcgctggaatttgaaaagcactataccaaaaccgacatcctggagatgtacctcaacctcatctacctggggaagagctgctatggcgtccagacggcggcggagtactacttcggcaaggacctcagtgacctgagcgtggcggagtgcgccagtttgatcgccatcaccaacaacccctctttgtacggtcccatgtccaacatcactatcacccggagtgacggctccaccgtcacgccccgggagctgaacaagcagcgccaggaactgatcctggacaagatgaccgagatcaaggacccggagacgggagagcccttcctgacggaggaagaggcccaggctgccaaggaggaggtgctgcagttcacggacggctccacttctgccgaggatctggtggagcaggctaccggcggtacgcagatcaacaactggtttgtggacgaggtcatccgggacgtgtcctccgatctggcggaggagctgaagatcaccgaggacgaggcgctgctgcgggtctacaacggcggctataacatctataccaccatggacccggacatccaggccatcgcggaggaggtctacggcgaccgcagcaatctggatgttacctcccgcaacggccagcagctccagtcgggtattaccatcatcgatccctccaccggcaacattgtggccatggtgggcgctgtcggggagaaggagggcaacctcctgaccaactatgcccggctgccccggcaggtgggttcctctatgaagccgctgacggcttatgctccggcgctggacgaggggaccatcacgcccgccaccgtatttgacaactacccggtccagctgctcaacggcaacccctggcccaagaactcgcccaacacctatacgggacggacgatcctttccaccggcatcgctaaatccatcaataccattgccatccaggcgctgcagagcgtaggcgtggcagatgcgtttgcctttgccacggaaaagctgaacctgaacctggtggcggaggatatgaacctctcgtctctgggcctgggcggtctgacctacggtctgaccaccgaggagatggcagcggcctacgcggcgtttgccaacaacggcgtctataattctccccggacctatgtccgtgtcaccaagaccgacagcaccaccggagaggagacagtgatcctggaaaatgaggcggagagccatgtggccatgaaggagaccacggcctatctcatgaccaagatgctcaagggcgcggtcaccagcggtaccgccacctctgccaacttcggcggcatgaccatcgccggcaagaccggtaccaccagcgacaactacgaccgctacttcgtgggttataccccctattactgcgcggcggtctggaccggctacaagtccaacgaaaagatcagctactccggaaacccggccatcaccatgtggaaaaaggtgatgcagaagatccacgaggagcttcccaacaaggactttgacaagccctctaccggcctggagaccattcaggtctgcctggacagcggcctgctgccctcggatgcctgctctcaggatgtccggggaagccggatcgtctccgtggaggtagccgccggtaccggccccaaggagacctgctccatgcacgtgctgcgggattactgcaccgagggcaagtgcctggccggcgagttctgcccggcggattccgtggtgcagaaggcgtttttggactatgagcggacggattacggctccgggatcactgcggaggacgatccgtacctgatcgtgaatctggaaaaggcggcggagagcggctgtcccgtccacacccaggcgacggaggagccggagaacccggacgccgcaacagaccccaacgaccccaattatattccgcccacagatgattcctccggagagggaaccgaaccggaa

SEQ ID NO: 1101 - DNA, 1827 bp, Unknown
  Artificiall/Consensus sequence
atgaaacgcatgctttccctggtgctatccctgattttggcttggtcccttaccatcccctcgctggcggcggaggatctggatccgccgctttggcagcagatgggcttttcctcccgggaagagtgcattacatatgtctatgggaatgaagatgcctatgagcaggcggtgcaggaggccctggaacgccagcggtgggaggacgccatggccgatgacatcgcggccttcgatccggacgcctactgggaatccgacgagtgccagtacagctggttctatgactccaaggaggagttcatggaggactggttcctggagacggaagaggagttccgggacgtgatgctggaagattggctggatcagcagtgggatgcctactggcaggagacgctggtggaccggacccgggcggagctgggagctcccgcgggccagaccggcgtgatgctggacggcacgtacctctccttcccggggagcgccgcgccggaagtggtcaacggctgcaccatggtgccctgcggcccgcttctgacggccttcggcggaacggtcagccacacgggcagtgatgtgacgtgtacgctggacggcgccgtttaccgcctgcgcagcggcagcgacaccatcaccgtcaccgccgctgacggaacggtctccgagatcccgctgggggtggcctgctatgagaaaaacggcgccacctatctggcactgcgtccgtttgccgaagtcatgggctgcgatgtcatgtgggacagcaccttccagaccgcggtgctgctgcggcgggacaaggtgatcgcccagctggatgagcagttcacgctcatcaatcagatgtttgcggccatggagtacgatgcgtccaagaactacaagaccgtggcgcggatggatgccaagctcaccatgctggattccatcaacggagacaagcagtatcccatggatgcggatgtggagatgctgcaaagcggcggtactgtgaatttgaaactccccatggacctctctgccctgctggagatcccgggcgcgctggacgggatggacccgctgtctgccgcggcggtgaaggggcagctgcggaacgtgaagatggagatgatctatgacgcagagggcggcaccctgtacctgaagatgccgctgctggcccagctcaccggcgggcagctggacgaggacagctggatcgccttccctgcggcagatcttacccagatgcccgtgggcaccagcaccaccatgggagcggtcctctaccagagcatgcggcagcaggcggagctcatgtccagctttggatcctattattttgagggcatgatcacccccgccatgctgtaccgggaagtgtttgtcagcgcagaagaggcggcggcctacctgggagacgactgctttgaagccagcggcggatacagcgtcctccattacgacgaggaggattacaacgcctatctggagtccgagtacggtgagggctccgcggagtacctcagcgagtttgagcagctggagatggagctgaaggtcgcccgttcgggtgcggccaccttccgggtgctgatgcagaccaaggcccaggggatgtactcccccgccatgctgctggacatcagcggcagccagagtcccacccgtgtggacctgagcatgctgatgaagctgaaaaaccagttcaatctggaactgacctataccggcaataccaccgaaaccgaccagaagcccaacaccgctcctccggcgggagagacggtgatcgacccctatgaatcctatatggtgccggagcctgcggcggcgtaa

SEQ ID NO: 1102 - DNA, 1398 bp, Unknown
  Artificiall/Consensus sequence
ttgcaggagaacaacatgaaaacaagacgctttttctcggtttttttgctgtgcgcactgatcgtcactctctttgccacccccctgtccgccgcagcggaaacagaggccaaaactcctccggaccccggcatctcctctaaggccgcactgctggtggacgccaataccggcaacgtggtctatgccaaaaatgagcatgaggagatgtatcccgccagtctcaccaaaatcatgacagccctgctggtgctggaggctgtggataatgggcagctctccctgacccagcagctgacggcctcccactccgccatgaccaccggtctggatgaggacggcagcaccgccggcattctggagggagagaccatggcggtggagcagttcctctactgcatgctggtggtctccgccaatgaggcctgcaacgtgctggccgaggcggtcgccggagatgtggacacctttgtggaaaagatgaacgccaaggcccaggagctgggctgtgagaacacccacttcgtcaatcccaccggtctccacgatccgcagcactacacctccgcctgggatctctacctcatcacaaaagaggccatgacccacagcgatttcatgcgcttttgcgacaccggctctgttaccatccctgccaccaacctctccgaggcccggacgctccacaccaccaactacctcattgacggctggcgttcccggggttacatcaacaaggacgcccacggcgtcaagaccggctccacctccgacgccggacactgtctggtctccaccgccacccggggaagcctgagcttcatcagcgtggtgctgggcggcgaccgggtgacgctggatggcggagagatccgtacatatagcttttacgacaccaacctgcttttcaactgggctttcgataatttctcctatcagaccgtcctcagcgcggaggaaccgctcaaggaagtcacggtctccctgtccaaggtggatcatgtgaatgttcatgtgggcgaagatgtggagatcctcctgcccaacggtctgacgccggaggatctggagcagaaatttaccattgaagagccggtggaggcgccggtgaaggcggaccagaagcttggcactctggaactgagctacggcgacaccatctatgccaccgtggatcttctggcctacaatgatgtggaggcctcccggctgttgaccttctggcagaatgtgaaggactttttcagcggcaccgtggtgcggatcatcgccatcatcattgtggtgttgctgctggtcctgctgatctggaaagtggtctttggccgccgtcgctaccgttacggccattccgtgggccggggccggagccgcggttaccggggccgccggagataa

SEQ ID NO: 1103 - DNA, 2034 bp, Unknown
  Artificiall/Consensus sequence
gcgggacaaaaccacatccgaaatgagagggaaaaccctatggctttgttcaaaaagaaagaggcggagcaggtaccgcccaccgcctttgaagagcatgatacgtccgtcggcaccgccgcggacgtagaggcggtcatgaaaaaatacgaccgggagtccaatacccgggtctgggaaggaatgccgaaactcgtcatccgctggctgatggtggctttttccctctactgcatcatcgacaccgtgtttctctccaccatgcaggagatccgtttgccggtgttcgtgggtctgatcctgctgtttggctttttgaccttccccgcgcggaagggagatacccgggtcaatcacatgccctggtatgacatcattttgctgatcatcggccccggcgcctatttcttctacgccgtcaatgcccagaacgtcatccagatgtccgcccgggtcatgcagaacgatctgtacatggtcatcggcctcatcggcattctggcgctggtggagctgtgccgccggtgcgtgggcctgcccattttgtgcgtggccggcgcgctgctggtctataccttcttcaacctgatgggtacacccagcgcggaccaggcgaagatgaccatttaccaggtgatccgcaccatgttctacaccacaaacggtatcttcggcggccccatcagcgtgtgcgccaagttcatcgtggtgttcatcatcttcggcgctttcctggagcggacgggcatcgcccagttcttcatcagcctggccaacgctgtggccggcgctgcccccggcggtcccgccaaggtggccgtcatctcctctgccctgtgcggcatggtgtccggctcctctgtgggcaataccgtcaccaccggttccgtcaccatccccatgatgaaaaagaccggctacaagggtgaatttgccggcgccgtggaagcggcggcttccaccggcggccagatcatgcctcctatcatgggcgccgcagccttcttgatggcggagttcaccggtgagccgtacagccagatcgccgtgcgggccatcctgcctgcggtgctgtacttcaccggcatttacatcgcggtccatctggaagccaagaagctgggcctgcagggcattccccgggatcagctgcccaagattggcaacctgatgaagaagatctacctgctcttccccctggtcctgctggtgatcctggtgtccaccaacaccttcaccatggccaagtccgcggccatcgccatcgtggcggccgtggccgtgggccttttgaacaacgtggtggatatgaccgtcaagaatgtggaccgcacggatttcctgaccttcggcaagatcctggacgctctggagggcggcgccagaggttccatcaccgtggccgtggcctgcggcgtggcaggcatcatctccggctgcatcacggtgacgggccttgcatccaagctcctcagcgccatcgtgaacctctccggcgggcatgtgatggtcgcactgctgctgacgatgctctgctgcatcgtgctgggcatgggcgttcccaccactgccaactactgcatcatggcggcgacctgcgcccccatcctgatggatccctccatcggtgtgaccaagatggcggctcacttcttcgtgttctacttcggcatcgtggcggacatcacgcctcctgtggctctggcagcctatgccggcagtgccattgccaaggcagatcccatgaagaccggtgtcaacgctacaaaattggccattgcggcattcatcgtcccctatatctttgccatgaatcctcagatgctgttcgtggatgtgagcagcgcgctgcaggtggtgcagatctgcatcagcgccctgctgggtatcttcggcgtggctgctgcgctcaatggctttttgtatcgcaccatcagcccgctgctgcggctgattctggtggtaggcggactgggaatgctgattcccggcaccgtgaccgatgtgaccggcttcgtgctggtggtgggcgtg

SEQ ID NO: 1104 - DNA, 1458 bp, Unknown
  Artificiall/Consensus sequence
atgaaaaccgaacagaagttgaatatgacgatgctctgcgacttttatgagctgacgatggggaacgggtacctcaaagcggggtatcaggaccggatcacgtattttgacgtgttcttccggaatgtgcccgaccagggcggttttgccatctgtgcagggctcgatcagttgatcgactatatcgaaaacctgcattttgatgaggaggacatccagtatctccgggaaaagcagatgttctccgaggaatttttggagtacctgcgcaatttccatttttccggtgacatctgggcgattcccgaaggaactcccattttcccccgggagccggtggtcaccgtccgggctcccgccattgaggcccagctgatcgagacgtttacccttctgaccatcaaccaccagagcctgatcgccaccaaggccagccggatcgtccgggcggccaagggacggaccgtgctggaatttggttcccgccgggcacagggcacggacggcgccatcaccggcgcccgggccgcgtttatcggcggctgcaagggtacggcatgtgccatctccgaccagctctacggcgtccccgcaggcggtaccatggcccactcctgggtgcagatgtttgattcggagtatgaggccttcaagacctattgtgagatctatcccaccagcgccacgctgctggtggatacctacaacgtgctcaagtccggcgtgcccaatgccatccgcgtctttgacgaggtgctcaagcccagggggatccgcaagtgcggtatccgcatcgactccggtgacatcgcctatctcagccgggaggcccggaaaatgctggatgctgccggctggacagagtgccagatctgcgcatccaactctttggacgagtatctcattcgggatctgctggaccagggggcgaagatcgacgttttcggcgtgggtgagcggatgatcaccgcccgcagcgaaccggtgttcggcggggtttataagctggccgcagtggaagatgccgctggccgcatcatccctaagatcaaggtcagcgaaaatgtcagcaagatcaccaatccccacttcaagaagacgtatcgtctctttgacaaggccaccggcaaggcggaggcggactatatcaccgtgtacgacgagacggtggacgagtctcagccgctggagatcttcgatccccaggctacctggaagcgtaagacctttactgattttaccgctaaggtactgcaggtaccggtgttccagggcggaaagctggtgtatgagcggccttctctgcaggagatccagacctactgtgcccagcagctggagaccctctgggatgaggtaaagcgctgcgagaatccccatacgtattacgtggatctcagccagaagctgtgggacatcaagcagtctcttctgcgtcaaaacggtgagaatacctga

SEQ ID NO: 1105 - DNA, 1182 bp, Unknown
  Artificiall/Consensus sequence
atgaccatggctgatgaaaagaacaacatcccggagctgacgctctcgcccgataccgcggcggaggtcgtgccgcagctgaccctgacgcctgaggcaccggcggcgcccgcgcaggaggaggccaagccggaagtgaccccggtgcagatggatgagaatctgctctctgatgcggaaaagcaggcggtagaggccttttccaagaaaatcgacctgacggactcccagatgatcctccagtatggcgccgctgcccagaagaatgtggcgggcttttcggaaaacgccctgaactccgtgcgcaccaaggacctgggagaggtgggcaagtccctctccgagctggtggtggaactcaagggcttcagcgaggaagaggagaagaagggcctcttcggctttttcaaaaagaccggcaacaagctggagaccatgaaaacccagtatgccaaggtagaggccaatgtggacaagatcgtccgggagctggaacagcaccaggtgacgcttttgaaggacgtggccatgtttgaccagatgtatgagctcaatctcaagtactacaaggagctcaccatgtatatcctggcgggcaagcggaagctggcggatgtccgggccaacgaactcccggccctgaaggccaaggcggagcagaccggtgcccaggaggacgcccaggcctataacgatcttgtgcagatgtgcgaccggtttgaaaagaagctccacgatctggaactcacccggatgatctccgtgcagatgggcccccagacccggctgctgcaaaacaacgacaccctgatggtggagaagatccagtcctctctggtgaacaccatcccgctgtggaagagccagatggtactggccctgggcctggagcacggccggcaggccactgccgctcagagcgccgtcaccaacatgaccaacgagcttttgaagaagaacgccgacatgctcaagatgggcaccatcgagaccgcccgggaggcggagcgcagcgtggtggacatcgagaccctccagcacaccaacgagcagctgatctccacgctggacgaggtgctcagcgtccagaaggagggtgccgccaagcgcaaggccgccgaggcggagctgggccgcatcgagggggagctgaagcagaagctgctggagctgcggggctga

SEQ ID NO: 1106 - DNA, 1539 bp, Unknown
  Artificiall/Consensus sequence
atgagcaagcatttgcatctggtgctgggaaaacttctctatgtggcattgtttgtcaccatccaggtcgcagcactgatcgtcatgttcctgttcttccgggatcagtttgcctacttctatattttctgcatgctgctctctctgggggcctcgatccacattctgaacaacaccaccagcaatcctgcctacaaaattgcctggctgatccccattctgctctttcccatctttggcggactgctgtacctgctgtttggaaagtaccgcatgacacggaaacagcgcgcctccagccgggcaatacgcaagcagatcgccacggttatggaatcagagcatatcgctgcggaccatctggagaccctgcctccggatgcggccatccaggcccggtatcttttgcgggcctccggttccccgccctgtgtccatacccaaacggaatatctccccattggagaggcgttctttgatgcgcttttgcgggagctggagacagcggaatctttcattttcctggagtacttcatcgtcgaggaaggcaccatgtggaacagcatcctggaagtgctggaacgaaaaatcaaacagggcgtggaagtgcggctgatgtacgacgatctggggtgccttctgacactgccccgccattacgatcgcgtcctgcgggcaaagggactgcgggtatgcgtgttcaatcccttcaactccgttctctcccctcggttcaataaccgggatcaccgtaaaatctgcatcatcgacggcaaggtcggctttactggcggcatcaatctggcggatgagtacatcaacgcctatgcaaagcacggccactggaaggataccggcgtatgtctccggggcagtgccgtatggagcatgaccgtgcagtatctcgcgctgtggggctttaccagcggacaggtggattccttctcccgctattgtcctcccgctgcatgggtggaatccattgcccctgacggcgtggtcctcccctacacggaccttcctctggatgatgatctggtgggcgaaacagcttacctgaacatgattcaccgggccaaaaaatatgtatacatcactaccccctacctcatcatcgacaatgagatgatgacatctctttgtactgccgcgaaggccgggatcgacgttcggatcatcacgccccatatccccgataagaagaccgtgtttttcctgacccgatcctactacgaaccgctgcaaaaagccggcgttcatatctatgaatacacccccggcttcatccacgccaagaccatggtctgcgacgacgaatacgccatcgtggggaccatcaatctggactaccgcagcctttacctgcatctggaggatgccgtctggatgtatcgcagcagcgctgtatctgacgtgaagcaggatttcctgagaacgcaggagatcagccaggagatgcaccctgaagatctgggccgcatcggctggctcaagcagctgtggctgggcatcctgcacgcctttgcgcctcttgtgtga

SEQ ID NO: 1107 - DNA, 1212 bp, Unknown
  Artificiall/Consensus sequence
atgagtttgatcgtacagaaattcggcggcagctccgtcaaggatgccaagcacatccgcaacgtggccggtatcatcgccgagacttacctgcagggcaatgatgtgatcgtggttctctccgcccagggcgacaccacggacgacctgatcgccaaggcggaggaaatcaatccccacgcctccaagcgggagatggatatgctgctgtccaccggcgaacagatctccgtagcgctgtgtgccatggcgctggagggaatggggcttccctgcgtgtctctggcggcttggcaggtgagtatccagtccacctccgtgcactctgacgcccgcatcaaaaagatcgacagtgagcgcatccaggcggagctggaccagcaccgcatcgtgatcgtgaccggattccagggcgtggaccgcaacggcgatgtgaccacgttgggccgcggcggctccgataccagcgctgtggcgctggcggcggcgttccgggcagatctgtgccagatctatacagatgtggacggcgtatataccaccgatccccgcctggtgcccaacgcccggaagctggatgagatcacctatgatgaaatgctggaactggccagccagggcgctcaggtgctgcataaccgcagcgtggagctggccaagaagttcagagtgaatttggaagtgctgtccagcttggagcgcaagccgggcacaaaagtgaaggaggtcaccaaagtggaaaaaaccaatatcgccggtgttgcaaaggataccagcatcgcccgggtcgctcttgtcgggctggagcacaatcccggtgttgcgttccaggtgtttgatctgctgagcaagcacaacatcaatgtggacgtgattttgcagtccatcggccgtgaggacaccaaggatatttcctttacggtacataagaaggatctggaggagacggtgcagatcctcaccgactccaagcagacgctgaagtttgaccatattgccgccgacgatcacatcggcaaggtctccatcgtaggcgcgggcctcatgagcaactgcggtgtggccgccaaaatgtttgaggcactgtatgaggcaggcatcaacatccagatgatcaacacttctgagatccgggtgtctgtgctgctcgacgaggatgatgtgaacagggcggtaaaggccattcacgccaagttctttgacgaggcctga

SEQ ID NO: 1108 - DNA, 1587 bp, Unknown
  Artificiall/Consensus sequence
gtgcttggaccgtttcgcagatggtggcaggaattctaccgccgcagcagcatccagggcattttgtcgctgtccttcaccgccgtggcggtggtgggcatgatcttcatgggcctggcgctgtttttccggttctctgccaataccaacgcgcagatggcggaaaacagccagcgggtgctggcccaggtgaatctgaatctggatgcgtacctgcgccggatgatgcgcttgtccgatacggcctattactccgtcatcaaggacgcggacctggcggaggaggacctgtcggaggcgctggaccttctttatgagaacaaccgggatgccctggtgtccatcgcgctattttctgaagagggggatctcatcgcctccacgccgctggtggggctcaagaacagcgtcaatccggaaaaggaatcctggttcaccaccgccatggaccggatcgaaaacctccacttttccacgccccatgtgcaaaacctctttgaggacccggactaccagtaccgctgggtggtatctctcagccgccaggtggagatgacccgggcgggggccatcgaaagcggcgtgctgctggtggacatgagcttcggcggcatcgagcagatctgcaaggatgtggacctctcctccaccggctacctctatctcatcgacggagacggggagatcatctatcacccccgccagcagctgatctatgcgggactgctggaggagaacaacctggctgccgccggctacaccgacggcagtcaccaggagaccttcggcggcacccgccgggaggtgacggtcaagaccgtgggctacaccggctggaagctggtgggcgtggtgccctcggagaatctgtgggacaactacggacagctggtgctgtttttcctctttgtggtgctcttctccgtctttttgctggtgtttgtgaacctgcgcctctcggagtggatcaccgccccggtgaaaaagctggaccgggcggtcaaagagctggagcacggcagcacggaggtggactttgatgtgggcggtcccggcgaggtggagcatctaagccactccatccgctccatggtctccaccatgcgccatttgatggacgacattattgagcaagaggaacaaaagcggcgcagcgaactggaggtgctccagtcccagatcaacccccatttcctgtacaacaccctggacagcgtcatctggatgacggagaacggccgcaccgacgacgcggtggtgatgctcacctccctggcccgcttcttccggatctcgttgagccggggcagcagcatcatccccatccgggatgagctggagcacgcccggcactatctcaccatccagaagatgcgctataagaacaagttctccgccaccattacggcggaggacggcgtggagagcctctacaccatcaagctcatcgtccagcccattctggaaaacgccatctaccacggcatggcctatgccgacggagacggggagatcaccgtccgggccttccgggacggaggagacgtcctcatcgaagtttcggacaacggccccggcatgccggag

SEQ ID NO: 1109 - DNA, 987 bp, Unknown
  Artificiall/Consensus sequence
atgaacgtagaaggagtatcgcgcatgacctttcagcagttggaatatgtagtggagatctccaaatgcggttccatcaataaagcggcgcaaaagctttttttgtcccaatccggcatctccaccgccgtgcgggaactggagcaggagctgggcattcggatctttgcccgcagcaaccggggcgtagagttcacccaggagggaaaggaattcctcagctatgcgatctctctgctggagcaaaagcaccggatcgaggggctctacaaggactcccgggatgatgcccccatgcgcttttccgtctcctgccagcggtacccgttctgtgtggatgcctttttgcggctcttggacattgcggaggacaaccgctatcatttctccatccgggagaccggtatggacgcggtgatcggcgatgtgtatgaccaccgctcggacatcggcatcatctgcctgacggatctgacggagaagatcatccgccgcctgctggattcccgggagctctccttccacgaactggcagcggtctccccctgcatttatgtacgccgggagcaccctctggcccatcttgccagcgtcaccgaaaaggatctggacggctatccttacgtatcatttgaccacgaccagggcgttgcctcggactttttcgaggaatatcccatggtctcgctgaaaaaaccggccaaatgcatcagcgtcaataaccgcgccaccgccatgtacgtcctggcccggaccgatgctttcaccaccggcagcggacttttgtccgagccggtgtgcaatccctccgtcattaccattcccctggagggcaagacctgcatccacctggggtggatccacgggaaaaacggcaagctctctgcccagacggaggggttcattcatctgctggagaaagccgtctccgattccattgcctttaccacagcgtttcagcaagccgcccttgcagatcggacataa

SEQ ID NO: 1110 - DNA, 1350 bp, Unknown
  Artificiall/Consensus sequence
gtgcgtgagacggctctctcccggcagttcgggactgccgcgctgctgcggttcgctctgccaaatatcgcgatgatggtgtttttgtccctgtataccattgtggacgggatctttatctcccgctatgtggggacgctggcgctgtccgcggtgaacatgtcctatcccctcaactccctgcagatggcgctggggatcatgctgggcaccggcggcagcgccatcatcgcccgggagctgggcgagggaaaggaacggcgggcccggggggattttaccgccgtggtggcggtatctctggtgctgggcattttgtgcatggcggcgggactggtgtttctcgatccgctgctgcggctgctggggaccagtgacgcccagttccagctgtgccggacctacacgcaggtgcttttgtgcttttccccggcgctgtttttgcagacggtattccaggtcctcttcgtcacggcgggccgtcccggccttggactgggggtcactgtggccggcggcgtggccaatgtggtgctggatatgctcttcatgggtccgctggggcttggcgtggccggcgcggccgtggccaccggtatcggttactgcatcccggcggtggccggaacggtgtattttttcaaaaaccgtaccggcgcactgtggtttaccccctttcgcctccgctggcggatgctgctgcagacctgctggaacggttcgtcggagatggtgagcaatgtggcaaatgccgtgaccacgtttttgttcaatgtactgtttctcgcctattggggggaggacggtgtggcgtccatcaccatcgtcatgtacttccagtttgtgttcagcgccatgtatctgggcttttccatgggagtcgccccggtggtgagcttcaagtacggcgcccaggaccgggagcagctccagaagatcttccgcagctgcgggttctttatcctgctctgctccggggccatgtacctgctcagccggatcgtcatcggtccgtgtctttccgtattcacagaccccgggagccgggtctatgccattaccatggagggctttcccatctatgcggcggcgttctggttcatgggagcaaatatcttcgcctcctccctgtttacggcgctctccgacggggcggtctctgctgccatctcctttgccaggacgtttctcttcctggtgagcatgctgctgatcctgccgcagcagctgggagcctgggggatctggctggcggtcccggcggcagaggcgctgggactggtggtatctgctgtgtttatcctgtggggaaggcggaaatacggctacgccccctgcagaggtgtctga

SEQ ID NO: 1111 - DNA, 1347 bp, Unknown
  Artificiall/Consensus sequence
atgcgtgccgctttgctggggctgatgcttggtgtgctgctgcagacggcctgcggctgcagcaccgggttcattttcaatccccaggagctttacagcctgccgcagctgccgccgaaatatgatgcgctcaaccagtgcctctctgaaatcatcagcggaggcgcggaatatgccgcccccacctctggtaccaacattcaggcagtgcagatggtggatctggacggtgacggtcaggaagaggcggtggcgtttttccgcaatgccgccgatgaaaaacctctgaagatctatatttttgccgctgaaggagagagctatcggcaaatggcggtcattgagggaagcgggaccgccatttacagcatcgattatcaagatctcaacggagacggggagatggccctgctggtgggctggcgggtcagtacggatctgcaggcactgtcggtttatgctctggaggacggcgaggctgtggagctggtccgctccaattatgtgaagtatgccattaccgatctggatcaggatcagaagaaagaactgatggtcctccgttcggacaaccagggcgagggcgttgcggagtattacagctggcaggacagcgggctgcttcccacttccacgatccgcatctccatcaccatggcggagctgagtcagcagggcaggatcatcagcggtgtgctgcgggacgaggtaccggctctgttcatcacgggcgtggcggaaaatgcggaggccattacggatattctcaccgtccgtgacggggagctgacgaatgtggtcctctccaacatgacgggggtgtcccaggtgatcgcgccgtttcggtctttgtatccctcggatatgaacaacgacggggtgacggaggttccgcagcccgtgaagatgccggggtggggcagcggcgtgacgtcagatgacggctaccggatcgattggtacagctatgattccaatgggaaagggaaaatcgtcatgcggacgtatcatgatatggaaagcggctggtacttccagctgccggaggagtggacggacctgatccaggtgcaccgcagttccggtacggatgagacggtggtgaccttctccgtgcaggatggagatacggtacagaatatattgagcatcagcaccctcaccggcaccaaccgggagatccagaccagccgcggaaaccgcttcaatctcagccgtcagtcggacgccacctatacggcggaactgttgagcggaaacagtgaatggaaatacggccttacggaggatcaggttcgggaggcgttcagcctgatccggccggagtggctgaccggagacaactga

SEQ ID NO: 1112 - DNA, 996 bp, Unknown
  Artificiall/Consensus sequence
ggaaatcccgatgagatcgagctggcattgaagcggggcgccaccggtgttaccaccaacccggtcctcaccttccgctccttccagtctcagccggacttctggaatcccaaggtcctggcactgggcgatgatttccccaccctggaagctcacgcagaagcgcttttgaagctggtggctacctacgccgccgacaaggtgcgggacatttacgaaaagaccaacggtgccgacggctatgctctgggtcagctgaacccgggtcgggccggcgatgccgagggcatgctggcacaggcccggcgggtccactcctgggcgcctaatatcgccgtgaagctgcccgccaccgctgccggtatcgaggtcatcgagcacttggcggaagagggcatccccatctgcgccaccatcaatgtctccgtggcacaggccatcgctgtggccgaagcctatgcccgcggcaaggaaaaggccattgccaacggcgtcaagccgccgctttgcatcgtggtgcagcaggtgggccgtctggatgactacctgcgggacgtggctcaggatatgaagctgggtctggacgagtccgtgatcaccatggccggtctggctgtggccaaacggtcttaccacattctccaggagatgaagtccgacgccatcatcatgcccgccggactgcggggcgcctaccacctcacggaaatggccggcggccggctgctctacaccatcaatacccgggtccaggatatgatcctggaggccgatcctccccaggtggagaagatcgccgagcctattccggctgagacgctctcgcagcttcagcggatcccggagtttgtccgggcctacgaaccggatggcatgaagccctccgagttcattacctacggcgttacccagaaactgctcagccagtttatggagaccggctggtccccgctggagacctacatgtccagcaagaaaaccagccgttggatctga

SEQ ID NO: 1113 - DNA, 1368 bp, Unknown
  Artificiall/Consensus sequence
atgaaaaagattgaacggcgggcgttggtttgctgtatcctggccatgctgctggcggcgggactttgtgtctttctgggcaaataccttctgaacggcggcagctgggtctcctcggcattcaaccgccatctctataacagttccggcgtcctggcctgcggcacagtgctggaccgggacggggatgtgctctccgctgtggaaaacggggaacggacgtattacgacaacgccgatgtccgccgggcgacgcttcacgcagtgggggatctccagggcaacatcggcaccggtgccctgaacgcctttgccgataagcttacgggctataacctgctcaacggagcctttggggcccagcagggaaacgacctctatctgaccattgacgcccggtacaactacgaggcataccaggcgctgggaggccacgcgggaacggtggccgtctacaactacaagacaggggagatcctgtgcatggtctccgcgccctcttacgatccgctgaacgttcctgccgacattgagaccaatgaccgctacaagggggcgtatatcaaccgcttcctctcctccgcattcacccccgggtctgtgttcaagaccgtcacgctgacggcggcgctggagcagatcccggacctggagagccgcacctggacctgtaacggcagcgtggagatcgacggagagaccatcgtctgttctggcacccacggcgagcagaatattggggacgccttcgccaattcctgcaacgtggcctttgccctgattgcccaggaactgggcggagacgtgctggaagagtacacacaaaaagcggggctgatggacagctattccatcaacggccttcccacggccaaggggaccttccagtttcaggacatcagtgacggagaactgggctggtccggcgtgggccagggacaggaccaggtaaatccggcgtcgctgatggtctacatgggtgccattgccaatggaggaaaggcgccgcagccctatttgatcgaaaagacggtcagctccctggggatcccatccctgccccacttcaccaaaaagacagacagcctgctcagcgccgatacggcccagcgcctggcggacatgatggcagacaatgtggagcggacctacggtgcctcccggttccccaatatggacatctgcgccaagtccggtaccgcggaagtgggcgagggtcagacgccccacgcctggtttgccgggttcctgcgcaatgaggacgcgccctatgcattcgtggtgctggtggaaaacggcggcggcggcagctcggtggccggtacggtggccgccaaggtgctggatgtgatggtcaacggatactga

SEQ ID NO: 1114 - DNA, 1725 bp, Unknown
  Artificiall/Consensus sequence
atgtctgagagctatgcaggaaagatcaaccggaagctgctgaaaaagcggcgcatcatcaacgcggccgccggtcgggaaccggcggatctggttttgaaaaatgccacgtacgtgaatgtgttctccaacgagctttgcactgccgacatcgccgtggcggaggggctgatcgtgggcatgggccagtacagcggaacccaggaagtggacatgaccggaaagatcgtccttcccggtttcctggatgcccatatccatctggagagctccctggtgacccccaaggagtttgtccgggccgtgctgccccacggcaccaccaccgtggtgacggacccccacgagatcgccaacgtcatgggcaccgacggcattgagtacatgctccaggccaccgaggggctgccggtggatgtgcggttcatgctgccctcctgtgtgccggccaccccgctggacgaatccggcgccgtgctggactaccgggccattgactccttctatgaccatccccgggtccagggcctggcggagatgatgaactttgtaggcaccattgccggagacgagcaatgtgtggagaagatcgtggcggcccaggcccatcataagaagatcgacggccacgcccccgatctggtgggcaacgacctcaacgcctacatcgccgccggcgtctactccgaccatgagtgccatgacctgaacgacgccatcgccaagctggagcggggccagttcatcatgatccgggagggcaccgccgcccggaacctggatgcgctgttccccctgctgtgcgacaagtatgccgagcggtgcatgttctgcaccgacgacaaacaccccagcgatctgctggaaaagggccacatcgactatatcgtcaagcgggccatcgctctgggcgccgaccccatcaccgctgtgaaggtggcctgccacaacgccgcccggtatttcctgctgaacaaccggggcgctatcgcccccggctatctgggtgactttgtcatcatcgacaacttccagtccttcgagatccagcaggtctacaaacgcggcgagctgatggtggaccacggacaggtccgggacttccctgtccccgctatcgagccctacctgacggagcgggcccacagcaccttccatgtggaccgcctcacggcggaagacttcacagagacccgtccccggggcatcatcggcatggtcaatggagagatcaccacggtggacgccgggtattccgaccggatcgacgtggagtacgacgtgctgaagatcgccgtggtggagcgccacaagagcacgcatcacatcggcatcggctttttgcagggctacggtctgaagtccggcgccgtggccacctccatctcccacgactcccacaacatcatcgtggtgggcaccagtgaggccgacatggccgcggcagccaaccgcgtggtggagcttggcggcggcattgtggtctgggacggcggtgccgtccaggccgaggtcccgcttcccattgccggcgtcatgagcgaagaacctctggtcacggtcaacgaaaagctggaagccgccaaggagaaggccttcgccctgggcgtcggccggggcattgatcccttcatgaccctgagcttcatggcgctgccggtgatcccctcccttcggatcaccacccgaggcgtgttcgacgtcaccagccagagctatgtttaa

SEQ ID NO: 1115 - DNA, 2265 bp, Unknown
  Artificiall/Consensus sequence
aacggcatccaggaggtcaaaactatgatcacagtccacaatgaaggcgtgttcctgcgcgccggcgtcccctgttccagcgccccggtctccccggaggagggacggcaggaaaccatggcctaccgcatccttcagtcccacaacacctccggcgcccccgatcatctgaagatccgctttgatgcgctgatctcccacgacatcacctatgtgggcatcatccagcaggcccgggcctccggtatgaaggcattccctgtcccctacgctctgaccaactgtcacaacagcctctgcgccgtgggcggcaccatcaacgaggacgaccaccagtttggtctctccgccgccaagaagtacggcggcatctacgtgcccgccaaccagtccgtcatccactcctatgcccgggagcagatggccggctgcggcaaaatgatcctgggctctgactcccacacccgctacggtgctctcggtaccatggcagtgggcgagggcggcccggagcttgccaagcagcttttgtgcaatacctgggacatcccctatcccaaggtggtgctggtctacctcaccggtgcccccaagcggggcgtcggccctcatgacgtggccattgccctggtaaaggccacctttgcctccggattcgtcaacaactgcgtgctggaattcgccggccccggcattgcgtccctccccattgattaccgcaatggcatcgacgtgatgaccaccgagaccacctgcctctcctccatctgggagacggacgaggtgacagagggcttctacaaggcccaccagcggcccgatgactaccagcccctccaccccggcgaaaacgcctggtacgataagtacatcgagatcgacctttccacggtggagcccatgatcgccctgccgttccatccctccaacgcctggaccatccacgagtttttggaaaacgcggaggagatcctcacccaggtggagcaggatgcccagaagcgctaccccaaggcccatgtcaagctgaccgacaagatccacgacggcggcgtgtgggctgaccagggcgtcatcgccggatgcgccggcggccttttcgacaacatcaccgaggcggcggacatccttcggggcggctccaccggaaacggcaccttcacgctggatgtgtaccccaccagcgttcccgtcagcctggagctgacgaagatcggtgccacggcggatctgctggagaccggtgccgttatcaagcccagcttctgcggcccctgcttcggcgcaggcgacgtccccgccaacaacgggctctccctgcggcacaccacccgcaacttccccaaccgggagggctccaagcccgcggagggccagtttgccggcgtttgtctgatggacgcccggtccatcgccgccacggctctcaacggcggcaagatcaccgccgccaccgacgtggactatacgcccgtccaccacgattaccactttgccaagagcgtctatgaccggcgcctttactacggcttcggcaaggccgatcccagtgtggaactggtgatgggccccaacatcactgactggcccaagatgcagcctctggcagaaaatctgctggtggaactggcagcggtgctgcgggacgaggtcaccaccaccgatgaactgatcccctccggtgagacctcctcctaccgctccaatcccctgcgcctggcggagttcaccctctcccgccgggaaccggcctatgtgggccgggccaaggccgcagcggcgctggaagcacagcggctggagggccaggctccggagaccctcaagtcgttgctggataaggtgggcgacggcgacgcgctgctgaagaccacccagttcggctcctgcgtctttgccaatcgtcccggtgacggctccgcccgggaacaggccgcctcctgccagaaggtgctgggaggcttcgccaacatctgctacgagttcgccaccaagcgctaccggtcaaactgcatcaactggggcatcctgccctttaccctggaccagggcaccgacttcccctacgaaaacggcgactgcgtctttgtccccggcatccgggaagccatcgcctccggccgggaggacattcccgccaaggtgatccggaaaaacggtgatgtggcggatctgctgctccacgtccgtggactgacggcggacgaaaaggagatcatcctggacggctgtttgatgaattattacgcaaagaggactgaatga

SEQ ID NO: 1116 - DNA, 1398 bp, Unknown
  Artificiall/Consensus sequence
atgaacgcagatgttgtcattgtcggcgcgggtcccgcggggatctttaccgcactggagatgatcaaaaaaggcagcaagcagaaaatcgtcatggtcgagaagggccagccggtagaaaagcgccactgccccaaggacaagaccaaaaagtgcatgaactgcaaaccttactgtcacatcaccaccggtttttccggtgccggtgcattttctgacggaaaactctctttgagctacgaggtgggcggtgatctgcctaccctgatcagcccggagctggcccaggagaccattcactatgccgatcagatctacctggaattcggcgctgatacccatatcgagggccttgagcacgaggaagagcgcaaggagatccgcaagcgggcaatccaggcgggactgaagctggtggactgccccatccggcacatgggaaccgaaaaggcccaggcgatctatctggccattgaacagttcctccaggagcatggggtggagatgtactttggctatgagtgcagcaacatcatcctggaaaacgatgtgtgcaagggcgtggccatttctaacggaaagaccgatctggaggtctacgccaagcacactgtggtggccaccggccgccggggcgccgactggttggagaagctgtgcgcggagcacggcatcgcccatgctcccggcacggtggacatcggcgttcgggtggaagtgcgcaacgagatcatggagacggtcaaccgggtgctctacgagtccaaactggtgggctatcccaagcccttcaagaataaggtccgcaccttctgccagaaccccggcggttttgtcagccaggagaactacgacaatgacctggcagtggtgaacggccactcctataaggacctcaagagcgacaataccaacctctccattctctgctcccacaacttctccgttcccttcaaccagcccattgcctatgcccagaaggtgggcgagctgaccaacatgctggccaacggtcagatcctggtccagcggttcggagacattctggacggcaagcgcacttggcagaaggaactggctcagtccaacctgcggcccacgctgccggacgccgtggccggcgacatcactgccgccatgccctaccgggccatgatgaacatcatcaacttcatccaggccatggattatgtggtgccgggcttcgctgccacggagaccctgctctactctcctgagctgaagttctactccaaccgggtgaagatggacaccgatttcaataccagcctccagggcctccattgtctgggcgacagctccggctggacccggggcctcatgatggcttccgttatgggtaccctgatggggcgcaagatcgcggaagagggctga

SEQ ID NO: 1117 - DNA, 1560 bp, Unknown
  Artificiall/Consensus sequence
atggggctgagaatcatgggcgctgacaatgtcatcgagatgcttcacatcaccaaggagttccccggcatcatcgccaacgacgacatcacgctgcagctgcgcagaggagagatccatgcactgctgggcgaaaacggcgcgggcaaatccacgctgatgagcgtgctgttcggcttgtaccagccggaagcgggcgtcatcaagaagaacggacaagaggtcaagatcaacagccccaatgatgcaacggcgctggggatcggcatggtccaccagcacttccagctgatcgacgtgttcaccgtgctggataacatcatccttggcgcggagaccaccaaaatgggctttttgcagaagaaggcggcccgggagaaggtgcaggccctctctgagcggtacggcatgaaggtggatctggacgccaaggtagaggatattaccgtcggcatgcagcagcgggtggagatcctcaagatgctctaccgggacaatgagatcttgatttttgacgagcccactgccgttctcacaccgcaggagatcgacgaactgatggacaccatgcgggagtttgccaaggagggcaagtccatcctctttatctcccacaagctcaatgagatcatgtcggtggcggaccgggtcaccgtgctgcgcaagggcaagtatatcggcaccgtggagaccaaggacaccgataagcagtccctttccaatatgatggtgggccgcccggtgcagctggaagtggtcaaggctccggcccagcccaaggagaccgtgctccacgtggagggattgacgatcgcgtcccgtggacaccacaagcgcaacgccgtggatggcgtgagctttgatgtacgtgccggtgagatcgtctgcgtggccggcatcgacggaaatggacagacggagctgatctatggactcaccggtctggaaaagaccaagagcggcacggtgacgctctgcggacaggacatttcccacgcctctatccgtcagcgcagccgttacctcagccacattccggaggaccggcacaagcacggactgatcctggacttcaccctggagcagaacatggtgctccagcgttaccgggagccccagttccagcacatgggattcatcaaggacggcgcggtccgtacctatgccaagaagctgatcgaacaatacgacgtccgcagcggacagggccccatcaccattgcccgcagcatgtccggaggcaaccagcaaaaggccatcatcgcccgggagatcgatcgggcgctgccgctgatcgtggcggtacagcccacccgcggcctggacgtgggcgccattgaatatatccacaagcagctggtggccgagcgggacaagggcaaggccgtgctgctggtgagtctggaactggacgaggtcatgagtctggccgaccggatcctcgtgatgtacgagggagagatcgtgggcgagctggaccccaagaccactacggtgcaggagctgggcctttacatggccggcgccaaacggacggcaaaggagggagaaacggcatga

SEQ ID NO: 1118 - DNA, 1722 bp, Unknown
  Artificiall/Consensus sequence
aagccccgccgggccatcggcaacgcctttacccggacgctcctcaatctgggcgtgacggtgctgttcggcctgggctacttctacgcagagctgccggccatcaacctccacgcagaggagttttatgtctttgcgtttttgctctgcgcagtgtactgcgtgtgcgcggtgttcacctctggcttccagggggacggcgttaagggatacgcgcagtttgtgaaaaagcagtgcacggtaccgtttctggtgctgctggcgctgatcgccaccatcgctgtgggcgcggcttcctcttgggtagtgattcgggcgggcagctacagtgagctgctgtccctggataccggtgacttcaccgcggaggtggaggagatcagttacgaccagatccccatgctggacgcggactccgccgagcggctggggagccggaagctgggcgagctcagcgacatggtctcccagtttgagatcctgccctcttatacccagatcaactatcagggccgccctgtccgggtgacctccctggcctacggcgacctggtgaagtggttcaccaaccgttctgacggcctgcctgcctatcttgttatcgacatggtgacgcaggaggcggaagtggtccgtctggacgagggaatgaagtatactccggtggagcacttcgggcggaaactggaacgccatctgcgtttccattatcccaccatgatgttcgccgatcccgtctttgagatcgacgaggagggcgccccctattgggtctgccccagaatggtcaagaccatcggactcttcggcggtacggacattcaaggtgccgtgctggtggatgccatcaccggtgagagccagtactatgaggaagtgcccaactgggtggatcatgtctacgatgccgatctgatcatggaacagtacgactactacggcatgtataaaaacggctttttgaactccatcttcggtcagcgggaggtgacccttaccacagaagggtataactatatcgccatcggggacgatgtttatatgtacaccggtgtgacctccgtcacctccgaccagtccaacatcggctttttgctctccaaccagcgcaccaaggagacccacttctactccatcgccggtgccacggaggcctctgcccaggccagcgcccagagccaggtccagcagatgcgctataccgcgaccttcccgctgctcctgaatattgccgaccagcccacctacttcatgtccctcaagggtgaggacggtctggtgaagatgtatgctatggtgaatgtccagcagtacaacattgtggagaccggcggtaccgtggcggagtgcgaggccaattaccgccgtgccctggccaacaacggccttattcaggacagtgagacagaggtggtccccagtgaccagaccgtggtcccgggcacgatttctgagatccgcagtgccgtgatgaatggcaatacctattatttcttccggctgggaagtgaagatcaggtcttttaccgcgtcaacgccgcggaaaatccgctggcggtgattttgaatgtgggagatgcggtggagctggtctgcaccgctgccccggagaacgcatccggtcggagcatcgtggacgcctcgtcgatctccttggagaatggggattatcaggaagcgctgctcccggaatccgcagagcaaagccaggcgcaggcggat

SEQ ID NO: 1119 - DNA, 1176 bp, Unknown
  Artificiall/Consensus sequence
atgcgcctggaccgcggcgcacagcaccggcaagcaggaacgtgcccgcctgtgggcggcaccggaaaagtctttcgacaggcttgcagaaaggatggtaccgtgaatcattttcatcagatcgctgccctgctggacagctacggcctggatgccatgctgctcaccggcgaggccaaccgcttctatgcctccgggttccactccgccggaacggacggcgtggccctggtcacccgcaagaaggcgtattactttaccgactcccgctatatcgaggcggcgggccgcagtgtccagggagcggagatccgggaagtgggcccgggccggggatacggcgtgctgctgagcgaggcgctgggcgagcagcaggtgtgtcggctgggctatgaagaggcgtatatgacggtgctggagcatgagcgctaccgcaaagcgctgccctgcgatctggtgccggccacagagcttttgtggaagctgcgggctgtgaaggatgacgaggagctggacgccatggtggcggcccagcggatcgccgaaaaggcgctggaggtgatcctggaggagatccggcccggcgttacggagaaggagatcgctgcacggctgcagtatctgatgctccatttcggggcggagaacatgtcctttgaccccatcgtggtctccggccctaatggcagccttccccacggcgtgccgggggaacggaccatccagaacggggagttcgtcaccatggacttcggctgtatctatcacggttactgctccgatatgacccgtacggtggcggtgggatttgccaccgaggagatgcagaaggtgtaccagacggtgctctccgctcagcaggcgggcatcgccgccgcccgggccggaatcaccggacgggatgtggacgctgctgcccgggcggtcattgccgccgccggatacggggcgtatttcggccacagcttcggacacggtgtgggcgtggagatccacgaggcccccaatgcgtccccctccaatgaactgcctctgcccgccggcgcggtgatctcggcggagccgggcgtgtatctgccggggaagctgggcgtgcggatcgaggacgtgatcctgctcacggagaccggctgccggaacctgaccaaggcccccaaggagcttctgattttgtga

SEQ ID NO: 1120 - DNA, 2229 bp, Unknown
  Artificiall/Consensus sequence
atggcaaatcacagcctggtcatcgtggagtctcccgcgaaggccaagaccatcggcaaatatctgggcaaggactttacggtaaaggcctgcatgggccatctccgggacctgcccaagagcacgctgggcgtggacctggagcatgatttcgagccggtctataagcccatcaagggcaaagaggacatcatcagcgacctgaaaaagtccgccaaaagcgcggacatggtgtatctggcaaccgacccggaccgtgagggagaggccatttcctggcatttgaaacagctcctggacctgccggacgacaagtgccggcgggtgaccttcaacgagatcaccaagaacgtggtgcaggagagcatccgggagccccgggacatcgaccagaagctggtggatgcccagcaggcccgccggatcctggaccggatcgtaggctatgaactcagccccctgctgtggaagaagatccgccggggcctttccgccggacgggtccagtccgtggccacccggatggtggatgaccgggaccgggagatcgaggccttccagccggaggagtactggacgctggacgccaatctcctgggcagcgacgtcaagcgcctgccctttgccgcccggtatcacggcgtaggcggcaagaaggcagaactcacatccgccgacgaggtggaggccgtggtggaagccacgaaaaacgctccctttgtggtcaagagcgtcaagcggacggataagcagcgctctccctctccgccctttaccacctccaccatgcagcaggaggcctcccgcaagctctccatgacgccccggcgcaccatggccattgcccagcagctctatgagggcgtggacatcgagggcgagggcaccgtgggcctcatcacctatatgagaaccgactccctgcggctttccgaggaggccatcgcctccgcccgggaattcattctgggccgctacggcgcggattactatcccgccaagggacccaaccgctacaaggcgaaagccaccgcccaggacgcccacgaggccatccgccccagcaacgtgaactggacgccggagcaggtgaaaaaggacctgaccggcgagcagtaccggctctaccggctgatctggagccgttttgtggcctgccagatgtccaacgcggtctatgacagcgtggcggtggaggtggaggctgcggatcacagcttccgggccagctcctccagcctgaaattctccggctctaccgccgtgtatgaagagggccgtgacgaggagaaggaggagaaggaatcccccctgccggcactgcgggagggggagaccctggagctcaaggacttctcccgggaccagcacttcacccagcctcccgcccactataccgatgcaacgctcatccgcgctatggaagagcagggcatcggccgtccttccacttacgcccccaccgtgtccaccattctggaccgggagtatgtgatgaaggagggcaagtaccttcacatcacgaacctgggccgggtggtgacggcgctgatgaaggagcgtttctccgacattgccgacctgaaattcactgcccatatggagcagcagctggactccgtggaggagggcaaaaccgcctggaaggatgtcctgcgggacttctacggggactttgaccagaacctcaagcaggcggagcaggccctggagggcgtgcgcatcaaggtgcccgacgaggtcagcgaggagatctgcccggagtgcgggcggaacctggtggtcaagtccggccgcttcggccgcttcctggcctgcccggggtatcccgagtgcagcttcaccatgccgttggtggtggagatgccgggccgctgccccaagtgcggcggacggctgatgaagcgtaccggcaccagcaaaaagactaacaagcagtatacctattactgctgtgaattcctcaacagcaaggacgagagccgcaagtgcgacttcatgacctgggacgtgccggtgaaggatgactgcccggtgtgcggccagaccatgttcaagcgggcgggccggggcttcaagaagcccttctgcatcaacccggcctgttccaacttcctgccggaggagaagcggggctatccccgcaagcccgcccaggacaaaacggagggcgcggcggaagaggcggcggagcagtctgccgcagagacggcaacgaaaaagcctgcg

SEQ ID NO: 1121 - DNA, 1599 bp, Unknown
  Artificiall/Consensus sequence
gtgcggtttgaggagaagctcaagcgatgcagccgtgaacagctgtggcaggagtactgcggctttttggacatgagcctcgcggaatatatgtatacccagcgccggctgatggaagagcagctggcgctttggtgcgcaagcggcctgggccgtcagctcctgcggggaagtcatccccggaatctggatgagctgagacggatgctgcctctgacctcttatgccgactatgcggacgtattgctggccaagcggacggaaatgctctgcggggaacccgctgtctggatccagaccacctgggagggcggcctgcggcccatcaagctggcaccctacactcgcagcatgctggatacctaccgccataacctcctttccaccatgatgatggccagcgctcggaaaaagggcgactttgatttgaagcggggggaccggatcctctacggcggcgcgccgctgccctatgccacaggtctgatgccctccctttttgatgaggacatcaacttcacctggctgccggactccaacaccaattccgatctgagtttcagccagcggatcaaaaagggctttgccatggccatgtccggcggcgtggacttcttcttcggcatcggctccgtggccaattacattaccgagaatttcggaaagagcagcggcggcggacaccggggactgcgggtctctcccggcaatgctgcgcgctacctgcgggccaagtacatcagccggcgggacggccgccccatcgtgccgggggatgtgttccgcctcaaggcgtttttcttcgccgggaccgatgccaagtgctaccgggaccggctgacccgggcctggggcatcgccccggtggagctggccgccggaacggagtccacctgcatcggcgcggagaattgggagcaccggggcatggtgttcttcccggatgcctgtttttacgagttcattccggagcaggagatgcgccggaacctggaggagccggactaccagccccgcacctgcctcatggacgagatccaggccggggagacctacgagctggtgatctccgtgcttcacggcggcgccttcatgcgctaccgcatcggcgacatgtaccactgcgtctccgccggcggcgggcagctgccccggctgacctttgtggatcgggtgcccaatgtcatcgacattgccggctttacccggatcaccgtctcctccatgcaggaggtcatccgcctgagccggctggagctgggggactgggtgctcaaaaaggagttcaaccagaaggaggaccccttcctccacatgtatctggagatcccgccggacgcccagagcagcgaggtggtggccaagtcggtactgacggagcacctgagcctctatttcaagtattttgacagcgactatggggatttgaagaagcttttgaatatggagcctctggagatcaccattttgaaatatgggaccatcgccgcctatgaaaagcggatgggcacccgcctgccccggatcaacccgggcatgctggacatcatcggcctgctggcgcaggaggccgagggagaaggcggggtgcggacgtga

SEQ ID NO: 1122 - DNA, 1920 bp, Unknown
  Artificiall/Consensus sequence
atgagcgaaggacagaagagaacctatcagcaaactgccaagtcccgccggggcggtaagcgtttggccggtaaggaaaaccagcggccggcagaggcaggccatctgggagatacgggtcggatccccaccggccggggcaaccggatcccccagacacatgagtctgtggaggagccggtgcaggagcgccggagcgccgcggccgtgcaggaccggacggaggcaaagccgtctgcgcccatctggcaggaggaacccgccgacgagcagccccggaagcatgccaccctacgggagagattccaggcgtggcgggaggatgacggcggctccatcagcccctttattaccttatataatactgccgctgaaaactggaagcgggcgcggcgccgctggcgtcacatcgtccgggagaaaaaggccaagcgattcccggagtcggagcagaaggccgtacagctgctgctgtttggctggagcctggtgcccatggtgggccgccgcctgcgggaggccatgctgggccgccggaagaagaatggccgcctgatggcgcaggcccgggcctggctgacacggtacaagatccatcccgtggcattcctgggagcgggctgtgctgtggccgccgttgcggtgttctgctccctttataccatcggcaccaccgttacctataacggcgaagtggtgggcacggtggattcccgggcatccgcagaagcggcccggacggatctggagcagatcaccaccgagacgctgggtgagacctacaccattgacgattcctccatccaatattcctccggactgatgcgccggcaggaagtatccgatgaggagacgtttgaagagcagctttccgatgagatcgggctggtgacgtccgcctactgcctgtatatcaacggcgagcggatcggcgccacgtcttatgccggtgcgctggaagaactgctggaacagcttaaggccgcttccacggatgagaacaccatctcctgcgagtttgcagaggatgtggagatcaagcaggagtacgtccccacctccgaggtcatgaacctggggtatctggcggagacgctctattccaccaagaccgctgaggtcacctataccgtggccgcaggcgacacctggtccgagatcgcggaggaccacggactgacgtccaaggaactgctggcgctcaaccccggctacaacattgacaagctccagatcggtgaagtgctgacgctgtctgcctctatcccctatctgaccatgaccgttgtgcagcgggaacactatgtggaccaggtgaactacgacatcgagtacaccgataccgcctatctttacaagggcgattacaaggtcacctctcccggtgaatacggcgcggccgacgtggtggccaacgtcacctatgtcaacggtgaggagacggcccgcacggtgctctcctatgtaacgctgaaagagcctgtgacggagcagcggctccagggcaccaaggagcggcccacctggctgcccaccggtaccttccgctggcctaccaccggacggatcacctcccgcttcggttaccggtcctcccccggcggcatcggttccaccaaccacaagggcatcgacatcgccggcagctacggctctcccatctacgccgccgacggcggtaccgtgacctacgccggctggatgagcggctatggctatctggtgcagatcagccacggcaacggttatgtcacctactacggacataactccagcctgctggtgtctgtgggtgaccatgtgtacaagggccagcagatcgctcgcatgggttccaccggcaactccaccggcaaccactgccacttcgaggtccgctacaacggcgtgcccaagaaccccctgaattatctgccgtaa

SEQ ID NO: 1123 - DNA, 2181 bp, Unknown
  Artificiall/Consensus sequence
atgaagaaacacagattcttatccctgttcctggtactggcgatgctgttctccctgaccgtcaccgccggcgccgcggacacggccgccacggaagacatggccggagacatcgtgatcctgcacaccaatgacgtgcacggcgccatcggcggctatgctaaggtggcggcgctcaaagatgcatacgaggcccggggcgcctatgtgctgctgatggatgcgggcgacttcatccagggtgatcccactgtcagcacgtctcagggggccaccgctgtggaactgatgaacctggcgggctatgatgtggtgagcctgggcaaccacgagttcgactatggctacgacaaaatcaaagccctggaaaaggacgccgacttcaccatcgtggctgccaacattgaatacaacggcagaccggcttttgaggatcacatgatcttcaccacgcctgatggcaccaagatcggcgtgttcggcctggatacgcccgagacggccaccaaggcaaaccctgccaagatcaagggtgtgactttcctggctggggaggagatgttcgacctggcccaggcggaggtgcagcagctggaggatgcgcactgcgagtacatcgtctgcctggggcacctgggcattgacgcggaatccaccggcaaccgctccatcgatcttctggaggaggtagatggcatcgacgtgttcatcgacggccattctcactccacccaggaggacatcctcgtggcgctgggcggtacccagacccaggcgggtgacgttgtcatcacctccggaactgacatggtcaacggcaccgtcctgacctccaccggcaccaagctggagaacgtgggcgttgtgaccatcggcgaggacggacgcgtgtctgccaagtcctatcctctggattccctgaccgacgttgacaagaccgtggccgaccgtgccgctgccatccaggcggagatcgacaaagaatacggcgcagcttttgccaagacggaagtggatctcaacggcgagaaggagcccggcaaccgcaccgaggagaccaatctgggcgacctgatcaccgatgcactggtctggggcgctgagaaggaaggtacccatgtggatgcggcggtgaccaacggcggcggtatccgcgcctccatcgccaagggcaacatcactaagaaggacatcaacaccgtgctgcccttcggcaacacgctgagcatcgtcaaggtcaccggtgcagagctgttggaggctctggaggcgtccacctactgcacccccaccgccatcggcggtttcccccaggtcagcggcatcaccttcacggtggataccaccaaggcctatgaccagggcgatctgtatcccggctccacctattatggccccaagagcatccagcgcgtgagcatccagaccgtgggcggcaaggcgtttgacaagaatgccacctataccattgccaccaacgacttcatggctgccggcggcgatacctactatgcatttgccgctgcttctgtgaactacgacctgggacttcccatggacgaggtggtcatggactacatcaccgacgagctggacggtgttgtcaccgccgaggactatggtgcgcccaatggccggatcaccattgagaagggtctgcccttcaccgatgtggctgctgacgccgcctactatgacgaagtgaagtactgctacgacaacaacatcttcaagggcgtcaccgagaccaccttcgcccccctttccaccttgacccggggccagatggtcaccgtgctgtggcggatgaacggctctcccgcacctgcggggacatgccccttcaccgacgtggcggcagattctcccttccggcaggccatcacctgggccgcggagaagggcctgaccaacgggaccactgccaccacctttgcgcccggacaggccatctcccgccagcagtttttgacgatcctgtaccgctatgctcagctcatggagtatgatgtctccaagacggcgacgatcatcggcgtctatgccgactgggaggccgtcagcgagtatgcccaggaagccatggagtgggcggtaggctccggcgtgctgatcgccgataaggcgctccgtcccaccgatgccgccctgcggtatgaggtggccgagttcctggcgaac

SEQ ID NO: 1124 - DNA, 1278 bp, Unknown
  Artificiall/Consensus sequence
atgttacagttcaaaccagtgacccgacaggacggaaacaagctgcgcaagtactacgaaacctgtgattacggactttgcgagtactccgtgggaacgaagctcatgtggaaaaagagcctgcacccggcctgggccgaggtggcaggctgcctggtggtgcgcaactgcatcaatggacaggtggtgttcgattacccggttgcagggcccgagggcgatgaggacgccgccctggaggccattgagacagactgcctggagcaggggatcccgccggtgatctctgtggtgccggaggccaaggctgcccatctgctggcccggtatccgtatgtttccgtcagtgatgtgcgcacctggcgggactatatctactaccgggaagatctgcagttttttgccgggcggcgctattccggccagcgcaaccacatcaacaagttccgctcgaagtggccggatgcggagttccgcccgctgacggcggaggacaaggacgtcatcgcccaattctggacggactatgaagcggagtttcccaagggggacaatgccaaagcccgggatgagctggaactggccaagaaaatgctggcgctggtgggcagaccctatttcctcgccggcggcatgttcgatggggagaagctcattgccctgtccctggcggaaaaatgcggagacaccctcatcattcacatcgaaaaggcgctctactcctataccggcgtctatcccacgttggtccaggcctttgccgacgcctttggtgacggctgccagtggatcaaccgggaggatgatgcggcggaccgggggctgcggacctccaagctccagtacggcccggcaaaactggcgcccaagtaccgctttgagccccagaacgagctgctgcgccatgtctctcagatcccggatctgaaaacggaacgcctgaccctctccgccctgacggaggcggacatccctgcctacaatgccctggtgctggatggagaccggaaccgttggtggggctacgatgacgtgggcggcttgggaggcccggtggaggagcggagcttcttcgaggtggcgcagcgggattttgaaaaccggcaggcggtgaattttgctgtccggctggacgggaagctcatcggcgaggcggtgctctaccgctttgactgccggggcggcgcggaactgggctgccggatcgacgcggcctacgccggtcacggctacggcacggaagcgtttgccgctgtggccgactggggcctctaccgg

SEQ ID NO: 1125 - DNA, 1824 bp, Unknown
  Artificiall/Consensus sequence
atgcagaatgaacacctgagaaacgttgccatcatcgcccacgtcgaccacggtaaaaccaccctggtagaccagatgctcaagcagggcggcgtgtaccgggaaggacaggagaccgtggaccgggtcatggactccggcgatctggagcgggaacgtggcatcaccattatggccaagaacaccgcgatccggtatcaggatgtgaagatcaacgttgtggacaccccgggccatgctgacttcggcggcgaagtggagcgtattttgaagatggtcaacggtgtcattttgctggtggacgcggcggagggtcccatgccccagacccgcttcgtgctgagcaaggcgctggagctgggccaccgggtcatcgtggtggtcaataagatcgaccgtcccgaccagcggatccacgaagtcatcgacgaggttctggagctgctgatggatctggacgctacgccggagcagctggattctcccatgctgttctgctccgcccggcagggcatctgctcctattcccccgacgtgcagggaacggacctcaagccccttttcgagaccatcctcgaatacattcccgcgccggaggcggataaggacgcccccttccagatgctggtcagcgccattgactacaacgacttcgtgggccggatcgccatcggccgcatcgagcggggcacgctgaagcagaaccaggaagtggccctttgcaactaccacgatcccgaggctgtgctgcgcaaagccaaggctactgccatctatgagttcgagggcctgacccgccaggccgttaccgagtccactgccggcaacatcatcgccatgagcggcatcggcgaggtgaccatcggcgataccatctgcgcaccggactgtgtggaggcgctgcccttcgtgaagatctcccggcctaccctggagatgaccttctccgtcaacgactccccctatgccggccgggagggcaagttcgtcacctcccgtcagctgcgggaccgcctgtaccgtgagacgctgcgggacgtgtctttgaaggtcagcgacaccgaccgggataccgccttcaacgtggcgggccggggcgagatgtccctctccatcctcatcgagaccatgcgccgggaaggctatgagttccaggtatcccccccgcgggtgctctatcaggagatcgacggcaagaagtgcgagcctatcgagcgcctggtggtggacgtgcccgctgagagcgtgggctccgtgatcgagaagctgggccagcgcaaggccgacatggtggagatgacccccgtgggagaccggatgaaggtggagttcctggtgcctgcccgtggcctgttcggctaccgcaacgacttcctcaccgacaccaagggcgagggcatcatggcctctgtgtttgactcttacgctccctacaagggcgacatccagcgccgtggcatgggcagcctgatctgctccgagaccggtgagtccatcacctacggcctcttcaatgcccaggagcggggcaccctcttcatcggcgccggcgtgccggtgtacgagggcatggtcatcggcgtggccagccggggcgaggacatcaccgtcaacgcctgcaagaaaaagcagctgaccaacacccgtgcctccggttccgatgacgcgctgcgtctggttccccccaagcagatgagcctggagcagtgcctggagttcctggcggacgacgagctgctggaggtcacccccaagagcctgcggatccgtaaggccattttgaaccacgagcagcggatgaaggccatgcacggcaaaaagtaa

SEQ ID NO: 1126 - DNA, 1254 bp, Unknown
  Artificiall/Consensus sequence
atggacagtaccacagccacattgatcggcgccatcgttgtgatggtgatcttctccgcctacttttccgccacagagaccgcgttttccagtctgaacaagatccgcctgcgcagcaaagcggaggcgggggactcccgggccgctctgacgctctccatcgccgatgagtacgaccggatgctctccaccattctcatcggaaacaacatcgtcaacatcaccgcctccaccctgggcacggtgctcttcacccggctctttgatgcctacggccccaccatctccaccgtggtgctgacggtggtggtgctgatcttcggcgagatctcccccaagagcatcgccaaggaatctccggagcgcttcgccatgtgggcctcgccgctgctgcgggtgctgctggtgatcctgcggccgctgaacttcctcttttcccagtggaagcggctcctgagccatatcatccgcccggcggacggggagggcatcaccgaagatgagctcatcaccatggtctccgaggcggaaaacgaaggcggcctggaccagcacgaaagccagctgatccgctccgccatcgagttcggcgacctggaggccggggacatcctgaccccccgggtggacatcgtggcggtggaggactccgccaccatggacgacatcgccgccgtctttgccgaaagcggctactcccggctgccggtctaccataaggatgtggacgacatcgtgggcttgatccacgaaaaggacttccacgccgcccgctaccggggccgcaccgatatttccggctgcatcacccccgtccactacaccaccgccaacgcggaactgggcgccctgctgcggacgctgcagaagaaaaagatccacatggccgtagtggtggatgaattcggcggcaccgagggtctggtgacgctggaggacatcctggaggagctggttggcgagatctgggatgagcacgacgaggtggtagagtccatccgccgccaaagcgacggcagctacctcatcgccgccagcgccgacctcagcgacctcttcgatcttttctccatcaaggacgacagcgacgccagcacggtctccggctgggtcatcgaacagctgggccgcctgccccaggcaggggaccactttacctctgagggactggaagtcaccgtcacccgggtggatcaccgccgggtgctggagatccgggtggcagacccggaaaagacgcctgcggaggcctga

SEQ ID NO: 1127 - DNA, 11424 bp, Unknown
  Artificiall/Consensus sequence
atgaaaaaggaggggaaagtttggattaaaatatcaggggattttgcaacatttctaaaattcagatcatggaaaagatcaaacatcaaatctaaacacgtcacatcagaacaaatcagatcaaacacatcaaaacacattccaaagggggaaaaacaattgaatacgaaaatatggaaacgaatgatggctggcttactggcaggcgtccttatttttacagggatcccgttttctgcctctgcaggtgaaccgcctgtgcagatgatcatcaggggagatgcctttcagaacaggcagatcaacatttttggtcacagtcaccggtcgatcacctgttattatgtaaatccggtggaaggacatgtaccggcattttgcctgcagccgggaaagaaacttcccaatcacacccaggcatcctgggagaggtacagtgcgtcaccggaaacctccgtaccggtcataggaagttttgaccggtatcttcctatgacactggcttatgagtggatggtttcaggaaattattatgataagacccggtatgccatggtgcagacttatttctggggctgtctggcaggttttgagcaggactgggatatccaggaagagaccatgaaaaaactggaatgggctataggagacggaagggttctctccctgtttcatgaaatgaggtcggtagtggaaaagggcctggaagaatatgagtcaaatagcggaagtagtcttcctgcctggaatggccgtaaggaaaatatgatcttaaaagacggtcattatgagctgaccttagatcttagttcctgtccccagcttaaaaacgcaaactggcagttcccggataaaaactggagttttacacagggaccaggggaaaatgagatcacatttctttatacaggagaagaaccttccggacggatcagcgcaggaaacgtggaaggcttggatgaccggtattatgcctatatcttttatccgggagagtcttatcagatgcagatgggctggctggatatgcagcgtccccaggcagaagtatggtttgaaacaggaaaggggagtgtccagggcggtcagatgcagcctttagaacggttccgccacagggaagtttttgaggcagattacaaaatagatctggaaaaatattgtgcagaaacaggacagcctcttgcaggagcggattttcaggtatgggaaagttttgaccattcccagatcaatgaacatggctatgaagaaggggagccggacggaacgacaggtcaggtttacagtaactgtatgtccccggaaccggaagaagaatggctgtgtgacgtgatcaccacagatgaagagggaaaagcttttcataaagatatacgcaattacaattacagcaaaacctactgtatgggccatccggcgccggaatggatcgaatgtgatcacgaaggagatggcggtgatggagaagacggggaaggcgacgaggaagaatgtaactgtgaagaagaaaatgaacgtctcaaggagcagtggcttgaggaacaggaactgtgtgaagcttccagcgatttccatgtatccaatgaggatgaagaggaccatgaacagagtacagaagcaatggaagccatgttagaggaccgggatgaaacctatgaaaattttattgccctggagtatggctatacattaacagagaaaaaggccagaaccggctatatggtccacgggacacacagggaagattttgaaatcgagaaaataacagtggcttccgcccaggcacagagaaatacagcaggaaagaaaggtacaggaagagaagatccgcaatcagaggtgtatctgggggaaaatatgcagctgcagtttcatcccgctccacaaaaaacagaaaagaaaaacggatatgcttatgaaaccggagcgcaggaagaaagatcagcagaggaacttagaacgatccatgaagtgaagctgaccgaagatatttatgaagaagaggaagatgacgaggatgagatctgggatgaccgggcaacggaaagtaatgcaaagataagcaggacaacagcaaatacggcaacagaaagcaaagcaaccgcaagtgatgcagcagaagataacgcagttggaactgctgccactgcatcgaacgcaaagaaggatctggaaacgacagaacaatatatttatacaagagaagaaatttccctggaaccgatttctttatgggagtctttacgggaaaatgtatggaattctgtaaaagcaatctttttttcctcagaagacgatgatgattttgaggggataacagcatttcttcctgattttcaggatgatgatctgggagagatggatgtttcctgttttggtgatccatcaaattccctttactgttttaaagtctgggaccaccgcacagaaggaaggatctatataaataaacgggatctgcatctttatgaaaaggaccaggaagaaagctatggccggacccagggagacggaactttagaaggtgctgtatatggcctttttgcagccgcagacattgtacatccggatggaagatccggtgtgatctaccagaaagatgatctgacagccgtggcagcaacggatcaggagggtaatgcctcattttttgcatacacggaggtcccgcatacagttgtaagagaagatggaacaattgaggaaccggaaaatttcctggggccggaaaccttatataacggcagtaccattaattcttctgatcatggatttggaagctatacctatccggacagaaaggaagaaaatggaaattcctggatcggaagaccgctgctgatgggaagttattatgtgaaagaactaagccggtcagagggatatgaactgtctgtaacaggaaagaacctggtggagacgaaccggggggcaggagaagaaaatgtagtgcgaaaggcagggcaggtacaggtaagcgcaggtctgtctgagcataacagtatggaagcagacggttcctggaatgattttacagtagaagcatttggaacagaaaaagggtatgagatcacagtttccggttatccggaaaatacaaagttttaccgtttaagttcacaggagcagagggaaaatttaaaacaaatcacaggaatggaaaaaattcccaaaatggatcatttgggaaatcctgtatatgaaaaggcaaaaggcggagaattaaaacgggatcttaatggcaatcctgttttaaaagcagatgcgggggaagacgaaaaagtacctgcatctgagactgtgccctatcatttccggacagccccttatataaaaggagaagcaaaaccggaagatctgtctaaatgggatgaagacctggatcctgattatgtgatggaacaggcacaggcaatgcttatgcagttaggctataaagaagctgacggggaaggggcaccatgggtttctataaatctggattctatgaatggaaaggccgtagaacagatccttgactggtatacagaacacagtttttataatatggccgccgtttctgagataaaggaagaagagggacagtggcaggcaaaacttttttatgactattctggaaatacagaagcaggatctgcagtttatgaccgggcagacggacagctttatgtgaaaaaagaaagggaaaatggtcattactggatctgcattcccaaaggaaaattccgtttaagcagtcataccgcttacataaaagaaaaatgggaatatgtggaagatgagcttaaattaatttatgagcctgtttatgaacggtatgaagaaggagaggttcttttagatccaaacggagtaccgatccaggaaatggaacaggtccccatttttgaagaacgggaaaccacgtatgtgactaggaaagaggagccggtagaggctttctgggatcctgaaaaaagagagtatcatattttggtggaaaatgaaacagactggtccgtggaaaaagaagaggtagaagaaacgttccgtgcagtgaccggacaaaccaccatttctgtaaatggaaaagaggtttcttataatcagtatctggtatccatgggagcagctgtggatgtagaagcagaacaggaagaaacagatcctggaagttttgtaaaatatgttcatctggcatatcctggtcagaaccagacagttcaggatggtggaacagaaaaagaaccggttcaggttttggaacgggcgatccggcagccggtacgcattaccaaacacatttcccagtcttcttatgaaaatgtaaatacctacggttctgtgcataatgatccagtcactacctttttaggcttattccgtaaaaatggatctgcagaaggccggaaacttttagatcagttttcattcaggatctacctgaagcaaaatcttttaaacatttatgtggatgatgagggaaagatcctgtcagaagatatcagttcaccagcttataaggagctggtacagactatttatctgccgccggaagatgcagaaaacaggggtcatcagctgatggaaagaaatgaggatggcagctgcaattaccggaaattttttgacgcaatggaaggcgcagaaaagaagaagggcggtatttatcccaaagaggtactgacccagtttgccctggatcattatgatataagatcctataagaaagagatcttaaaagaccggccatatatggacagtgacagggcatacaaacaggctttagaccaggcgagaaaagaagcagcccgttatctggatcagtttacagggttaaaagagcgtctgtctattgaatgggaacgggatgcaaatggcggtacggatggtaacaggaagaccatccagtgtaaccagagaaatggaaaagacgattattatgagtattccattcctctcccgtatggtgaatatgtgatcgaagagcagatgccttctgatctggaaaaagaactggcaaacaggcattataagattgaggaaccaagggagatcacactgccctttgtgccggagatcatacgaaatgaggataccggggaagaaacggttttagatgagatcggcagtgcctattttcgttatcacagtagtgacagtccggatgaactgatccgcaaatacaagatccgctttaatgaagaggaccggaagatcctggcagatggtatagatggttcctttgccatttatccttatgggcttgataaagatattttgccggaatacagtacgggaactatttcacaaagtgaggatcatgtaattttagatggtgtgatctatgacggaagtgaacgggaaaatggccagatggaaatatgtgaccaggttcctggtatgaaggggaaaaatactgccattgagggcaaatttgcgccgatgctggtaccgtggagcatcctgacaccggaatatgaccgaatcaacccggatacggggaatatagaaaccttacagcctgggggaagcggtgccggatttaattatattgcatttgcccaggaagattttgaaaatacctattttaattcaaggctgcggatcgaaaagatcgacagtgaaacaggggaaaatctgatccatgagggagctttattccgcatttatgctgcaaagcgggatgcacagaaaaacgggataaacagtgtgaccggaaccggacaggtgctgtttggaccggcagaggatgcagaaggaaataaggttgtggacgcagatggaaaggagatcctttatccgagagtggggcaggacaatggttcacaggatgatcttcctgtgaagttagaccaggatggggtccctctttatgatgaaacccagcggatcagccaggtggatgaaaccggcacagagagagggatattccgctcttttactacactgcgggaagtcttgatccatggaaagctggaaaaactcccagtagggtatattgaaactcccagacctttaggggcaggtgcctatgtcctggtagaagtacaggcaccggaaggttatgtaaaaagccgtccggttgcttttgaagtttatgggaacgaagtatcctattataaggaaaacgtgtacagagacggtacaacagatggatatgaacggaaaacagctgcaaactatgagtatgccattccggtaacgggagatggaaataaaaatgcttacgaaacagtcagccagatcccggtggaaaatcatccttctgtaatgcggatccggaaagtagaggatggcgattccctggttggaaatgaaaatggcctgttaaaaacggatgctttaggccaggaagaaacaagcggcggcctggaagaagatatatgggtaaatgacagaggagatgaaatcatttaccaggtatatggaagaaaggagaagttagaagaaagaggagatgtaagagagatccattttgaccgggaactggggacatggaccgggaaagtaacaaagaaaatggatttctgttcagaagagatcatagaaggtacagaaaaagaactaaaagcaatggaaggagtaaaactcctttatgaccggaagggggaatttacaggaaaagggattcgttttaaagtaacggtctcaggagcaacactggctttataccagggactttggatggaaaaagaagaggatggaagttataagggagtaacagctgaggttcaggatggtaaaaccataaagatcactgcttctgaaacaggaagcaggcggcagatcctggagacaggaaaagatgccggtcctgccgggcttgctatatggcaggatgagaaggtggaaaaccagccggaagatctgtatttttatgatctggaccagttaaacgaagaagggcgcctggagaggacagaggacaagtctgtatacaaagtattagatgaacggggcaatttcatctgttatgcagacacaaaaacaggaatggcctttgtatacgatgatcatgaacggatcatggcttacattgcagatgaaacgagagaaaagaagctggtttattctgtccaggtctataaggatgagaatggggaggctgtttataaggaaaaacgttctgtagatgatgaaaatggtctgcctgtttacgacaaacaggggcatttcacaacaaaggaggaacgctggaccagtgacaacagcacagactccaaaggagaagcagagcgaagaggaggccttcatgagatccggcgcctgccttttggggcctatatccttcaggaagaacaggttccttttgaacagggctatgtgcaggcaccttatcagggaattctttttaaagacagtatagagcctcaggaatatttccattccaatgcctttacaagggcagcgttcgccaaggtagacacccgtacacaggaagagatcaaaggggctgtgatgacgttttatgaggctgcgacagatgaagcgggaaggatattaacagatgaagacggaatttatctgcctggaaagaaatatgcttcctgggtcagcggttatgcctgtgacgatcaaggcaatgtgaaaacagatgaggaaggaaaccggatcgaaacaaaagaacctcactggatcgatcatattccggtaggggagtatgtattagaagaaacagagtgcccgtatctgcagggctatgtgcagagaaaacggcagaatatccagattttggaaacagaacatgtacagtcttttactatggaagatgattttacagctgcagagatccgcaaggaggatggaaagacgggagaacttctctatgaagacagtctggcaaaactggtcctttaccaggtgccggaaggagaagaagataagccgttagcggatcttatgggagaagataataagttgttagactttgaacgggccggttttaaagaatggatggaaatatgggctacaggaagagaagaagcagacgctgccggcttaaatcccattgcaaaatacgatcatcggtgggagaatgtgccgggtacgcttaaaggcaggtattgctttacagaagaaggaacggtacggtttgaatatcttcctgtgggattttacattcttgcagaaaaagaaacgccttccggttatgccacagcggatccaattttatttgagatcacagataccggtcatttggaaaaaatccatcaggtggttatgaaagatgaacctttgagtcttgtggtcagcaagaatacgattaccggaggaaaagaagtagcaggagcaaagctgggaatctatccggtggatgaagagggcacagtcagcgaaaagccgctgcttttgcatattccggaggaagaagggcgttacagggatgaggaagccatatggttttccggaactgatggagtgtatacagaagaagagaatgaaaatggggaactgccagaaggatttgaagtgggagatctgaaaccacatctgatcgaatacattcctgttggttcttatattttaagagaagaaatgacgccttatggatttttacagtctgtggatatcccatttgtaatagaagataccagagaaatccagaaaaaggagatgcaggatgaaataccagaaggcaggctgacggtgatcaaacatgatgcagatgatgcagatcaggttttagagggagcagaatttgaactctttaaccagaccttgggcatatcctgtgaaaagcaagtaacggatgaaatgggaaaaactcagttttcttcccagcctattggctgcttggatcaggaaggaaaattcagttcttatgattatctggtaaaggaaacaaaagcagcgccgggacatatgctttctgaaaaaacgctggaattccagtttgaatataaagatgaaaaaacacctttgatagagcttacttatgacccggtaaatgacagcaaccgtgtactggtgaaaaagcttttaagggatacagaagagtatctggaaggtgctgttttgagactggaacgggaagaaaaggtaattttggaaccggatgaaagaggtgatcagggcgaaagtcagaagaaagatcagaaaaaatatcaggcgaaagatcagatgaaagatcagatgaaagaggagaagacctgggtagtagtagaaacatggatctcaggaaagcagccccatctgatcaaaggccttacagccggagattacagactggtggaagaaaaggcgccgactggatttacgaagtcagaagaaccggtgtattttaccattacagatggaatgacagaaataccggagattacactgcgcaattatggcaccattatatccgtagaaaaaagagaagccagttcagaaaaacttctttccggcgcaaagctggaactggtatgcaaagataccatggaagtgatcagccaatggatatcagaccaggaaaatggtcaggtatttaacggtctggaaccgggaacttatatcatcagggaaatagaagcaccggccggatatgagaagggcaaagaaatggagatccggatcttagaccaggcagaaacagtgcaggagtttgttttctataacagccggatccgttcatctggcggaggcggaagtcatacagtgccaaagaaactgtatatttcctttaaaaagacagatgaagagggagaacctcttgcaggagctgtgtttgcattttatgaccagacaggacgattggcaaagatagcagaaagtggcccagatggaatgttcaagatcatttgcccgccaaatggaacttatattttcaaagagataaaagcaccggatggttatgaactgagtcaggaactgtatcattttacagtagaaaaggatcagaatgtaaaaggtgtatttaagatcaaaaatgaaaagatacagaaaaagacaaaaggaagaatccaggctttttaccaggtaaaaggaagaaatgggaactttaagggcttaaatggaagatattccggcagcagtgttaagacaggagacaacagtcagattggatggatcctgttggtgacatgtgtgtgtctggcaggggctggctggtgtttttctgatagcagccgaaaaagaaaaaagatggttttgtttctgggacttgtgatgggtgcagtgagcctgtttgcattcagtgcaatggcccaggaacaggatgcaaatctctatgatgaaagcttttatgcatcccaggagatcatttacaaaaagatggaaggagtggatacagtaccggagactgcctgggtccaggtaaaggaccggacaacgggaagaaaaacaaagcggatcctgcctttagaacagttcagccgttttaatgaacactgggaagatgggctggagatcacgatagaacaggaaaaggaatttcagaatgagataacagaagcagaaatattagacgaagcgggtttacccgcttcggactatgagatcacacagatcgagaaaggagaagatggaaaactggttgccaggggcagaaaaaaggtatttgactgcagggcagtatacagtgggctgatcgcagagaaagattgggacagggaagaaatgccggatacggatctgaaaagagaatgggaacaggatgtagaattaaaaccagctgtcacaggatcaaagtttgtaggaaaaatggttctggcagtggtaaccggcagctgtgtcggtattggcgcctactggatcatgaaaaagggaaagttaaataaagcaagtttaaagatcagggaaaagcgccggatcttagggataattcttttgacaggagctgcagccggaatagtctataccggaaatacagtaagaaagtatcgtctggctgccgaaaaatacgaaagtatccgcagggaggtacagaaaacagaaacttcttatgcccaggaccattctggtacgtctatagatgaaataacaatagaggaagcaaagttaaaagaaatcaatccggattataattgctggatccgtattccgggaacgtccattgattatccagctgtctggggaaaggatgacaaatattatttagatcatggatttaacggggaaaagcagtcaggaggaacaatctttgcggacagccagaacattccttttgtatcagccaataccattttttatggacataacatgaaggatggttctatgtttggtgatctgaaaaaatacagggatcccggatttttaaaggaacatcccaatgtagagatcttttatcaggggcaatggatcacctgccccattatcctggcaaaagtaacagatgagacagatggaacaccttatcaaaaaggagaaagaaagatactgaccttatccacctgctatggaaccagtaaacggatgatccttcaggcacttattccggttgcggggggaatgaattga

SEQ ID NO: 1128 - DNA, 3915 bp, Unknown
  Artificiall/Consensus sequence
atgccacaggcaggaggtttggaagtaaaacatgaaaaaaagaaaagaacattgatgcatattttacttctgcctcttttactggtggtattatttcagggcatcttacctttttccatgctcctttccagcggtgttaaatccattatggagagtaatgcagtagatcttgacagttatctggtggaaaacagcaaggtaatactggaaaatgccatgatcgagcagtggagtgctgtgcgcaaagagagcaactatctgaatagtgttctttctgatctgttaaaagaacaacgggcagatatagaaaagtttacaaaggataaggaacttcagaaggaatatacccagcgtgtatttccggagcttttagagtctttgcgccgtgataccacctgcggtgtgtttcttgttatggcaaatgatcagccaataggggcaccgggagattttacgggatttttcctcagggactctgatcctgtgaccaaggcagatacaaactctgaccttcttttggagcgcggggataaaactctggcccgtcagtggggaattaccctggataattcctggtcccctgcatttcgttttcagggaaaaggtatcagggaaagtgatgattttttctatgaaccttacacagcaggtatggctcatacaggggtagatatggccagtttaggttactggtccatgccttttatactggaagattatgaaatggataaccataaaatgatcacatattctgtccctttggtcaatgatggtgtgatctatggtgttgtgggaacggaagtttctgtcagttatctgtgcaatacctatttccgtgtacaggatctgaacaggcaacagacagccggttacgccattgccgttgataacggagatggtacgtatgaaaatattgcaggaaaaggtaatctttatgatgcggtacagcgtgaaaatggtatttttaagctggaaagtacaaagcatgaggatcttttcaaggtaaaggactctaagatcggttcccaggagatctatgccctgttttcaaaaatgaatttgtatgccaataatgtcccttataagaatacaaactgggttttatgtggttttgtggcagaggactctattttcagtctgggagataagctgtacagcgatattttgacgactattgtggcctgtgcagttttgggactggtgatcatgagtgtggtgatccgctgcgtaacacgaccggtatacaggcttatggacagtatccgaagcggaattgcaggcttaaaagagtttgcgccttccggtatccaggaagtagatgagctgcatcaggtggttgaaaatctgacagaaagtgagatcagcacagaacatcagctcagtgaagaaaaagagcgttaccggatcgcagtagaaagttccaatgacctgttttttacataccgtgaaaaaggaaatacactggagatcgtaaacagcagggaaatggatggtttgtgggatataaaaaatgccaaaaaaaagctcctggaccgttatttttcaagggaagaccagaaaaagctcctttctatgctgcaaagtcatgagaatacaatttatggtcagttttgctgtatcaatggcaaccactcacagggacgctggatcgagatcagaggaaagaccattgcagagacaaaagaggatgatcgaaagatcgtaggttttgtccgggatatccatgaaacaaagatgcgggaactgaaacaggaacgaaagcagatgatagatcctgttaccttattttaccgtttaaaaccgggaatggaggtaattgagaaggttcgtggaaagtatccccagggtttgtttattcttgtggatatctgtcattttaccatcataaccagggactttggtctgacatttagggatgtggtcctggaagaattttccaaaatgtttctggaggtgtgtgccgaagatctttccagacctccggtgatgatccgtgcaggttctgatgaactccttacctggatccctaaaattacagaggaaagctgcaggcagaaactggaaaaactgaaagaacgtttttctgtgatgatccggcgcagtgccttaaatcttaatttccaggctggaattgccagaggggatgaaagtgtaacaaccacctctctgttaagacgggtccggatcgctgttacagaagcggaaaagcaggagatcggtgtcctttcctggaatgaggtaaaggatccgggagcacagccgaaaacatttggaaagatcgtttccatgggatatatggaacagatcagtctggcttccctggcattaaatctgttagaccgctgtccgtctattgatgcaggtctggatctgctttcccgccgcttaaaagcacgttatggaatggaaaatatgctgatcaccagttttcattatgatttcctttccagcgagctggaataccagtggaagcatcttcatggcctcatgggaaaacggggcgttgtccactgtacagaagaagagtatgaaaaattaaaccaggatgcccagatcaatgcagtgcagcctgtaaaacagctgttgtccgttgtacctgttctcaggaaaacagatatagatcagaccggtgtggggatccttatgtcagataacggacagtattccggaagtatcttccttttgggaatagaaccctctgtgtatgaaaatgaggaggacagaaagcttctctgggagatcggcattatcatccagaaccgtatcaacagagaccgtcatgatcagtctgcacaggcaaagtctgacttcctggcccatatgtcccatgagatccgtactcctatgaacggtatcattggtatgacagagatcgctctaaaagaagggcagacagaggaagtgcgtttagactgcttaaagaaggtaaaaggatcctccaaatatctgttaggtctgttaaatgatgttttggatatgtcaaagatcgaaagcggaaagatgaaactggtaaaagatgatttccagcttgataagatgatcggcgaactgtatccgttattggaagctaagtttgaggaaaaatctcagaaatatcaccaggagatccatttggtcaaccagtggttctatggggatgctttgcgtctcagtcaggtcctggtcaatctgttaagcaacgcagtgaaatattccggggatcacacggagatcactttaacagtagaggaaacaaggctttctgatggtctttctaaattacagtttgcggtgaaggatcacggcatcggtgtcagtgaagaagaccgccagcgtattttcagaagttttgagcaggtggaccgttctgcggtaggacagcagggaaccggactgggactggcaatcagcaaccgcctggtacatatgatgggcggaaccattgagcttgaaagccagatcggggaaggaagtaccttccggttttccattacgttaaagccggtcagagcccaccatgtaaaagaagaagtttccagggtggaaagagattttacaggtgtccgcgttctggtaacagaggacaatccattgaaccgggagatattacagtatattttggaagatatgggaatgtctgtggaaaatgcctgtgacggaaaagaggcggtagataagtttaccgcctccgagaaaggatattatgatctgatcattatggatattatgatgccggttatgaacggactggaggcagcccatgccatccggaccaccgatcatccggatcataaaaagatccctatcattgccatcagtgccaatgcttttgatgaagatatccgcaggtctcttgcaagcggcatgaatgcccatctttccaagccgatcgaagtggataaactgcgggagacccttggaaaactgttaaaataa

SEQ ID NO: 1129 - DNA, 3798 bp, Unknown
  Artificiall/Consensus sequence
atgaaatggacagaaaaacagcagcaggttatagacagcagaaacagaaacctgctggtatctgcagcagcaggaagcggaaaaacagcggtgctggttgaaaggatcatttccatgatcagtgaaggaacccatcctttaaatattgaccagcttcttgttatgacttttaccaatgcggcagcttctgagatgcgggagcggatcggggcagctgtggaaaaaaagctgaaagaagatcctggaaatgagcacctgtggcttcagtcagccctgatcccccaggcaaagatcatgaccattgacagtttctgcctggatctgatccggaaccattataatgcactggatattgacccggctttccgcattggagatgaaggagaactgactcttttaaaaggggatgtaatggagcaggtcttagaagaatgttacgaaactgcagatgacggctttttacagttttcggagcagtttggaagtggaaaatcagataaggcaatggaagatgtgatccttcaggcatggaccttttcccagagccatccctggccggaccagtggttagatcagtgcagacagcagatggaaaaagaagcagagggggatctggactccagtgagtggatgagatttcttttaagggatatcagccttcagatgggagaactggctgcccaggcagaagaagccctggaggtggcaagggaagaaaatggtccttttgtctatgaaccgatgctgatgaatgatgtgagccggttaaaaaagatcagggaagcagcagcttccggctcttatgaggctttttatcatgcagtatcagaactgacctttgaccgtctggcagcagccagaagcaaagagatcgatccggagaaaaaggcctatgtaagtgatctgcgcatcagggtgaaaaaagcggcagaaaaatgcagggatacctatggaagccagtcaccggaagcagcaatagaggggatcagaaataccagaattgtgatccaggttcttttagatatggtaaagcgttttgacgcagcctacacagaagcaaaaagagagcggaatgtgctggattttaatgacctggaacatcttacgctgcaggtgcttacagtagaagaggaagatgggacccgggttccttcacaggcagccggggagttaagcggacaatacgaagaaatactggtagatgagtatcaggacagtaatctggtacaggagacattgatccagagtatttccagggaacggctgggccagccaaatgtatttatggtcggtgatgtaaaacagagtatctaccgtttccgtctggcaaggccggagttatttatggaaaaatatgatacttacagcagggaagaaagcagtcatcagatgatcgagctgcagcagaacttccgcagccgtgccagtgtacttacctgtatcaatgatattttctatcagatcatgacgaaaaatctgggaggcatccgttatacagaagaaacggccctttatccgggagctgcgtttgaagagacagagaaaaaagcggggatcccggtccagtttcttgtggcagatacgggaacagaagcttttaagcagctagacgaagaggcagcagattatacagccagggaactggaagcaaaaatgatcgcagaacagatcaaaagctttacagatgaaaaaaacggtctgtatgtgtgggataaggacgggcagagttacagaaaagcctgctataaggatatggtgatcctgctgcgcagtatgagtggctggtctgaggtctttgtaaatgttctgatgaatgaaggaataccggcaactgcccagacaaggaccggatattttgcaacagcggaagtggaaaccgtactcggccttctgtctgtgatcgataatcctatgcaggatattcctatggcagctgttttgcgctcccctatggtcgggatgacggatgatgaaatggcatggatgatcgctgcctataaacggtatctccagaaaaaacaggaccgtggggtatatggtgcctggaaattgtgggaggagatctatccacaggctgtttctgatgaaaatccggatgaagatgaaaagaaagatccggaaacagagcagatccggatcggccaggtagagatcccgaaagcaaccgctaaatctatctggaaaaaactggaatattttgcagcttttacagaagaactgcgccaggacagccggtatctgcctgtccatgagcttctttatcagatctaccggaaaacaggatattatgattatgtttcctccatgccggcaggagagacaagaaaggccaatctggatatgctggcagaaaaagcggcagcctatgcttccaccagctacagaggcttatttcattttgtaagatacattgaaaagctgaaaaaatatgatacagactttggagaagcctctttaggagatgaaagcaattctgtgcggatcatgagtatccacaaaagtaagggtctggaatttccagttgtatttttagccggaatgggaaagaaatttaacaagcaggatgcctatggccagctgcttttagatgcagatctgggggcagctgcagatgaaatggatctgaacctgcgcaccaaggcgcctactcttaaaaaaatggccatcagacggcggatggaactggagtctatgggagaagagttgagagttctctatgttgccatgacccgtgcaaaggaagtgctggtcatgacaggaacagaccgttccctggaaaataaactggaaaaatgggatcagctctccttaacagatggacagatcccctatacagtcctgtccggggcaaattcatttttagactgggtgcttatggcaaaagcagcagttcccgctggacatatggaagtaaaacaggtgcagcttacccatctgatcggcagagaactgcagcggcagctggaaaagaaaaatgtaaaagaagagttgttaaaactggatacaaaacaggtttacgatgaacagatgaaagagcagctggatcaggcgctaagttatgagtatccttatctggaagatacaggcctgtatacacagatgtccgtgtcggaactgaaaaaacagagtcagatcgggcgtgaagaagaaaatatcggaacagaacgaaaggacctgtccgaagtcagactggaccacgaacatgaaatggaaccggaaagcagtgaagcagaagatggcaaaaaacagacagaaactggaaagaaaggtgcattcagaggaacggcttatcaccgtgccttagaatgtctggatctgcttgctgttacagaccagagaaaactggaaggggatctgttagacctgtttcagcgaggctttcttacagaagaagcctatgagtccatctttccatgggatatatggaaatttctggaaagtcctctgggtaagcggatgaaacaggctgaaaaggaaggaaaactttacagggagcgccagtttatggtaggtattcctgccagtgaaatgggaaaagggctgcagtctgaggaactggtgctgatccagggagtgatcgacgcttatatagaagaagccgatggatttatcctcattgactacaaaacagattatgtacccaaagaagatacacaaaaaggagaagaactgttaaaagaacggtatcaggtgcagttagattactatggaagagccctgacccagctcacaggaaagaaagtaaaagaaaaatggatctattcctttggattaagaaaagcaatccagttgggatag

SEQ ID NO: 1130 - DNA, 2541 bp, Unknown
  Artificiall/Consensus sequence
atggatgcgatcagaatgatggggatcgtaaaatctttcgggccggtgcgggcaaatgacggtatcgacctgatcgtaaagcagcaggagatccactgtctgctgggtgaaaatggtactggtaaaagtaccctgatgaacatcctgttcggcctttatcacccggatgcaggagagatctatattaatgaaaagaaggcatcgatcacaaatccaaatgatgcttatgctttagggatcggcatggtccaccagcactttatgctggtgaaccagctgactgttttagaaaatattattttaggaaaagagtccggcggatttttattaaacagaaaagaaagccgcaaaaaagtagaagaactggtagagcgcttcggtttccggcttccattggatgaaaaagtggaaaacctttctgtaggtatgaagcagcgtgtagagatcttaaaaacactgtaccgcggcgcagatatcattatcctggacgagccaacagccgttcttacacctcaggaggttgaggaactgtttaagatcctccgccagttaaagaaaaatggaaaaaccattattttcattacccacaagttaaacgagaccatgtctttatctgaccgtatcactgttatacgaaaaggaaaggttgtatttaactgcgatacctgtgatacaaacgaaaaagaactggcaacccagatggtaggccgtcaggttgagtctattgttaccaaggcagaagatcctcatggtccggtagtcctggaacttaaaaatgtgcgtctgcacaagcgcgcccaggagactgtcagcatccaggtacatgcaggagagatcttcggtattgccggtgtagatggaaacggccagcaggaactggaagaaatgatcgttggaaacagaaagacagaagaaggaactatttccatgaacggaaaagaagtccagaacctgtctgtaaaagagcgtaaggcaatgggactgggctatatcccatctgaccgtcacaaagacgctatggttcctgatttttctattacagaaaacttcctgttaggttatcaggaagatcccaaatactgcaaaaaaggctttatcgattacaaggcactggaagaggatgccaaagtccaggtagagcagtttgaaatcaagatcgcaggcgtaagccagcacattggacagctttccggcggaaatcagcagaaggtcattttaggccgtgagacaagccatgatccgtcctttatgctggttgcacagccggtacgtggtctggatatcggtgctattgagcgtgtccacaaaacactgcttcagctgaaaaaggaaggaaaagccattcttcttatctctgcggagctgtctgaagtcatgaacttaagcgaccgtatcgctgttctctatgaaggagaaatgagcgcacagtttaaggccggacagtacaccaaagaagagatcggtttatttatggcaggaaaaaaacaggaggatgtggcaaatgaaatgaaatggatcagcagtaaacaggctgcagaactgggaaaatcccttgcagcaatcgttttggctcttgtgatcggagccttgtttatccttgtggctggagagtcaccggcaactgcctattcttccctgttgaaaggtgctcttggaacacctcaggcagtagccaatacagtaagtaaaagtatcccgttagcgtttaccggactggcagtagccttaggttctcgctgcggtatgttaaatatcggtgcagaaggccagcttcatgcaggtgccatggcagctacactgaccggtctgacactgagtttccttccggcgccgattcttttggttgtaagtatcgcagccggtattgcagccggaatgttagtaggaagtgtgccgggtatctttaaggcaaaattccagacaaacgaagtcattgtagccatcatgttaaattatgtctgtactttatttacatcatggctggtaaacggaccgtttaaggtaccgggttctactgcacagacagaaatgcttccggagaacatctggtttgcaagactgcttccaaagacccaactgacctgggcgctgttcttactgttagcaacagccgtacttatgtacattttcctctggaaaacatccgtaggataccagttaagagccgtaggtgccaatgcatctgcagcgaaaacagcgggtattcctgtaaatttctatctgatcatggctatgaccttaagcggcggtatcgctgccttagccggtgttacagagatcttcggaaaatatcatcgttttattgaaggattttctccttcctttggtttcaccggtattgcggttgccattcttggaaagaaccacccggcaggtgttcttttaacgtctttactttttggtgtcctggaaatgggttccctgcgtatgagccgtgaaaccgctgtttccactaacatggtaacggtgatccagagtctggtcatcttgtttgtagctgctcctgagctgatccgctggagcagaaagaggaggggttaa

SEQ ID NO: 1131 - DNA, 2628 bp, Unknown
  Artificiall/Consensus sequence
atgacagagaaaaatatgtggaacctgtcaccgcaggaggcgctaaaagcctgtcaggcatcagaacagggactgactacagaacaggcagaaaagatccgtctggaaaaaggggaaaatgtactcttagaggaaaaaaagaaaagtgcttttcaggtctttttagaccagtttaaggatctgatggtagtgatcctgatcggtgcagctatcatatccatgttttctggaaatgaagaaagcaccattgttatttttgcagtccttgtgatgaatgcggcccttggaactgtgcagcatatgaaggcagaaaagtccttagagagtttaaaacagctgtctgcgccggatgccaaggttataagagatggcagaaagcaggaaataccggcaaaagatgtagttccgggggatatcctggaattagaggctggggacatggtggctgcagacggaaggatccttcataattattccctgcaggtcaatgaaagctcccttacgggagagtctactaatgtagataagcaggagatggcactaaatggagaggcagcgctggcagaccgcaccaatatggtctattccggcagcctagtaacttacggaagagccactgttcttgttacagcaacaggtatgaatacggagatcggtaaaatagcagggctgatgaacggggcagaagaacggaaaacaccgttacagaaaagcctggatcaattcagtggaaaactggcagtcctgatcatggtagtctgtgccctggtgtttgccctttgcatgttccggaaaatgagccttctggatgcactgttatttgcagtagccctggcagtagcagcgatcccggaagcactgacttccatcgttaccattgtccaggcatttggaacccagaaaatggcaaaagaaaatgccattatcaagaaattaaaggcagtggaaagcttaggctgtgtatctgtgatctgttctgacaaaacaggaacactgacccagaataagatgacggtacagcaggtttatgtagatggaaaggtgatcgacgggaaagagttagatcttacagaccagacacagcgttatcttctttatgatgcagtactgaccaatgattccagcattgtagacggcaaaggaattggtgatccgacagaatacgctcttttggagatgtttcgtaagatccaggtccttccggacagctattttggaaaaatgggaatgcatgaggatgcgttaagaaaggtaatggaccgtatagaagaggtcccttttgactctgaccggaaactgatgagtacaaaataccggatccacggggtgcctacgatccttacaaaaggtgcggtagatgttctgttagaccgctgcgtatctgtgcgctatggtgatgggatccgtcctatgacagaggaagaaaaagaaaagatccgcctgcagaaccagcacttttcagaaaatggtctccgtgttctggcctttgcctataaggagtccaatgaaatgctctgcgcccaggcagaatgtggatatgtattcctgggactgatctccatggtagatcctccaagaccggagtctgtaaaggcagtggcagaggcaaagcaggcaggcattaaaacagttatgatcacaggcgaccataaggtaacggcaacagccattgcaaagcagattggcatttttgaggaaggggatctggcacttactggtatggaattagatgccatgagtgaagaagaactggatcagaagattgataaaatatccgtttacgccagagtttcaccggaaaataagatccgcattgtagaaggctggcagagacggggaaatatcgtttccatgacaggagacggtgtgaatgatgccccggcactgaaaaaagcagatattggtgttgccatgggaattacaggaacagaggtttccaaggacgctgctgccatgatcctggcagatgataactttgctacgatcattaaagctgtggcaaatggaagaaatgtatacagaaatattaaaaatgcagtgctgtatcttctttccggcaatacagctgctatctttgctgtattatatacttcccttatggctttaccggtgcctttcgctccggtgcagttgctgtttatcaaccttctgactgactcccttccggcccttgccattggcatggaaccggcagatgaaggccttttaaaagaaaagccgagagatccgaaagaagggctgatgacaaaagatttcatgatccagatggcagcccagggtgtgttgatcgcagcagtagtcataactgctttttatctgggattaagaagtagcgcagcaatggcatctaccatggcattttccactttaacactggcaagactgttccacggatttaactgcaggggaaagaaatccatttttaaactgggctttggcaccaatccttacagtctttacgctttcggagcaggtgctctgcttttaggactggtgattttcattcctggacttcaccgtctgttccaggtacagagtatgccggtggtatctctgctccaggtggcagttttagcgttcatcccgactcttatgatccagatgaaacggctgatctgcaaaaaatga

SEQ ID NO: 1132 - DNA, 3915 bp, Unknown
  Artificiall/Consensus sequence
atgaatgacataagttatgaaattctggacttatttaagaaatacggcgcagataaagagggcatcttaaaaattttagaggcagacagccgcccggaagtcctttatgccctttcagacatccgtcgcaatcttatggactggatggatttttcaggacaggaacatgtactgcagcttggttctgactatggcgtgatcacaggtctgcttgcagagcgctgcgccagtgttgcagttgtagatgagagagacgaaaatctggtagtgaaccagaagatgaatgaagcacacaccaatatttcctatatgaaagcagctgatttccagaaaatggaagcagttgaaaaagaaggaaaatatgatctgatagttttacgtgcagaccgcccggatatggatattaaggaatgctttacaaggttatcctcatatctttcagaaaacggcaagctgatctttgcatgtgaaaatgcccttggtttaaacttcctttccggtgctgtccatgatgaggatgagactgcatttacaaagggagaactggaagaagctttgaaagaagcaggactttccaaagtggaattttattatcctatgccggaatataagcgggcagtatctgtttattctgaccggtatcttccgggaaagggagatatccctcatgtgacggcagtatatgacagacagcgctgggcctgcatccatgaagacgaaatctccgataaactggtgcaggaaaaggccttcggtctgttttccaatgcatatctggcagtagcatctaagggagcagagagttttaagacagtatttgcaaaatacaacagtaccagaaaagaagaattccagatccggactgcaattctggaagaaaatggaaaacgatatgtggaaaagacgcctcttacagaaaaggcggcagggcatatcagttccatgagtgaaaaatatgagaaattatcaaaggtaaatccaggggtaaaagtgctggcacctgtgtattccgaagataaaaaggcagtccgctttgaatttttaaagggaagaacactggcagagatcttaggagaacagatccgaggaaagaaagcaccggtagaagctttaaaagcagcgatcgatcaggtatttggacaggcagttcttaaaaatgagccatttgctccaacagacccgtttaaagaggtatttggtgacagtgaagatgttctttccttacaggatacttcctatgaagtcagcaacattgatggcctctttgaaaatctgatggagactgaggacggactttactgtatggattatgaatgggtatttgatttcccaattccatccggttttgtccgctaccgcaatctggtttacttctattataaatatgaaggactgatggagtatgaaaatgcaacccagttcttaaaagagtttggaatggatgagaagctggcagaaacctatgcttctatggaagtagcattccagacctgggtacatggagacggtactcagggataccttggcaattacaagcagcgtctggtgacactggaagaattaaaggcccaggaaaaggaactggctcaggcaagagagcggatcaaccagcttcaggcagaggtagaagagcgcaatatccaggtaaagaaagaccaggagatcctgcgtcttaccaataaccatgtgaccaacctggaagtgatgatcaaagacctgcgccatgaggtgaatgaactgggcaagctggctacctatttaaatggacatgaagcagtgatctttaaaatgcgccggaaactgggagaacaggtaaacaaggcatttccaaagggaaccagaaaacgcaaacttttaaattacagttttaatacagtaaagcatccggttaaatacggaaaaatgtatgccaccaaagagggacgcaacctcatcgaaggtgactttaagatcggagaaggttatcttaccggcggacatctttctttcccgcaatatgagaacccgactgtttctattgtaattccgtgctataaccagatccattatacctatgcctgcttacagtccattctggaatttaccaaagatgtgacgtatgaggttattattgcagatgatgtttctacggatgctactgcagagattagccgttttgtagacggccttgtgatctgtcgcaaccagaccaaccagggcttccttcgcaactgcaaccaggctgccaaggctgcaaaaggcaagtatatcatgttcttaaacaatgataccaaggttacagaaggctggctttcttccctggtgaacctgatcgagtcagatgataccattggtatggttggttccaagctggtttacccggatggaagattacaggaagcaggcggtattatctggagcgatggttccggctggaattacggccgtctggatgatccggataaggcagaatataactatgtaaaagatgtagactatatttcaggtgcagccattttgctgtcagtagatttatggaagcagatcggcggctttgatgaacgttttgctcctgcttactgcgaagactctgacctggcatttgaggtaagaaaggccggttacagagtggtttaccagcccctttccaaagtcattcattttgagggcgtttccaatggtacggatgtaaacggtaccggattaaagcgttatcaggtggaaaacagccagaaattaaaggaaaaatgggcggatgagtttaagaagcagtgcgtcaatgacggaaatccaaacccattccgtgcaagagagcgcagtcagggcaagaaagtcattttagtagtggatcattatgttcctacctttgataaagacgctggttccaagacaacctatcagtatctgaaaatgttcttaaagaaaggctatgttgtcaagttcctgggagataacttccttcatgaagagccatattctaccactcttcagcagatgggaattgagatcctttatggggatcactgggctaccggtctttgggactggctgaaattaaataaagatgagatcgacgttgcttatctgaacagacctcatattgctaccaaatatgtagacttcatcaaggaaaataccaatatcaaggtgatctactatggtcatgacctgcacttcttacgtctgggccgtgaatatgagctgaccggggatattaatattaagagagaggctgattactggagggccattgaactttccatgatgcgcaaggcggctatttcctattatccgtcttatgtggagatcaatgccattcatgctattgatccagaaatcaaggcaaaagccattactgcgtatgtatacgatcacttcctgacaaatatccaggaagactttgcaaagagagaaggactgctgtttgtgggcggttttgcccatccgccgaatgcagatgctgtgctctggtttgcaaaggaaatcttcccgtatatcagggagcagctgccggatattaaattctatgtagtcggttccaaggtaacagatgagatcaaagccttagagcagcctggaaacggtatcatcatcaagggctttgtcagtgaagaagagctggcaaacctgtatgcttcctgcaaggtagtggtagttcccctgcgttacggtgcaggtgtaaagggcaaagtggtagaggcaatctataacggcgcaccgatcattaccaccagcaccggtgccgaaggcataccgcaggtagagcaggttcttgaagtagaagatgatccaaagacatttgcagataagacagtagctttgtatcaggataatgaccgctgccgccagatgtgcgaaggaacccagaagtatatcagggaacacttcagcatggatggggcatgggaggtaatagaggaagacttttcgcgatag

SEQ ID NO: 1133 - DNA, 3477 bp, Unknown
  Artificiall/Consensus sequence
atgtcattgcagtttattgcagggggcagcggctccggaaaaacaaggtatctttacgaaaaggtgataaaagagtccgaagaacatccggacatacagtatctttttattgtgccggaacagtataccatgcagacccagaaagaactggtgcgcttacaccccagacatggacttcttaatattgatgttttaagctttaaacgtcttgcatacagggtttttgaagatctgggagtacagctgccccaggttttagatgatatgggaaaatccatggtcatccgaaaggtagcgggaaaactgaaaaaagaactgaaactgtacggaggccatctggaacagccaggctttatcaaccagttaaaatcccagatctcggagctttgtcagtacggggtaagcgtagaagacctggcaatggtagaggaagaaacagaccgtgtactgttaaaagataaactgggggatctgaagaccgtttatgggggatttaaagattatattgagtctcattatattacggcagaagagatcctggatattctgtgcagaaaactgccacagtgggaacctttaaaaaacagcgtgatccttttggatggttataccggttttacgccggtgcagtaccgtcttgcagaactgtttatgatccacagcagggaggtgatctgctgtgttactgcagatccaagggaaatgctttataaagaatgtaccatgcagcatttattttacatgggacggcatactgtatgcaggttgagaaaaatggcagaggaacatcatattcctgttttaaaggaagtatggtgtgataaccgcccggcctggcgttttaaggaaagcccccagctggattttttggagcagaatttataccgttataatgggaaaatatggaaaaatgatcctcaggacattcagatcttccggggaaaaaatccggcagaagagacggaatatgtgtgcagctgcattaatgaaaaagtgcagaaggaaggcatgcgctaccgggatctggcagtagtcacaggagatctggcttcttatggaaaagagatcgcccaccggtttgatgaggcagggatcccgtattttctggatgataaaaagagtattctggaaaatccttttatcgagcttataagggctgcgttagatggtgtaaaagatgcttcttacgaaagcattttccgttatctgaaaacaggttttgtctatgatgaaacctattccagggaggaagcacaggttcttacagaccggatggaaaactatgcaagagccctggggatcaaaggctggaaaaactgggatatgatctgggaaaagccatgcagaggcggggaacggctgagtctggaagaactgaaccagtaccgtcagtggatgttagaacctttaaaggtcctgcgccaggcttttaaagaggaaaatgccaccatttcttctgttaccacggttttgcgccaggtccttgaaagcatgaagctggaagaaaagctggaaagtttcagcaactattttctggagcggaaggaaccgggagatgagaaccgggccagagaatacagccaggtctatgagcgggtcatggagctgttagaacggttagagggccttttaggggacgaaaaggcggatatgaaaaattatatccagatcctggatgcaggttttgaagagatcaagatcggtgtccttcctgcaacagcagaccaggtgatgatcggagatattacccgaagccgtctggagtctgtaaaagtattatttttcacaggtgtgaacgaaggcattgttcctcagagaaaggcgggaggaagcctgttaaatgacggggacagagaagtgtttaagagccttcatatggaacttgcacctactgcaagggaagagggctgtatccagaaattctatctgtatctcatgctttccaagccttccaggcagctggtgatcacctatgcggctatgaatggtcagggcaaaagctgccatccttccagtctgatcggggagatccgcagactgttcccggaaatggtgccaagggaaaagcgggaagaggaatggccggtatggacagcggaagatggtttaaaaaagctgatggcaggactgcgggaagcaggagataaaaatctggaacagttaaaagaagcccagggaacctttctggaattgttccgtcgtttttatggacaggaagagtacaggaaactggtagaaaaactgacagatgcagccttttttgtttatgaagataagggaatcggccgtgcggcagccagagccctttacggacagaaacttcagggaagtgttaccaggttagagcagtttgctgcctgcgcctatgctcatttcttgaaatacggtctggaattaatggaacgtcaggagtaccagttagaggcagtggatatgggaaatctgttccaccagtccttagaccagtgttttgaggtgatccatgaaaatgggatggactggagcaatattacagaagaagaacgaaaagaactggtgaaaaaatgtgtggaccaggtgacatcccagtacggaaataccattatgtccagttctgccagaaatacttatctggcaaagcgtgtggagcggattaccgaccgtaccatctgggcgctggcagagcaggtgaagaaaggggattttgtgccctccggttttgaagtgtccttttctgctattgacaatttaaaggcaatgaagatccgcctgtcagaggatgaagaactgctgttaaagggccggatcgaccgtctggatctctgtgaagatgaaaaacatgtgtatgtaaagatcattgactataaatcaggaaatacctcctttgatctggcagcactgtactatggcctgcagcttcagctggtggtatatatggatgcggccctggaaatggaagaacggaaaaatccggaaaaaaccgcagttccggcaggaattttctattacaatatcaaagaccccatgatcaaaaaagaaggggaaatgacaccggaggagatcgaaaaacagatcttaaagcagcttcgtatgaacggactggtaaacagcgatctggaggtgatccatcacctggatcgtgagatccagaaggagtcagacgtaatacccgttgctgtaaaagacggttatgtacaggaagcaaaatccagtgtggcaggagaagcacgtttccaggctcttcgccgatttgtgggaaaacggttaaaacagtccggacaggctattttaaaaggtgaaaatggactggcaccttataaagacggagacagaacggcctgtgattactgcccgtaccatgcagtctgcggttttgatacgaaaacggcgggctatggtttcaggcggcttcactctatgaagccggaggaagtatggcaggaaatcgaggaaaagggtggcatgaaggaagataaaaacggggaaggggatgaataa

SEQ ID NO: 1134 - DNA, 2640 bp, Unknown
  Artificiall/Consensus sequence
atggcacaatggtatggtctgacccaggaagaagttttaaagcgccttggcaccaacaggaccgggctaaatgagaaagaggcagaaagaaggctggaaacatatggggaaaatgttttaaaagaacaggaagaaatgccctggtggcaggtatttttaggacagtttaaagatcttctggtcatgatcctcattggggctgcgggggtatccatggttaccggagatccggaaagcgctcttgtgatcttttccgtccttttgttaaatgccattttagggactgtggaacatcagaaagcacgaaaatccctggaaagcttaaagcgacttgcttctccggaaacacttctgatccgggaaggacgcgtttgtacggcgccatcttccagggtggttccaggggatatcctggttttggaaacaggaggaatggtacctgcagacggccggatccttcagtcctgcagccttacctgcaacgaaagttctcttacaggagaagctttaaatgtggaaaaaagagagggaaaactgccggcaggaaaaacgcctttatctccgggagatcagagcaatatggtcttttccggtgctctgatcactggcggaaggggaactgcggtagtgacggaaacaggaatggatacccagatcgggaccattgcttccctgatgaaccgcacagtggaaaagaaaacacctttgcaggccagtttagaccggttttccggccatctggccttaggaattatggggatctgcggggcgatctttctgatcagcctgtatcgcagggagcctgtattagatgccctgatgtttgcggtagcgctggcggttgcagccatcccggaggctcttggctccattgtgaccattgtccaggcaatgggaacccagaaaatggcaaaagagcatgcagtcataaaggacctgaaagcagtggaaagtttaggctgtgtatctgtgatctgttctgataaaacagggacactgacccaaaacagtctgcgggcagaggctgtttgcataaatgggaaggtcatggatacagggcagttaaaaaaatattcccaccacccggatctttctcttttcctgcgatcagtcattcttgcaaataatgcttccggagaggagaccggggaaaaagaagatcccttagagcaggctcttttacatatggcagaagaagcaggaaaagatcccggacttcttcgcaggcagtggcgtcgtatttcggagatcccttttaactctgataaaaaatatatgggtgccatatgcagcaaagggggagaaaagatcctttttgtaaaaggggcggtagacgttttgctgtctaaatgcagtctggcagtcaatccctcttttcaggaagaagagactgcttcctggggacgtcccttttccttttctgataaagagcggatccttcgccagaacggtctatggtccaaaaagggaatgcgggttctggcactggcatgtaaaccattaaaagaggaagaaatcagggatgcaaaggcggaaaatatgatctttctgggtctggctgctatgacagatccaccaaggccggagtctaaaatggcagtggcagatgctaaaaaagcagggatccgcacggtcatgatcaccggggatcataaagagactgcggcagcgatcgcctcggagattggtatttttacagctggtgatctggctgttacaggagcagatctggatcagatgagcgatcagcagctgcaggaaagactggaaaagatctccgtatatgccagggtgtctccggaacataagatccgcattgtggaagcatggcagaaaaaagggcacattacagctatgacaggagacggggtaaatgacgctcctgccttaaaaaaggcggacatagggatcgctatgggaaaagcaggcacagaagtttcaagggatgccgctgccatgatcttaacagatgacaattttgctacgattatcaaggcagtggcaaatggaagaaatgtatatcggaatattaaaaattccatccagtttttgttgtccggaaatatggcagggatcctttgtgtactgtatacatctatcaaggcgcttccattgccttttgcgccggtgcatctgctgtttatcaacctgctgacagactctcttccagccattgccataggtatggaaccggcagaccgggatcttttaaaccagcctcccagagacccaaaagaagggatcctttcttttccatttgcagggaagatcttattccagggttttcttattggtgcagcaaccatgtgggcatgggaaatgggatattcccagggcggggaagccattgccagtactatggcattttccactctgactctggcaagactgttccatggttttaactgcaggggaagaaaaagcctgctttcattgggaataggaagcaatctctggtgtgttatggcattgtttgtaggtgtagtccttatgtgtgcagtgctttttgtgcctaagcttcaggatgtatttgccgcaggggatctgacgggctcacagttactggcagtggttttaggtgcgctggcaccaacggcagttattcagatctacaaaatgatgagcgcaggaaccgcttaa

SEQ ID NO: 1135 - DNA, 2502 bp, Unknown
  Artificiall/Consensus sequence
atgaaagtatgcataaatgcgacaactgtaaaacagaaggaaaattacttttctgtagctaccaactgcacagagatccggattttcttcctcaccgattatatcatccgtatcagagccggatttgacggtgattttgcagaagaatcctacagtcttgttacaactgcctgggaagacagaatggatccgtttttaaaggactaccgtaaaaaaatccagaccgctgacgctgttctggaagatggaacagatcaggccgtgatccagggaaaagaactgaaagtagttatagaaaaagatcctttccgcatctgtgtttacgataaagaaggaaccatgatccatgctgatattgtagatcttgcttaccgtgaagacagcaaccaccacaggatccataccagccagattgaagcagatgattgtttctttggttttggagaaaaaggcggtgaatttaacaaagcccagaaatacatggttttaagcccgggtgattccatgggatatgaccccaaagaaaccgattctctttataagcacataccattttatattaagttaaatcagactaccaaaaaagcaaccggatatttctatcacaatacctgggaatgtgactttaacatgggacgtgaaaagcgcaattactggcaccgttacagcagctactccaccaacggcggagatattgaccttttcctgatctcaggaccttcagtccgccaggttgtagaacgctataccgatcttaccggaaagtcagccatgcttcctaaatacgctttaggatatcttggctcctccatgtattatccagaactggatgctgactgcgatgatgctattgcagagttcatcgacactaccaaagaagagggaattcctgtggatggtttccagctttcttccggttactgtgccattgaaacagaacagggcatcaaacgctgcgtatttacatggaataaaaaacgcttcaaagatccaaaagacttttttgcccagatgaaaaaacgtggcatctgtgtatcaccaaatgtaaagccgggaattcttctgatccatccaaaactggatgaaatgaaagcaaaaggcatgtttgtaaaagccagtgaaacagaagaacctggtatcggcacctggtggggcggaaaaggcatgtttgtagactttaccagccaggaaacccgcaataactggaaggaaatgttaaaagagaatgtcctggattatggtacaagttccatatggaatgacaactgcgaatatgacagcatggttgataaagactgccgctgctcttttgaaggaaaaggtggaaccattggccagttaaagtctgttatgtccaatattatgtgccacatcaccaatgaagcgatacatgaaacctttgacaatacccgcccttacgttgtatgccgttccggtcatgcaggcatccagcgctatgctcagacctgggccggtgataacttaacctgttgggaatctttaaaatacaatattgccacgatccttggtatgggattatctggtgttgcaaaccagggctgcgatattggcggcttctacggacctgctcctgaagcagagctgttagtcagatggatccagaatggtattttccagcctcgtttctctatccattccacgaatattgacaacacggttacagaaccttggatgtacagcaactgcacagaatatatcagaaccgctatcaaactccgttaccgcctgttcccatatctgtattcccttatggaacgtgctcatgaaaccggacttcctattatggagcctatgtgcagtgctttccaaaatgacccgaagtgctatgaagaaggcattgacttcatgtttggtgactcactgctggtagcaaatgtagtagaaaaaggcgccacaacacgtaagatctacctgccggaaggaaataaattttatgatttctatacaaggactccttacgatggtggacagacgattgaaataccggtagaccttggaagtatccctctgtttgtaaaaggcggcagtatcattccaatggcaacgaaccagatgaaaaatcttatgaccgaacagccaaacggaatttctattctttgcgcgcctgactgtgatggttcctttgtcctgtatgaagatgacggtgtttctatggattatgaaaagggctgctatttaaaaactttcatttccatggctgctggggagcgcaccgttctcacctttaaacaggaaggttcctatactacctctgtagaaaccatgtctctggacatgatccacagagaaaaagctccatattgggtaacggtagatggaaaggaaattccacattttcttcatagaagaaagtttgaggagactgactgcggctggtattacagccagactttaaagtctgtactggtaaaatatcctaatccgaaaaaggattaccaggttgtcgtttcctttgagcagttcgatctgatcggtatgtaa

SEQ ID NO: 1136 - DNA, 3279 bp, Unknown
  Artificiall/Consensus sequence
atgaagccgaaaaaactggttataagcgcctttgggccttatggggaaaagacagtggtcgattttgaaaagctgggagaaaaagggctttatctgatcaccggtgatacaggtgcgggaaagaccactctttttgatgccattacttttgctctttatggggaagccagcggaaatgtcagggaaacggggatgtttcgcagcaagtatgcaccggatgatgtgcctacttatgtggagctgacctttatttatcagggaaaagattataaagtcaccagaaatccggaatatctccgtccaaagggcagaggaacaggatttaccctgcaaaaagcagaggcagaacttgtttttccagacagccggcagcctgtgaccaagaccagagaagtgacaaaagccattacagagttaatgggactggactaccgacagtttacccagatcgccatgatcgcccagggagatttccagaaactgcttttagccggaactgcagagagaggggagatcttccgccagatcttccatacagggatctatcaggatattgagaacaggctgcgggaggcagtgaagggaaaatggaaagaatatgatgagatgcgccgcagcatcagccagtatctggatggcgtcagcatcagtgatgacccggaagcagaaagtgaatggaaagagctgaaaaaggcgaaatttgagggaaagaccattcggggaattgaacttctggctgaggttataggacggcaggaggaaaaacttgcaggtctgaaagatcagatccatgggatcgaggaagagatacagaaagaaaataaggttcttggggaagcaaagcagagacagaagatgaaaacagatctggaggcaaagcagaagctgtttgaagaactaaaacctgaggtagaaaaggctgtttctcaaaagacggcggcagaagaagaggcaaagggctgtgaagtactggcagaagagataagagagctgagagagaaaaaagccggcttggaggcatttctgggaaaagtacaggaagccaaaggaaaagaaagggcaataggagaagagaagtttacggaagagaagttaaaacaggagaaagtttctctggaacaggcactgcttgaaaataaagaagcccaggaaggtctgaaaggtgtagaagcagagaaagagcggctgcaaaacaggcttaaggaagccatgggaaaaggggagaaactgactggggatgaaaaagctctggatcaggctgtaaaggagaaaaaggcggcagaggaaaatgtgctgaaactggaaatgactggaaataactggaagctgcagaaggaagaaatgataaagcaggaaaatgctttggcgcaggcagcaggaaatgagcctcttttacagatgaagtcacaacagttacaggagtttttgcttcaggcaggtcaattggaactggtccagaaaaagctggcagaaacccagaaagaatatgaaaatgccgttgttgtaagaaacagggaaagagaaatttatggtcatctggaacagacatttttagatgcccaggcagggcttctggcaaagcatttaaaagagggggagagatgcccggtctgcggttccgatcatcatccaaaaccggcagtacttacagataaggtgccggataaggaatttttagatgagaagaaagaggtattggatcagaaagaagaaaatgtccagaagctaagtgcattggcggggcagtttaaggaacagtcggaagaactgtgggaacagtaccggaataaggcggagcagatctttggggatgcaggggcagagagtctacctgaggtgaaacggcgtctgtcagaagcaattaataactgtgatcagaaattaaaggatgcccaaaaggcagcggaaagtcttaaaaaatgccaggaaacgaaagaggcattggagaccaatgagaagattcttcaggataaactgctgcaggcccgaaatatccattcagcggcagaagggcagatggatctgttgatcagacagtgcataaaaaatttgcaggacgagccgaagatacaggaaatgcagcaggtaccggggatacagagcacaaatgatatagaaaacgttgtatccaggataaaaatgtttttcgcagagctaaaagcccaaaacaacgctgttttagaacagataaaagctgatctggaagaaaatggaaaaaaggcggaatacttaaaccgtttacaggcccaggctgaaacgatggaagaccaacagaaaaaactttctgaaaatatttccgaaaaggccctgctgatccagaagctggcaactcagctggaagaattaaagaagcagctggaagaagaaaataagatctatggttctgttacagcagaagaaatagaagaccggctgaaaggaaaaatgcagaataaactgaaactggaagcagcactggctcaggcagtggaaacattaaatgttttaaatgcccagtctgaaagtctgagatctgccatagaaactttaaagtcccagatcgggtccatgcaggaaacttccgaaggggagatccaggaaaagataactgttctttcagaagaaaagaaggaatggaatgagaaatattccagacaatatgcagatctggaaaataatcgttgtatttacaacaatgttcagaaaaatcagggaaaaatggcagcagcagagcaggaatatgtgtggatgcggtcactttctgatacagcagggggaactctcagcggaaagcgcaagatcgagctggaaacctatgtacagatggcttattttgaccggatcctgcgcagggctaatctgcggcttatgactatgagcagcggtcagtatgagttaaaacgccaggaaaaaggggagagtaagaaagaaaaagcaggtctggacttaaatgtcatcgatcattacaacggaacagagcgaagtgtaaaaacactttccggcggtgagtctttccaggcatccctgtcccttgcattagggctttctgatgagatccaggcgggagcaggggggatccgtctggatgccatgtttgtagatgagggctttggttccttagatgaggactctttaaaccaggcgatccgttccttaaatgatttggcgcagggacagagactggtaggtattatctcccatgtaggagagctgaaagacaggatcgaacgtaagatcattgttaccaaaaagcgcagcagtactggcgttggaagccaggtgcaggtggtaggagagtaa

SEQ ID NO: 1137 - DNA, 2514 bp, Unknown
  Artificiall/Consensus sequence
tataaatgggctgagtttaaaggactgaatgatatgaaaaaaataatacggacagcagggatacttacaatggtatttgccgcatcggtggctgtgtatttctttgctgcaagaaaaaatatgcaaaaggaagaggctgtttattcttcaatggatgcgcctgaatttcctgtggtgtatacagagtttgatggaaaagagatcaatgctcttcatggatacattcaggatatgggaaaccaggtggcaggagagagtatttccgtacttcctgaggacagaaagctgacattgcatattgatgaatatgataatggaatcacagggatccgctacgaagtgcgcaatctgggaatggaccgtttgatcgaacggacagagattgataactggcaggaagaaaatggaagtttgcaggtagtgcttcctattcaaaatctgctgacacaaaatgaaacttatttgctggatcttacagtaagtacagcagaaaaagagatccattattatacccgcattatgtgggctgataccaaccatgcaggagatatgttggatctggcagaaaatttcaccagaaaaagtctgaattacgatgaggcgaaagaactggtgtcttatctggaaaccaatccgggagaggataacagctctttaggcaatgtaagtatcaaggcaagttttgatcatcttacctgggacggattggaaacagaactggagggagaaccgcagatcacattgcagctgtacgatgggatcatggggcaggtccaggtagaatataatgtgtgggtcacagacagcacaggtaatcgttccctggtgcggacagaagataatttcactatgaagtggaatgataagagaatttacctgatgaattataaccgttatgccaatgaaatgtttaacggggaacagaagaattttgcgggaaaaaggatcctgctggggatttcggatgcaaagcagatcaaggcgcagaaaagcgaaaattcccggtatatcctgtttcgtgtaaatggaaatctgtggcgctatgatcagcatgataaaaaagccctttgcatgtttactttcgcagatggctccaatgatgatgtgagagcggattatgggaaacataatgtgaaagttttggcagcttcagatgaaggagatgttgattttcttgtatatggctatatgaaccggggaacctatgaagggcagatgggagtggtattttaccattatgatgaagacagtcgtacagtacaggaaaaattctttgtgcctgtttcagaaggatatgaccagttagagtctgatattaccacactggcatatctgggagaagatggtatgacctacctgctgcttaacggaaaggttacaggaattgacctgaacagcaatgagtcggttactgtagcgtatggcctgagccagggaagttttgcagtcagtgcagatggaagccgtatggcatggcaggaaggaaataatgcatatcagtcggaaatgcttcatgttatggattttaatacagcacagaaacaggatattacagctccatcaggagattatgtaagggctcttggttttgtaggaagtgatctgatctatggtttcggacatgaaagtgatctgtggtcagtaaatggaattgtaaaagaacttcctatgtacgccttgtatattgctgataatgagatgaacattcagagcgaatataaaaagccgggtatctatatatcagatgtaacggcagaagatggaagaatccatttaaaacgactggtgaaaataggagatgggcagtatgcttaccaggatgaggacaccattgtttgtaatgaaaaagtagataaggatccttttgaaggacttggatggtatgcgtcccaggacaaaggcagggtctattttgtacagacagatggagaaataaaggcttcttctgtgaaaacagaggtaccaaaggcattttcttatgaaaatacaagtacgttggagttgtctggcagacagaataatcttgaggatacggatcttattttctatgcttatggcggtggaagatacctgggagcctttaaaaatttcagtgaagcagtgaatacagcctatgaaaaaatgggctatgtaacagatcaaaatcagcatctgatctgggatcgtattaataagaagccgatccgcagcctgaaagatccggccggacaggcaagagagttattatcttatatggacagcttaggtgaaaataagctgagagatggcggacttatgacattagatgggtccggctgtaatgtaaatcaggtgttgtattttattgataagggaataccggtggtggcatgcagaccggatggttcctatctgcttttatatggatacgaccagtacaatgtaaatatttatgatccggcaacacaggagatctccaagatgggactgggagatggggctgtctatttttcaggagcaaataacagctttttgtgcggtctgaaagtggaataa

SEQ ID NO: 1138 - DNA, 4599 bp, Unknown
  Artificiall/Consensus sequence
atggcattacttatgaccgttttctttgaaaatggcttttcggaaaactatttccccaatgtagataaccgcaatttccccattgccatacgtccctatgtaagcggtttaaaagaagaactggtattaaatgcagaagtctgggacggacaatggaaactgcgaagatccccacagtattccctgatcttaaagggagatccggtggaaagtgcggatctaaaagatggtaccgtgatcgagggaatggtgaccaaaacagacctgtacttttctgttaagatcgatcaggtccagagagaacatgtaaattttgaaaaatatatgctgaaagagggcagcatcttcaaactggagatcggcagtgatgatctttgtaatattgtatacaaaaaccgctttgtaacaggaagccatgcagagatcacttttgagtcaggagctgcttacataaccgataaaaacagcgtaaatggcacattcttaaacggcaggctggtaagggagaaaacaaagctgcattacggtgatattatttacgtagtaggtcttaagatcgtatatctgaataatcttctggccatcaataatcccaataaccagtgcaggatccgggagttgaaagcagtagagatcccacattttgaagatgaaccatcagaagagacagaggtggaagatgtatatttcctgcgcactccacgaaagcttttaaatttggaccgggaaaccatttccattgaaaaatgccctaaaaaacagcagcagaagcgacagcctttgatctttaccataggaccttcttttaccatggtcatccccatcgctttagcagcagccatgaccagcgatggctttggtgcaggaagtatctgcatgtccttaggtgcagccgggatcggggctatatgggcggtagttaattctgcttacaacaaaaaagaggaaaaagagtcagaagaaagccgggtcagcaaatatttagagtacatggtccgtgtagaagaaaaattgaaaaataaaacggagtataaccgtctcgtactggcagagcaatacccttcttctggggaacttctggaatttaccacttccaatacccgcaggctctgggaaaaaagcagtacccatgaagattttctttctctccgtttaggagcaggtgatatgccttctcctaatgagattgaggatgcaaaagaagatctgggcagtgaacatgatcctttaaatgaccatatagaagaactgaaggagaaatttgatatacttcgccaggtttcggtggcagtttccctttatgatcaccgcctcttaggtgtagtaagcggggatgaggaaaaacgggatcagctgatgcgcattttagccttgcagattgctgccctccacccatatacggatgtacgcatgtgctatgtatttccaggcagagaccttgaaaaaatggaatatacccgctggcttccccacacttatacaccggacggaaagcttcgcatgattgtctgcgactccaaagccatgggcgatgtgatgtattacctgtctgatgtgatcagagaacggttagaagcagaggaaaacaggaaaaacaaggaagaagaggaaaaagtccttcctcattatgtagtctttatcagtgatatttccatgatcgaaggggaacctgtttccaagtatcttttagatccgccgaagaatgcaggggttagtgtgatcttcagtgcagatgccattgataagcttccgtcccattgcaataccattgtacagtgggaaaaggattacagtggttgttacaatacgttatctaaatttgaagaacgggaaggagtagcctttgaccgtgtcagcctggccgaaatggatgtattttccaggcagctttccaactttaaagtacgggaaaatgcatccaatgcagcgatcccggatatgcttaccttcttagatatgtataagacttccagggtggaagatctggatatgtaccataagtggctggaaaaccgcacatatgaaagtatgcgttccctcatcggtcagaaggcaggggaacagccggtttatctggatatccatgaaaaataccatggtccccacggtctggtggctggtactacaggaagcggaaagtcagaaacactgcagacctatattttaagccttgtattaaattatcatcctcatgaggtggcatttatcctcatcgattacaaaggcggtggcatggcccaaagctttatcggacttcctcatctggcaggtgtgatcaccaacctgggaggaaaccagactaccagggcccttctttccattaacgcggagatcaagcgtagacagcgcattttcaacgaatataagatcaagcacattgacgcctatattgaactttacagaaatggggaagcagaagaaccaatgcctcaccttctgatcattgccgatgagtttgcggagcttaaaaaagaacagccggaattcgtccgggcgctggtttccgcagcccgtgtaggtcgttctttaggtattaatctgatccttgcaacccagaagccaagcggcgtagtagatgatgagatatggagcaatacaagatttcgtatctgtcttcgtgtggcagacaaacaggactccaatgaaatgttaaagcgcacggatgcagcttacatcaccggaaccggacggggctttttacaggttggaaatgatgagatctttgatgaattccagtccggctggtccggagcaccttacacgccggaaattccatttagtgatgacagcaaggcaaaagccatgatcatagggctgacaggaaagccggaggcagtgaagaagaaaaagaagaaaaaaggggataatgtgaagaaattcacccagttagacgctatggtccagtatgcggcaaagctggcggaggaaaatcatattaaacctctcagacagatctggctgccgccgcttccaaaacttctttatctggaggatatgaagcttacctgggatgaaaaacagatgaaacttcctattggtctggcagatgatccgcagaaccagaggcagtttccggtttatcttgattttataagagatggtcatttactgatctgcggttcagctggttcaggaaagacatctctggtacagaccattttttacggtgcggcccttcattatacggcaaaacaggtgaacttttatatagcagatttttccagccgtaccatgactgcctttgcaggacttccccatacaggctgtatctgtatggagggggatgatgagaagatccagcagatgatgggttttgcagaggaagaattagacagtcgaaagaagtcattttcacaaaaaggaatgggctcttacagagactatcgtgaaagttacagcgatgtgccggcgatctttttagtcattgacaattatcccgccttttcagacagctatgagcagtatgagagtactttgatccagctttccagagaaggtgccagctatggtatttacctgatccttacctgcaacaattccggtgatatccgaagccgtattttacagaatatcacaaagggtattggacttcagttagcagaccggtttgagtatgacagtgtgatcgggatgcgctccgagatccttccggatgaccggactacaggcagaggtcttataaaagaaggcgttcctttggaattccaggcagctcttcctgtaaaagcttcccagggagaaagcatgatgctggcgatccgggaaaaattaaaggctttaacagaagaaggtacccagggagcgagaaaactgggagtgcagttagatgagatcaatgcagatacatttttggagatgatccatcttaaagggctggcagaagagaactttgtaatgggagcagaggatggatcccttatttccacagatttagataagaccctttgttttaccgtctgtggtgcaggaaaaaaaggaaagaccaattttctaaaatatacggccctgcttatgaagaaaaagggcgcagaagtttatgtctttgacgggtgtttaagagaattggaagaattttccagaaacaatgatctggatggctacatgacagataaagaagaactttatcattttatggaaaatgaacttttgccccagttaggagagcgcaatgaacttgtgtatgaagcgagacaggcgaaaacttcggtaaaagaggctttaaagaactataagcgcatggtccttctgatcaacagcgcatcggaatttatggaagcagtttacagtgaagactttgatgtaagtgaagtccttgaaactgtatttgaaaaaggaatgaatcacagactgcatttctttatggcactgtctccaagagagtatgaagaactggccggttacagggcgattcgtcagtttggagactggaagcagggaatccaccttgggggagcttttgatgagcagggtatttttgattatgagatcacaccttctgagaggagcaggacttatccggctggagccgcatttacggggcaggaaggaagagcagtcctctttatgacaccttttgtaaaggagggagaacatgagtaa

SEQ ID NO: 1139 - DNA, 2532 bp, Unknown
  Artificiall/Consensus sequence
atggaaccgaatgtatttgacaaggtccatgacgtggaccttaaaaagaccatggaacagtcctatattgactatgccatgagtgttatcagcgccagagcccttcctgacgccagagacggcttaaagccggtacagcgccgcgtgctgttttctatgatagagttaaacaacggaccggataagccacatcgtaagtgtgcccgtatcgttggtgataccatgggtaaatatcatcctcatggtgacagctccatttacggggcattggtcaacatggcccaggactggtctaccagatatccgttagtagacggacatggaaactttggttccgtggatggtgacggtgccgcagctatgcgatatacagaggcacgtttaagccgtatttccatggaaatgctggctgacattaataaaaataccgtagatttcgtaccaaactttgatgagaccgaaaaagagcctgtagtattaccttccagatttccaaatctgttagtaaatggtacttccggtatcgccgttggtatggctaccaatatcccgcctcacaacctgcgtgaagtcatcgcagcggttgtaagaatgatcgataaccgtgtaaatgaggaccgtgagacctccttagaggagatcatggagattattaagggacctgatttccctgcaggagccaccattttaggaaaacgtggcattgaggaagcataccgcaccggccgcgctaagatcaaagtaagagccgtgaccaatattgagaccatgccaaacggcaagtcacgtattatcgttacagagctgccatacatggtaaataaagccagactcatcgaaaagatcgcagagctggtaaaagaaaagaagatcgacggcattacctacatcggtgacgaatctaaccgtgaaggtatgcgtatcaatatcgaactgcgccgtgacgtaaacgccaatgttatcttaaaccagctgttaaagcatacacagctgcaggatacctttggtgtgatcatgctggctctggtgaacaatgaaccgaaggtcatgaacctgcaccagatgctggactgctacattgcccatcaggaagacgtagtaagacgcaggacccagtatgacttaaataaggcagaggaacgtgcccacattttacagggcttactgatcgccttagaccacattgatgaggtcatccgcatcatccgcggttctgcaaatgtagcagacgctaaaaatcagttaatggagcgtttcggcttaagtgacgcacaggctcaggcaatcgtagacatgagactgcgtgcgcttacaggtctggaacgtgagaagctggaaaatgaatataaggagcttcagatccgtattgcagagttaaaagcgatcctggcagacgagaagaagcttttaaccgtaattaaagaagagatcaatatcattgctgaaaaatacggtgacgacagaagaactgccattggctatgatgatgatatgtccatggaagacctgatcccggatgaggataccgtgatcgccatgacccatttaggttatatcaagcgtatggacgtagacaatttcagaagccagaaccgtggcggaaagggcatcaagggaatgcagaccattgaggaggactatattgaggaccttcttatgactaccaaccaccattatatgatgttctttaccaacactggacgtgtatacaggatcaaggcatatgagatcccggaagcaggccgtacagcccgtggaacagccattgtaaaccttttacagatgcagccaggtgaaaagatcacggctattatcccaatgcgcgagctgaacgaggataaatatctgtttatggctaccaagaagggtatggtaaagaagaccccgatgttagaatacgaaaatgtgcgcaagaacggacttcaggccattgtacttcgtgacgatgatgaactgatcgaagtaaaggcaacggataatacccaggatatcttccttgtgactaagaaaggtatgtgtatccgctttaaggaaacagacgtaagagtaacaggccgtgtttccatgggtgttatcggtatgcgttttgatgaggatgatgaagtcattggcatgcagatggaaagccagggcgaacatcttttagttgtatctgaaaatggtatgggcaagcgtaccctgatcagcgaatttaatgcacagatccgcggtggtaagggtgtactctgctataaggtaacagaaaagaccggctacctgatcggagcaaagctggtaaatgacggtcgtgagatcatgcttatcactactgagggtattgtgatccgtatgtctgtagatgatatttccgtgatcggaagaaatacttccggtgtaaaactgatgaatatcgaccaggagtctgatattaaggttgcaagcattgccaaggtaagagaaagtgctaccagagacaatgaagcagaggaagaagaactggaagaggcagaggataatactgctgaaacagaagaaaatgatacagaagaataa

SEQ ID NO: 1140 - DNA, 2196 bp, Unknown
  Artificiall/Consensus sequence
aaaataattatgaatttaataataaatataaaagaggaaaaacctgtgaaaaataatattcagataaacagggatgccctgttttcagcagaaactgaggattaccgtatgcctgcagagccggatattcatgataaagttgtagtgagaatgcgcacggcaaaggatgatgtggatcatgtttattatatagagggaaagaaagagacagagatgaaaaaaactgtctcagatactctttttgactattatgagcacacaatgacagcaggagaggaacagatcctgtatcattttaaaatagtaaagggaacagaagtctgtcagtataaccgtctgggagtttctgatcaggacacggaccagtttgattttaagatcacacctggttttcacactccggactgggcaaaaggtgccgtgatgtaccagatctttgtagaccgcttctgcaatggagatccgaccaatgatgtacagtcctgtgagtatgtctatattggcaaaccggtttaccaggtaaaagactggagcagaaatccttctactatggacgtaggctgtttttacggcggcgaccttcagggcgtgtgggacaaactggactatatcaagagcctgggcgtagaagttatttatttaaacccggtattcgtatccccgtccaaccataaatacgactgccaggattatgaacatattgatcctcattttggaaagatcgtaaaagacggcggttccatggtggatcagaatgctgcggataacacaaaagcagagcggtatgtagtgcgctccgcagaccgtgaaaacctggaagccagtgatgccttttttgcggaattcgtaaaagaagtacacaaccgcggcatgaaggtgatcttagacggtgtgttcaatcactgcggatcctttaataaatggctggatgcagagcagatctatgagcgttccggtgattatgagccaggggcctatatttccaaggacagcccttatcacagctttttccattttcatgacaacagtgataaagcatggccttacaaccgcacctatgacggatggtgggggcatgataccctgccaaagctgaattatgaaggctctgataaattagttgagtatattttaaatgtggcaaaaaaatgggtgtctccgccttacagcgtagatggctggcgtctggatgtagcggcagatctgggacatacagcagaatataatcacgctttctggaaaaaattcagaaaggcggtaaaagaggcaaatccccaggcactgatccttgcagagcattacggcgacccgtccggctggcttcagggagatgagtgggactctattatgaactatgatgcctttatggagccggtcacatggttcctgacaggtatggaaaagcacagtgacagatattatggcggtctttacggaaatggacagtctttctttgatgccatggcttatcatatgagccggatgcagaccaacacggtgtttacagccatgaaccagctgtcaaatcacgaccactcccgcttccttacaaggaccaaccaggtagtaggccgtatcggaagtatgggaccggaacgtgcttctgaaaatgtaaagaaatgtgttatgagagaggcggtcatgattcagatgacctggccgggtgctcctacactgtattacggcgatgaggccggtgtgtgcggctggaccgatccggacagcagaagaacttatccatggggaagagaagacctggaattaatggaattccaccgttatatggccggtatccacaaacgtcttcctgcactgcgaaaaggcgctgtaaagccattatttgcggcaaaccagcagattgcctatggccgtatgtgggacagataccagacagtgacagttatttccaatttgccacaaccgtctacgatagaaattccggtatggcagttaggcatcacagatgaagatattatgggacgtcctattataacaacagaggacggctacaatgcaggaattttattctaccatgtaaaagacggtattttgaaagtaagaatgcctgcatacagcggtgcggtctttgcttcccatccggaagatttttatccggtgcttccatctcgttttgtagaagagggagaagaagaggcaagggaaaaagagcagcttgagaaagctgcggaagcataa

SEQ ID NO: 1141 - DNA, 4653 bp, Unknown
  Artificiall/Consensus sequence
atggcaaaaggttttttagaagtatttccaacccttaatattgcagagcctttaaaggagcttttagctttggcagaagtagaaaaagttacttctgccagagatagaagctctattcgtgtttatatgaaaagcacaaggctgatccataaacaaaatatctatgatctggagcggggcatcaaagaccagctgttcccggataaacagatcaccattaagatacaggaaaaatacagactgtctggtcagtacacaccggaaaagcttttaaaaatgtataaggacagtctgctgctggaattaaagcattacagcatcgtagaatacagtatgttccgcaaagcccagatcgtctttgaagatgaaggaaaaatggtgctgactgtagaagataccatggtcaaccgggacaagaccaatgagttaaagcgggttttggaaaaggtatttaatgaacggtgcggtctgccggtagaagtagcgtttcagtacattccgccaaaggaaaatgaccgtagaaagcagattgaactgaagttagagagagaagcacaggctatttactggcaaaatcataaggatgagttagaaaatgcaagtggtggagaaaatatctcgcagacagttgcaaaaagcgataatggtgagaaaaaaactcataatagtaatgctgctattatggatattcctatgccggaggcagctccatgggacgctcttatggatcaggcagcttccggaaatgttcctggcaatgatgagactatttctcctgtatcagatggcataaaaccagtagatgcaggaaaaacagctgctgcaaaaccacagtcaggcggaaaaacggaaaaacctcagcttaacaaaggcagaaaaggctggggaagagataaagactccggctttggagaagacaggaagttttctgttaaacgttccaataatccggatgtactttacggccgtgattttgaagatgactttatggagattgagaagatcgacggagagatcggagaagttactttacgtggacagatcttaacctgtgaaagccgcgagctaagaagcggtaaattcattcttacctttgatgtgacagactttacagataccattacagctaaaatgttcatccgtccggaaatcttcaatgaagtaaaggacatgatcaaaacgggcatgttcattaagatcaaaggtgttaccaccattgataagtttgacggagaactgacattaggctctattgtaggtattaaaaaggccgatgactttaccaccaagcgtatggacaacagcctggaaaaacgtgtggaactgcactgccatacaaaaatgagcgatatggatggtgtttctgaggtaaagagcatcatcaagcgggcgaaaaaatggggtatgtcctccattgctgttacggaccacggctgcgttcaggccttccctgatgcaaaccatgcattggataaaggggatacctttaagatcttgtatggtgtggaaggctatctggtagatgataccaagcagctggtagaaaattccaagggacagacttttgcagatacctatgttgttttcgatattgagaccacaggtttcagccctgtaaagaaccggatcattgagatcggtgctgtaaaagtagtagacggtgtgatcacggacaagttttctactttcgtaaacccggatgtgccgattccatttgatattgaaaagctgaccagcatcaatgacgctatggtactgccatatccgaagatcgatgtgatattacctcagtttctggaatttgtgggagacgcagtactggtagcccacaatgcaggttttgatgttggttttattggtcattatgcagaagcgctgggactgccattttcaccaacagtactggatacggtatctctggcccgccttcttctgccaaacttaaaccgttttaagctggatacagtagcgaaagctttaaatatttccctggaaaatcatcaccgggcagtagatgatgcaggagctacagcggagattttcgcagcttttgtaaagatgctgcgggatcgggatattgaagatctggaccacttaaatgaattaagtaccatggatgcccagaccattatgaaactgcctaccaaccatgtgatcatcctggcaaaaaatgacctgggacgtatcaacctgtaccgtctggtcagctggtcccatttggattattattccagacgtccccgtatcccaaagagcgttctggacaagtacagagaaggtctgctgatcggttctgcctgcgaggcgggagaattatatcaggcccttcttcgcggggctcccgatgcggagattgccagactggtaaatttctacgattatctggagatccagcctttgggaaacaatgcgtttatgctccgggatgaaaaaagtacagttaagacagaagaagacttgatcgagatcaataaaaagatcgtagatctgggaacccagtttggtaagctggtgtgcgctacctgtgacgttcatttcctggatccccaggatgaggtttaccggcgtatcatcatggctggtcagggatttaaagactccgatgaccaggcgccgctatatctgcgtacaacagaagagatgttagaagagtttgcttatctgggaccggataaggcatacgaggtagtcgttaccaatacccgtaagatttctgatatgtgcgaaaaaattgcgccggtgcgtccggacaagtgcccgcctgttatcccagactctgataagaccttaacaaagatctgttatgaccgcgctcatgagatgtatggtgaagatcttccaaagatcgtagtagaccgtctggagcgtgagcttcattccattatcaccaatggatttgcggttatgtatatcattgcccagaagctggtttggaaatctaatgaagacggctatctggtaggttcccgaggttctgtaggttcctcctttgtggcaaccatgtccggtattacagaggtaaatccgctaagtcctcattatcattgtccaaagtgccgttactatgattttgactctgaagaagtgcgtaagttctccggtatggcgggctgcgatatgccggataaaaaatgcccggtatgcggaacacctctggaaaaagacgggtttgatatcccatttgagactttccttggatttaagggagataaggagcctgatatcgacttaaacttctccggtgagtaccagagtaaggcccatgactatacggaggttattttcggtaagggccagactttccgtgcaggaaccattggtacactggcggataaaacggctttcggttatgtaaagaaatattatgaggaaaggggaaccaggaagcgaaactgcgagatcaaccgtattgttcagggctgtgtaggcgtgcgccgtaccaccggtcagcatccgggaggtatcattgtactgcctttaggtgaagagatctattcctttacaccggtacagcacccggcaaacgatatgactacctccaccgttaccacacactttgattaccattccattgaccacaacctgttaaaactggatattcttggacacgatgatcctaccatgatccgtatgctgcaggacctgatcggtctggacccggttaaggatattcctctggacagcccggaggttatgagcctgtttcagaatacctctgcactggggatcacgccggatgatatcggtggctgtcctttaggagctcttggtgtgccggagtttggtacggactttgctatgcagatgcttctggataccaaaccaaagtatttctctgacctggtgcgtattgccggtctggcacatggtacggacgtttggctgggaaatgcccagacgttgatccaggaaggaaaagctactattcagacagcgatctgtacccgagatgatattatgatctatctgatcgcccagggaatggaacagggactttccttcaccatcatggagagcgtgcgaaaaggtaaaggtttaaagccggagtgggaagaagatatgaaggcgcatggtgtgcctgactggtacatctggtcctgtaaaaagatcaagtacatgttcccaaaagcacatgcggcagcctatgttatgatggcgtggcgtattgcctactgtaagatcttttatccactggcttactatgcggcctttttcagtatccgcgccagcgccttttcctatgagatcatgtgtcagggaagagataaactggaatattatctggcagattataaaaaacgttccgatactctttctaaaaaggagcaggataccctgcgtgacatgcgtattgtccaggaaatgtacgcaaggggctttgattttgtgccaattgatatttataaggcaaaagcaagacatttccagatcattgacggtaagctgatgccttctttaagcagtattgacggtttaggtgaaaaagcggcagaagcagtggtagatgcagtaaaagacggtccgttcctgtcagtagaagatttctccagccgtaccaaggtaaatggaactatctgttccctgatgtcagaccttggactgcttaaagaccttcctcagtctaatcagttaaatttatttgagctgatgtag

SEQ ID NO: 1142 - DNA, 3531 bp, Unknown
  Artificiall/Consensus sequence
atggaaaatccgttattggaattacaggaatatgaaaatttacgggaagcgttaaaaagggcaaaaggcccggttcaggcaacgggaacccttgattcccagaaggtacacctgatgtactggctgggaaaagacgggggttttccctggaaactggtggtgacttatgatgaccagagagccagggagatctacgaagattttcgcagctttacggaaaacgtatggctttacccggcaaaggatctgctgttttacagtgcggatatccacggaaacctgatgacccgccagcgcattgcagtgtggcggcacctgatggaagagaaggaaggcgtagtagtcactacgttagacggccttatggatcatctgctgccgctggtatttttaaagcagcaggcggtgactgtggaaaacggccagatcatggatctggatgaatggaaagaacgccttacagcactggggtatgagcgtacagcccaggtagacggcatgggccagttttccatccgtggcggtatcgtggacattttcccgctgacagaggaagtgccggtgcgtattgaactgtgggatgatgaggtggactccatccgcagtttcgacccggaaagccagcggtctgtggaacagctggaaaaaattaccatttatccttcagccgagaccattttaacaaaaaagcagttagaagcagggattgaacgtctggaaaaggaagaaaaagaatatgaagcagccttaagggccaaacatcagattgaagaagcatcccgtatccggggtattatcaaagaactgacagaagggatccggcaaggctggaaacgggatggactggatgcctatatccggtatttctgcccggagactgtgtcatttctggactatttcccggcaggagatactctgatctgtctggatgaaccggcaagattaaaggaaaaaggcgagacggtagagcaggaatttcgtgaaagcatgatccaccgactggaaaagggctatctgctgccggggcagacagagcttctctatgcaggcacccaggtccttgcaaagcttcaaagttcttatactgtaatgcttaccggtcttgaccagaagctgccgggcatgaaggtaaaggaaaaattcagttttgatgtgcgaaacgtcaactcctatcagaacagctttgacatgcttataagcgatctgacccggtggaaaaaagaaggttaccgggtagtcttgctgtctgcttccaggacaagagccagccgtttagccagtgacctgcgtgaatatgatctgcgggcgtattgtccggacggaacaggggaagaacataaagcggcgccaggtgagatcctggttacctacggaaatatccacaggggttttgaatatcccctgatcaaatatgtcatcattacagaaggtgacatgtttggcacggaaaagaagaaaaaacggcggaaaaagagcaattaccagggaaaagctattcagagtttctctgagctggcagtaggagattatgtagtccatgaggaacatggtcttggcatttacaaaggaattgaaaaagtagagcgggacaaggtcattaaggactatattaagatcgagtatggagatggaggcaatctgtatcttcctgccaccagactggaaagcatccagaaatatgccggagcagatgccaaaaagccgaaactgaacaagttaggcggtacggagtggaacaagaccaagacccgtgtaaaaggtgcagtccaggagatcgcaagggacctggtaaagctgtatgcagcccgtcaggcgcaaaatggctaccagtacgggggagatactgtgtggcagaaggaatttgaggaactgtttccatatgaagaaacagatgaccagttagatgccattgaggcagtgaaaaaggacatggaaagccgaaagatcatggaccggctgatctgtggtgatgttggttacggtaagacggagatcgcccttcgggctgcttttaaggcagttcaggacagcaagcaagtggtatatctggtgcctactaccattctggcccagcagcattacaatacctttgtccagagaatgaaggattttccggtgcgcattgacatgttaagccgtttctgcaccccgtcccagcagaaaaaaacgctggaagacttgcgaaaaggcatggtggacattgtgatcggtactcacagagtgctttctaaggatttaaagtttaaaaatctggggcttctgatcatcgatgaggagcagcgttttggcgtagcccataaagagaagatcaagcagttaaaagaaaatgtagacgttatgactctgactgcaacccctattccaagaacactgcatatgagccttgcagggatccgtgacatgagcgtactggaagagccgccggtagaccgtacacctatccagacttatgtaatggaatacaacgaggaaatggtccgggaagctattaacagggagctggcgcgaaaaggccaggtgtattatgtatacaaccgtgtgacggatattgatgaagtggctgcaaagatacagaaactggtgccggatgcagtagttaccttcgcccacggtcagatgcatgagcatcagttagagcggatcatgacggactttatcaatggggagatcgatgttttagtatccactaccattattgagacaggtcttgatattccaaatgccaacaccatgatcatccatgatgcagacagactgggactttcccagttgtaccagcttcgcggccgtgtaggccgttccaaccgcacatcctttgcatttttaatgtataagcgggataagcttttaaaagaagaggcggaaaaacgtcttcaggctatccgtgagtttacagaattaggctccggtatcaagatcgccatgcgtgacctagagatccggggtgccggaaatgttcttggagcagagcagcatggacatatggaagcagtgggatatgacctttactgtaaaatgttaaatcaggcggttctggcattaaagggcgaggaaacagaggaagagtcctatgctaccagtgtggaatgtgacattgatgcctatattccggctgcttatattaaaaatgagtatcagaaactggatatttataagaggatctctgccattgagacagaagatgaatacatggatatgcaggatgagctgctggaccgctttggggatataccaaaaagtgtggaaaatcttctggtcatcgccagagtccgtgcgctggcccataagtgctatgtgaccgaggttttagtaaaagaaaaagaagtaaagctgaccatgtaccagaaggccaagatcaacgtaggaggaataccggatctggtaaattcctatggcggcgccttaaaactggtaccgggagaagtgcctgtgttccactatgtggagagaaagcctaagggcattaccattgaagatatgctgtttaaggcagaagagatattaaagggattaagaaagctgcggatgtga

SEQ ID NO: 1143 - DNA, 2817 bp, Unknown
  Artificiall/Consensus sequence
atgaaagacttacgtaagcagacacacaaaaaaatggcccatggatccggtcaccccatagcaacctgttttggtatcctgggctggcttttccatggcatactgtctgtgatcacagccggtcttatcatcatggcgatcgttggccttctgatctatgcaaaggtaaaaccggaattagaccagtgccgtgagatcgcctatgacaaactggcacagatggaacggtccgatttttccatgctctctgataccgttgtctatgacaaggccggaaagcagatcggacttattaacgcaggtcattatcagtatgtagatataagtaagataagcatgaacctgcaaaacggctacattgcccaggaggaccgtcgtttcaagagtcacggcggcgtagactggatcgccaccttccgggccggtctggctcttgtcaaacacggcggccatgtgacccagggcggcagcactattacccagcaggtgatcaaaaatacatatctcacccaggaacgtacctttacaaggaagatcgtggagatccttcttgcccctgaaatcgagaaaaaatactccaaagctgacattatggagttttactgcaataccaatttttacggccaccagtgctatggcgtagaagctgccagcctgtattattttggaaaacacgcaagcgatcttgccccggaagaagcggcgatcctcatcggtatcagcaacagcccttctgcctatgacccggtagctcatccggacgcttccaaagaaaagcgtaatgatgtccttaacagcatgaaagaagtaggctatctctccccagaagattacgaaaaagcagtaaactccccacttaagatcgtacagcaagagtctgaaggaacggatgaaaattatcagagcagctatgccatccactgcgcagccctggaattaatgaagaaagacaacttccagttccagtacatttttaaagataaagaagattatacccagtacatggaccggtatacagccgcttattctgaaaaatcagacctgatccgaagcggtggctttaagctctatacttccatagacagtaccatccagagccagctccaggcgcagattgaccagtctctttccggctttacagagctgcaggaaaatggaaaatatgctcttcagggagccggtgtcatcgttgataataagaccaactatgtagttgctattgtaggcggccgcggcacagaagacaaatttaacagagcttatttaagtgccagacagccgggaagtaccattaagccgctcatcgactatggtccggcttttgataccggtgaatattaccctacacgcatggtagatgaccacaaatggaccgacggaccttccaacagcggcggacgttattttggaaatgtaacagtccgtgaagctttaaaccgaagcttaaacaccgttgcatggcagatcttagaggacattggcattgattatggtctggattacttaggagaaatgcagttccagaaactgacttatgtggataataatgttccttccttaagtatcggcggttttaccaacggcgtccgggtcgtggatatggcaaaaggctacagcacccttgcaaacggcggtgtatacaatgaccgtacctgcattattaagatcgaacatgaacatgacggggaactgaccaaagatttaaaaccatctgcccatcaggtgtacagagatgactctgcctttatgcttacagatgttttaaaaggcacatttactgcagcctacggcactggccagggacttggactggacaatgatatgcctgcagccggaaagaccggtactaccaacagcagtaaggatacctggttctgcggctatacacgttattacactactgcgatctgggtaggttatgatataccaagaaatatgcctggtatctatggtgccacctatgcaggaaggatctggaaatccgttatggatcagatccatgagggcttagaaccctgggattggatacagccggaaacagtcgagcgcaaagtagactccaagaccggtatggaagattatttcagcaccactgcccagttccgcgcagaacagagtcttcatgaaaaagagcaggaacagttagagactactcttcaggcttctgtagatgcctttatagaaaaggagatcggatctgtagaagatacttatactgtaaaagacgaatacaacagtattacctccaagctgccgctgttagatgacggcgaacttcgcgccagtcttttagagaaggtggaaagccggtatgactactttaaggagatcattgccggtatgagcgatgagatcagccggtatgaagcggttcaggcagaggaaaagaaacaggcacaggaacaggctgcaaaagacgcagaagccaaacgtgcccaggaagaaaaggcagtaaagaaacagacctttatgcaggccttagagcggatcgaaaatctggaataccaggaaacagatgccgaagatctggtatctgatgctatcgacaaactttcccttgttgcaggtgatgatgaggaagcctccctttctgcaaggctccaggctgccatctcccgtatcaccactcttccaacggaaagtgagtggaatgctgcccaggctgaaaaagaggcgggagaagcccagaaagaaagccaggctcaagtgcaggtacaatcccagcagcgtcagctgcgctccgctttaagtaaggaacagtataagtggaacaatgcagaaatctatggaccaggaggcagaggcgatgaaaactaa

SEQ ID NO: 1144 - DNA, 2775 bp, Unknown
  Artificiall/Consensus sequence
gtgaatgcagtgagtcgtgaagaaatagaacaggtagaaaaagaactggatgaggtccttgaaatagtccagagaccggttccggtgaaaaatacaggcagggaggaaacagtatctttgcaggaaaatttacaggaaaatgatcccttacaggaagaaatgcaaatagaaacagagaaggaagagaaagaagaaaaagaagacagccctgaaagcgcagcgaaggagcagacggcagtttcagaagaagaactggatctggaggatgatatagaaaatggttacttccatttcctgcgtccaagtgatggcctgatcgcagcctttttcgtgccggtagctgtcctgatcatcctgtttgcccagagaggcatcttcccttttggtgaagagtgctttttaagaacggacatgtatcaccagtacgcgcccttcttttctgagtttcagtacaagctaaaacagggaggaagcttgctatacagctgggatattggtatgggagtgaatttctcggctctttatgcttattatctggcaagtccggtgaactggctgatcatcttatgtccgaagaaattcatcattgaatttatgaccatccttattatggtaaaaacaggtctctgcggagtgacgtttacctggtatctggatcatcattttgagaagaagcattttgtagccggtgttttcggcattttctatgctttaagcggttatatggcagcttacagctggaatatcatgtggctggactgcattttcctgctgccgctgatcctttatgggttagagcagctggtgcaggagaaaaagggcctgttttactgtgtgactctgggtctttctattctgtccaactactatatctctatcatgatctgtattttcatggtcatgtatgtgatcgtgcaggtgatcttatccccgccaaagaagataaaagacctggtggcaacaggagtgcgctttggcttttattctcttcttgcaggaggactggcagccgttgtgcttttgcctgagatctatgctttgcaggcgactgcttccggcgactttgattttccaaagaccatcagctgttatttctccatttttgatatgatcgcccgtcacattggaaatgtgggaacagagatcggcctggaccactggcccaatatttactgcggtgtggcagtgcttatgttccttcttctttatctgggggcaaagaagatcacagtgcgggaaaaggcagtttactgcggcctgctgttaatgttttatgccagcttttccatcaatgtgttaaatttcatctggcatgggttccattatccaaacagccttccatgcagacagtcctttatctatatcgccttggtgctgactatgtgttatcaggtctgcctggaattgaaagaaacttcctggaaacaggtggtgtgggcgttctggggtgccattatctttgtgctcatggcagagaaacttgtggataactctgcacaatttcatttttctgtgttttatgcagccatcattttcctggcactgtatatggggcttatttatctgtataagcggaaaaactggaatgaagatgtgatcatgatgctgaccctgcttttagtagcagtggaaactgcgttaaaccttggtgtcagcagccttccaactaccagcaggactgcgtatgtaaaggacaatcaggataccagaaggttagcggaaagcattaaatgtgatactttctacagagtggaaaagggagacagcaagacgaaaaatgatggtgcgtggatgaattttccatctgcgtccctgttttcatcggtagcaaatgcttctttaactgattttgtgagaaagctgggctgcgaaagttccaccaatgcttacagtattaaaggaagtactcccctggtagacagcctgttttctatccgatatggcatttatccggatcagcagccggtaactggtttaaaggatcagatcagcagaaaaggctctatgtggctttatgaaaatcagaatacgctgccggtagcatttatgcttcccgcagatgtggagaataactggctgttagactcaggcaatcctgcggtagtacagaatgacctttgcaatgtgctggggaccaaagatgtgctggtgtccaatgaaagtgttacagaaggcaagaaacttacctttacagtggaaacttccggtgattattatgtgtatgtgaccaacaagaaagtggaaaaggtcacagcaaccatgggagaaaagagcaggtcctttgacaatgtagacagaggttatttcctggaactgggatatcttgtaaagggaacggatgtagaacttcgctcagaggatgagggaaatccttcccttcagggagaagtatggcggtttgatccggaagcctttaaagaattttatgataaaatgaatgaaaatcccatcaacctgactaaatggacggatacagaactttccggaaccattcattctgatggatataagaccatgtttacaagtattccatatgacaagggctggaagctttttgtggatggtgtggaaacggaaacaagacctgtttttgatacatttattgcagcagacctggcagaaggagaccatgaaatttcctttacctatgagccggaaggtttaaaaacaggtgctattattacaggtgtgagccttgtagtgtttgcaggagcagcgatcattactactgtaaataataaaaataagaaaaaaagacaaaaatataaaaaatag

SEQ ID NO: 1145 - DNA, 3852 bp, Unknown
  Artificiall/Consensus sequence
aaaacaggcaaacgaggccatttatataatggtccggcacagaagaagctaaaagctatgaaaaacaggaggtctgtaatgagcgtaagacgaatttttgtagagaaaaagcctgattatgcggtaaaagcaggagagttaagagaagagttagtaagctaccttggcattaccggagtgaagagtgtacgggtactgatccgttatgatattgaaaatctttcagaagatacctataagaaagcactgggaaccattttctcagagccgcctgtagatgaggtttatgaggaagaatttccaaagaacccgggagatctggtattttccgtcgagtacctgccgggacagtttgatcagagagccgactctgccatgcagtgtgtcaagctgttaaaagaagatgaggaaccggtgatccgtacagcaactacctatgtgatcacagcaccgctgactctggcacaggaagatgccatccgccatttctgcatcaacccggttgacagccgtcaggcagaagaggacaagccaaagactctggtaactgagtttgaggttccggaagatattaagagctttgaaggctttgcaaaggcttctgaagaagaattaaaggcattatatgataccttaaatcttgcaatgacattcaaagacttcttatatatacagaaatattatgcaggagaagaacacagagatccaactgtaactgagatccgcgtgttagatacctactggtctgaccactgccgtcataccaccttctccacagagcttaaaaatgtaacctttacagagggcgaatacaagaagccaattgaagatacttataagaaatacctggctgaccgtgcagtaatctacaaggaccgcaaggacaaatatgtatgcctgatggacctggctcttatggcaatgaagaagctgcgcagcgaaggcaagttagaagaccaggaagagtctgacgagatcaatgcctgcagcatcgtagttcctgttgagatcgacggaaagacagaagagtggctggtaaattttaaaaatgagactcacaaccacccaacagagatcgagcctttcggcggcgcggctacttgcttaggcggtgccatccgtgatccgttatccggccgtacttatgtatatcaggcaatgcgtgttaccggtgcagcagatcctacaaagccattaaatgagactttaaagggcaaacttcctcagagaaagatcgttaccagcgcagctgccggatattcttcttatggaaaccagatcggtctggcaaccggttatgtaaaagaattatatcatccaggttatgtagctaagagaatggagatcggtgctgttatgggcgctgctccaagaaaatatgtaaagcgtttaacctctgatccaggagatatcattatccttttaggcggtcgtaccggccgtgacggtattggaggtgctaccggttcttccaaggtacacaccactgcttctattgaggtatgcggtgcagaggtacagaaaggaaatgcacctaccgagcgtaagatccagagaatgttccgtcgtccggaagtaagctccattattaaaaaatgtaatgactttggtgcaggcggtgtatctgttgcaatcggtgagctggcagcaggtcttcagatcgacctggacaaggttccgaagaaatatgcaggtcttgacggtactgagatcgctatttccgagtcccaggagcgtatggcagttgtagttgatcctgctgacgtagagaaattcttaggctatgcagcagaagaaaacctggaagcagttaccgttgcagttgtaactgaagatccaagactggtgatgaactggagaggaaagaccattgtagatatcagccgtgctttccttgatacaaacggcgctcatcaggaagcagatgttaccttagaggttcctgcacatgagggaaatctttttgataagaaagaagtaggaaatgtaaaagataaatggctgaacatgctgtccgacttaaatgtgtgctcacagaagggactggtagagcgttttgacggttctattggcgcaggttctgtatttatgccatttggcggcaaatatcagctgacagaaacacagtccatggtagcaaagcttcctgtattagaaggacatacagataccgttaccatgatgagctacggctttgatccatatctttccagctggagcccataccatggcgctgtttatgcagttgtctcttctgtagcaaagatcgtggctgcaggcggtgattataaaaagatccgctttactttccaggaatacttccgcagaatgagcagcgacccaaccagatggagccagccatttgcagcactccttggtgcttacaatgcgcagatgggctttggacttccttccatcggcggtaaggacagtatgtccggtacctttgatgatgaacacggtgagatcaatgtacctccgacacttgtttcctttgcagtagatgtaaacagctgcaagaacatcattactcctgaatttaagaaagcaggaagcaagatcgtagaatttaagatcaaccgtgataactatgatctgccggattacgcccagatcatggacggctacggaaagctgtttgaagatatcaaggctggaaagatcctttctgcatatgcagtagaaggcagaggcgctgcggaagctgtaagcaagatggcattcggcaacaagatgggcgttaagatcgagcacaatgtagatccaagagatttctttggcgcaggctggggcaatatcgtatgcgaagtagcagaaggaaaagtgggagaactttccatcccatatactttacttggcgaagtaacagacaagggtgtatttgaatatggaaataccaccattaccatggatgaagctttagcaagctggatgaagaccttagaggacgtattcccaactgttacaggcaaagaaaagacaggcgaagctgcaaagatagaagaaaagctttacgatacagatactatttacatctgcgaccacaagctggcacagccggaagtatttatccctgtattccctggtactaactgcgagtacgacagcacaaaagcctttgaacgtgcaggcgcaaaggtagtaacaaaggtatttaagaacttaagtgcacaggatatccgtgagtctgtagaagaatacaagaaagagatcgcaaaggcacagatcatcatgttcccaggcggcttctccgctggtgatgagccagacggttccgctaaattctttgcaactgtattccgcaatgcagtgatcaaggaagaggtagaaaagctgttaaatgaacgtgacggacttatgcttggtatctgcaacggtttccaggccctgatcaagttaggccttgttccggaaggaaagatcacagagcagaagccaaattctcctacactggctatgaacaccattggacgccatatttccaagatggtttacaccaaggttatgacaaataagtccccatggctggcagaagcaaaactgggtggtgtatactgcaatccggcttcccacggtgaaggacgtttcgtagcagacgaagcatggctccaccgcctgatcgcaaatggccaggtagcgacccagtatgtagacgataagggcaatgtgaccatggacgaatactggaatccaaacggttcctacatggcaatcgaaggtatcacaagcccggatggccgtatccttggtaagatggctcactctgagagaagaggcgaggcagttgccatgaacatttacggcgaacaggatatgaagatctttgagtctggtgtgaagtactttaagtaa

SEQ ID NO: 1146 - DNA, 3372 bp, Unknown
  Artificiall/Consensus sequence
atggaacagaagaataattctccttttctagcatttaccaggatctgtttaaacaactggcattatatttccagaaagatcctttccctgaataaggagatcaatttctttaccggtcactcaggaagcggaaagtctacggttattgacgcattgcagctggtcctttatgccaatacagacggccgcggcttctttaacaaggctgctgctgatgactcggaccgtagcctgatcgaatatctgcgcggtatggtaaatatcggggaaaataatgaattttcctatctgcgcaaccagaatttcagttctaccattgtactggaaatgcagcagacctgcacagaagaatatcagtgtatcggtgttgtctttgatgtaaacacagcttccaatgaagtttccagacgtttcttctggcacaaaggtcctttatgggaaaatgaatacaggacaccttcaaggcctatgtccatcagcgaagtagaacagtatttaagggaacattacagcaaggaagattatttttccacttcccataatgagagatttcgcaggatcctttatgacagctatttaggaggtcttgacagcgaaaagttcccattgctttttaagcgggccattcctttccgtatgaacatccgcctggaagattttgtaaaggaatatatctgtacagaacagaacatccatattgaggacatgcaggaaagtgttatgcagtatggacggatgcagcgaaagatcgatgatacctgccaggagatcgataagctgactgcgatccatgatgcatatggggaatatcgcctgatccatgacaagttagagaaatatcactggtttgtaaagaaactggatcttctggataccaggtccaagatccgtatgctccacgaaaagacagaacacggcaaagaagatctgctccagttagatgaggccaaaaagtcagtggaacagcagatcggggagctgactgcaaatagtgatgaacttcttaaaaggatcgcttctaccggatatgaggaattaaagcagcagcttacctctttaaatgccctttgcgagcagttaggccacagtgaagccaagtggcagaagacgctgctggctttaaagaagtgggaagaggaagaaatcgtttctaatcagacattatgggatctggaagaatttgaaacacggacgattaccagaccggttttggaacgtttaaaagcttccctggcatccatggctgctgatacggaaaaactgcgtcaggagacagtaagccagatcaatgaattaaagaagtctgagaagctgaaaaaattggaactggaacagttaaaggcaggtaataaagcctatccttcttatctggaagaggcaaggtcttatctgcaaagacgtcttttagaggaaacaggcaaaggcgtagatgtgtatatcctggcagaccttctggaagtgaaaaacgaccagtggcgcaatgccattgaaggttatcttgggggaaataagttaaacctggtggttgctcccaaatacgcgaaaacagccctttctatttacagggaactggataagaagaaattctggaatattgctgtgctggatacggagaaagcagccgaatatgacaatgatgccttgaacggatccctggcagaggaagtaagtgtacgggaggcttatttaaagccttatatgaacctgcttcttggcaaggtgatcaaatgtaataccattgaggaattacaggccaatgccattggtattaccccggactgtcttttatatcatactttccgtctccagtatatcaatccggaaaattatacccgtcttgcctatattggaaaagacagtatgcgcaagagggtccgtcttcttgaaaaggaactggaggaggtttcagaaaagagaaatccgttagaggaaacgttaaaggactgcaagcggatccttgctttggaaaccttaaaagaggatacagaggagtatttccagtggttaaaggatatagacacccgcaaagaacagttaaaggaaaagcaaaaactgtctgaacggctggaaaagcttcgccagaaggatgtaaagcagttagaagccgaccgtcaggctgttttagaactgagtgacggaaagaaacgggagagagatctgttacaggagcagatcctaaacaagaaaaatgaactggaacgtttctcacagactatcttaaagctggaaacagaggctgcaggtcagggtaaggaagtacctgtaaacgaggaacatgaacgggaactgaatgcttatctggcagataaggatcatccacgctttgaccaggaaaaagaggcttatgcgtccaagtgccagatcttagagcagaaggcagttcaggcgaaggaacatgtaatgggccttagaagtgaatacatccgccggtatccgggaaggaatgttcctgtaagcagcaatgacaatgcagcgtatgacaagatcttaaaccgtctttcctgtgatgacctggaagtttacagggaacaggcaggtaagcaggcaaaagcggcagtggagcattttaaggacgattttatgtacaagatccgcagtgccatcaaggacgctcttttgcgcaaggatgagttaaaccggatcatcagccgtctggactttggaaaagataaataccagtttgtgatcggccggtgcaaaggggctgacggacggttttatgatatgttcatggatgagtcattggagatcaatcccgccagtttaaagaccggggtggaaaaccagatggaccttttttccatggaacatgaaaaccggtatggggatctgatcaacgaactgatcagcattttcatcccgccggaaaatgctacagcagcccagttagaagaagcacggaaaaatatggaaaaatatgcagactaccgcacctatctttcttttgacatgcagcagctgatcaaaaatgaggatgaggtgatccggatcggcttaagccgtatgatccgcaaaaattccggcggtgagggacagaacccgttatatgtggcgctccttgcaagttttgcacaggcctatcatattaacctgtcatcagctgtaaggcagaggccgtccatccgcctggttattttagacgaggcattttccaagatggatgcggaaaaggtggcaagctgtattgaactgatccgtggactgggctttcaggccattatcagcgctaccaatgacaagattcagaattatgtggagaatgtagataaaacctttgtatttgcaaatccaagtaaaaaatctatttccatccaggcgtttgaaaaggaccgcatgaaagatctggcgtcagaaatggatgaagaggcataa

SEQ ID NO: 1147 - DNA, 2301 bp, Unknown
  Artificiall/Consensus sequence
aaggtggccacatatatgggaaaagagggaacaaaagaaaaactggatatagagcttgaagctccggcggactttaccagcccggaagtgttgtatcaggatctggtcaaaacgatccataaataccatccttccgatgatatttccatgatcgaaaaggcatacaaggtcgctgcagaagcacataaggatcagaagagaaagtctggagagccttatatcatccatcctttatgtgtggccattatcctggctgatctggagatggacaaggagactattgcagctggccttcttcatgacgtagtagaagataccgtcatgacactggatgagctgaccaaagagtttggtcccgaggttgctttcctggtagacggtgttaccaagctgactcagttaaactgggataaagataaagtggagatccaggctgagaacctgcgcaagatgttccttgcaatggcaaaggatatccgcgttatcatcgttaagctggcagaccgtcttcacaacatgcgtaccggccagtactggaagccggagaagcagaaggaaaaagcaagggagaccatggagatctatgctcctattgcagaccgtctgggtatttccaagattaagatcgaattagatgacttatcacttaagtttttaaagccggaagtttattatgacctggtagaaaaagtggatctgcgcaaagatgcaagagaagcttttgtccagtccattgtagatgaagtaaaggcacatttagacgaagcaggcattgaagccaccgtaggcggcagagtaaagcatttcttcagtatttataagaagatgttaaagcagaacaagaccctggatcagatctacgatctgtttgctgtgcgtatcatggtagacacagtaaaagactgttatgcagctcttggtgtgatccatgaaatgtacaagccaattcctggtcgttttaaagactatatcgctatgccgaagcagaacatgtaccagtctctgcatacaactctgatcggcagcaccggacagccatttgagatccagatccgtacttacgagatgcaccgtactgctgagtatggtatcgctgctcactggaaatacaaagagagcggaagcggacagatcgctgccggaaaagaagaagagaaattaagctggctgcgccagatcctggagtggcagcgtgatacagatgattccaaagagtttttaagcatggtaaagggtgatctggacctgttctctgacagtgtttactgtttcactccgtccggtgatgtaaagactcttccaagcggctctactcctattgattttgcttattccatccacagtgcggtaggaaataagatggtaggcgccagagtcaatggaaaactggttcctattgaatatcagatccagaatggtgaccgtattgagatcatcacctcccagaattccaagggaccaagccgcgactggctgaagctggtacgcagcacacaggcaaaaaataagatcaatcagtggttcaagacccagatgaaagaggataatatcatccgcggccgtgatgccattgaccgttattgtaaggcaaaaggcattaatctggcggacctttccaaaccggaatttatggaaaaggtaatgaaccgctatgcctttaaagactgggattctgttcttgcatctattggacatggtggcttaaaagagggccaggtcattaacaagatgttggaagagcgggagaagaagctgaaacgtgagatcactgacgcagaagttctggacggcattgccgatacagatggaagaagcggcgaagcaactgtacgcaagaataagagcggtatcgtggtcaagggacttcatgatctggcagttcgtttctccagatgttgtaatcctgtacctggtgatgagatcgttggttttgttaccagaggaagaggcgtttccatccaccgtacagactgtatcaatgtgatcaaccttccggaagatgaaagaggacggctgatcgatgctgagtggcaggtagcagaaaatcctaccagtacagagcagtattccactgagatccagatcttcgcaaacaaccgtatcggcctttttgcagatatttcaaaggtatttacagaaaagcagatcgatattacttccatgaacgtgcgtaccagcaagcagggccgcgccaccatcattatgacctttgatatccatggaacagaagaactgaaccgtattaccgataagatccgccagatcgacggtgttctggatatccagagaactacaggctga

SEQ ID NO: 1148 - DNA, 1986 bp, Unknown
  Artificiall/Consensus sequence
atgaatatacatcaggtaaacggggaggtagctatgtcggatacagaatatggagcagcgttaaaacttggtaaaaaacaatatcaggatgcagtggcaaagggagaatacccgtatctgccggtgttggatgatgttttatcctatacggatattgtatccacagtaagccttggaacaatggatattcctctggcgaaactggtgggaaccaagactgcggaacggtccaattcctttgccaacaactttatgcctcttttgccggaacggtctgaatttgggatcaaatggttaaatctttacaatcatcaggtagaggacggaattcaggatcctattgtggcctatgaatttatgaaccggttctatgtccaggagggaaataagagagtcagtgttatgaaatacctgggtgcttacagtattcccggaacggtgacccgtctgatccctaaaaggacggatgatctggaaaaccgtctgtattatgaatttctggatttttataaggtttcttctaactgtgatgtgtggttcagcaaggaaggaagatacaaagaacttctgaaactgatgggaatgaagccggaccaggtgtgggaagaagaggaccgtgtatatttcagatctgcctatggacgctttgccaaagccttttccatggctcatggagaccgcttaaagcttacagagggagatgcctttctggtttatattgaagtttatggatatgacaatgtaaaaggccagacagaaagagaaatgtaccgggcgttgatgcgtatctgggaagagatccagctggccaacagaggaaataagatcgaactgatccaggatccccaggaagtagaggaagataaaaaaccggccatcttaaaatggttcctgcctcaggaagagataccaagcggtctgaaagtgggatttatctatggaagaacagcagaaacttcccggtggatctatggccatgaactgggaagaatgtatctggaacaggcattccccggaaaactgacgactatggtagtagatcaggcagatacagaggaagcggtggcggaggctattgaaaaagaggcaaaagccggctgtaccattatttttactattacttccaggatgttaggacagagcgtccgttcggcggctctttatccggatattaaattttacaactgttccattaatatgtcctattcttccgtaagcaattactatgcaagaatgtatgaggcaaaattccttatgggagcgatcgcggcagcactgtccagggaagacaggctgggatatattgcagagcagcctacctatggaatgttagctgatatcaatgcctttgcccttggtgcaagaatggttaatccttatgtggaagtacatctggaatgggacagaaggaaaaaggcgcagcatacagaagatattttacatgaaaaagggatccattatatttccggccatgacatgatcaatccggaccatccgtccagggaatatggtctgtatcggaaaaatgaagatggaacagtgacaaaccttgctatgccggtatggcactggggtaaattctatgagcagatcatccgtcttgcatttaagagtacagaagagatcgaagccatgaaaggcaagaaagcagtaaactactggtggggtatgtcagcggatgtgatcgatgtgatctgttctgaaaatatgccaaatggtaccaggcggctgatcgagtttttgaaaaattccattcgtgccggcagcttccatccatttgacggactgatctatgcccaggatggaagcaccaaatgcacccagggcaagagcttaaatgcagaggagatcattactatgaactggctggcgcaaaatgtagttggctatattccaaagatcggggaaatgaatgagcgcgcccaggaactgatgcagcttcagggcattaaggcaacggagcagacagagatggagaatgaataa

SEQ ID NO: 1149 - DNA, 2598 bp, Unknown
  Artificiall/Consensus sequence
atggatacaggcaaaaataaaatggttggaatgagaaaaaaaagggcgctgagaggcaccctttttgcggtcatattgtccgcttccatgagtttttcggctctggctgccatgacagcagacggaccgggaatggggacagcggcaggggcatcagcggatacttccgacagtacggacagtgagcaggtgcttaaaacagaagcagcgccagaggaaggccctatccgtatggatgtggtctatggatatgacaatgtggcaaaaagcgggcgttttcttccactggatatacagttagacaatacgtcagaggaaacctttgaaggaactttgtgcgttacttcccaggaaccggactatgacggttacagcaacaattcccaggaaaaatatgatacataccgctacgaatttccggtcatgatccagggagacagcagccttgaaaagaagttaaatatctctctttgcagcaagtcagacctgatgtacatcacacttatggatggggccggcaatgaggtacttagcaaacggctgaaaatggatctgaacacagatgcagcccagctgtttatcggtgtactttgtgatgagccggaacgcctttcctatctggagcaggtaggtgtcaattacagtatgctgcgtacaaagaccattgacctgtctgtgtatgatctgccggatacagaactgggactggaccagttagatgtgcttctgatcacggattttaactcagagacccttacagaagagcagacagaggcgatctgggaatgggtacaccgtggcggtattttactgtttggaacaggtgccaggggagatgaaacattatctgctttcagtaaacaattgctggaatatccggtttcacctggaatggtttacgagatccagatgggacaggaccgtacagccagggaaccgggggaaaatattctttccctggaaggaacagaagtggatttaaaaggcggaacagacctgcttacaagtggttcccttacggttctttctgctacttctgtaggaaatggaatggcagcggcagcaatttttgattttacggatctggaagaatattgtttaaaagacaactcctatgcagattatttccttacagcactccttggtgaagacagaatcaataccttaaacagcaacgcaggtggtggaaattacaaccagttctggtctgtccagagtctggtaaatacaggaaatattcgcaatcttccaaagatcggattttacatgaccctggcagtggcatatattgccctggcaggtccgggactttatttcttcttaaaacaaagagatctgcgggaatattaccagcctgcagtggcactgatcgccatctgtaccactggtatggtgatcttaatgggaacaggaacccgttttaagggcccgtttttcacttacgctaccatagaaaataccagtcagacagataaaacagagacgacttttatcaatatgcgggctccttataataagacatattcagtggaattaaatccccagtaccgtctgtatcctgttacaggcagtccttattatgaccaaaatccatcgaaggaatttttcggtgaaggagaagcagatatcaccatccgctatggggaagatgccacctggatccaggcagtggatacaggggcctttaattccaaaattttccagatggagcttcacacccagaatgaaacaggagaaggtttctcaggtgagatccgggcttttaacggaacagtttccggtactcttaccaataactattcttatgcagtagagaacgcagcaattcttctttacaatcagctgctgctgatcggaaatatggaaccaggtgagacgatctccttagataaccgtcaggtgactttctgcgcgaccaatttcagctatgcgctggcttcccagatcacaggcgtttccctgtatgacagaaacggggatatggaagatgccacctatgttcaggcattagagcgggccaatctgctttcattttatattgaaaattatctttccggttatcatgcacaggccagtgtggttgcttttggaagaggaaaagaaaatctggatttcctgaagaaaaatgactatgaggcttatggctgtacccttcttacctcagaactggatgtaaattatgaaaagggcggaaatgtatacagatctgccatgcagaaacagccaaatgttctttccggagaatatgacgcggacagaaataccatgtatggaatggcgcctgtgatcttggagtattatctgggaaatgaaacagatgtggaagctttggacttccatccgctgacagcagaggcttctgacagtctgcgttattattacacagttccatttacaggcggcatgtatttttataattacaatacaggggactatgatctgatgaagccggagaaagatcactataccagggaagagctggaagaatatctgtcaccgggaaataccattacagtgaagtatgtatatgataccacaggagaatatacctggaatatcatgcttccggtacttacagtcacaggaaggagcaagtaa

SEQ ID NO: 1150 - DNA, 2013 bp, Unknown
  Artificiall/Consensus sequence
catagattacgttgtgaaaacgaaaggagaactattaaaatgggcatgatagaaacaaagacagctaatgccattcgtgtattatctgctgatgctatccagaaggcaaaatccggacatcctggacttcctttaggatgtgcttccgcagcttatgaattatgggctaatcatatgagacataacccggcagatccaaagtgggtggacagagaccgtttcatcctttctggcggacatggttctatgctgctgtattcattattccatttatttggctatggtgatctgtctatggaagatttaaagaacttccgtcagatcgactcccttacaccaggacatcctgagtacggccacacagtaggtgtagaagctactacaggacctttaggacagggaatgggcatggctgtaggtatggctatggcagaggctcatttagcttccgtattcaacaaagatgacattaagatcgttgaccattacacctatgtactgggcggagacggctgtatgatggaaggtctttcctctgaagccttctctttagcaggtaccttaggacttggaaaactgatcgttctctacgactctaacaatatttccatcgaaggaaatacagatatcgcatttacagaagatactgcaaagcgttttgagtcctatggatttggcgtattccaggtagaagatggaaatgacttcgctgctatcggcgcagcgatcgaagcagctaaggctgatacagaaagaccttctctgatcgttcttcatactcagatcggatacggctgcccggctaaacagggtaaagcatctgcacatggtgagcctctgggcgaagagaacatcattgccatgaaggaaaacttaggctgggagagcatggagccattctatgtacctcaggatgtttatgaccacatggctaaggtaagagaaagcttaaaggcaccagaagaagagtggaatgcaagatttgcagcatactgtgagaagtatccggaaatgaaggaactttgggatcagtatcatgacaaagacctgcctaagaacctttgggacaatgaagaattctggtcctatgaggacaagccacaggcaaccagaaatctgtccggcgagctgttaaataagatcaataaggtagttccgaacctgttcggcggttctgccgacctggctccttccaacaagaccaacttaaagggcgagggagacttctccaaggctgattactctggaaagaacctgcactttggtgtaagagagcaggcaatgactgctattggaaatggtctggttcttcacggcggcgtgatcccttatgtagcaacctttttcgtattcagtgattacatgaagccaattgcaagactgtcatccctgatgaaggtgccgctgatctacgttctgacccatgacagcatcggtgtaggcgaagacggacctacccatgagccgatcgagcagttagctatgttacgtgcgcagcctaacttccatgtattccgccctgcagatgcaaaagagactgcagcagcatggtacagtgcgattacttctgaaaagacacctaccgctctggtacttaccagacagaacctgcctcagttagcaggaactggccgtgatgcagtaaagggcgcttacattgtagctgattccgcaaaggaaactccagatgcgatcatcattgctaccggttctgagttaagcctggcagtagaagcaaaagaactgctgttaaaggatggaatggatgtccgcgttgtatccatgccatgtatggacctgttcgaagagcagagcccagaatacaaagagtccgttcttccaaaggctgtaagaaagagagttgcagtagaagcactttctgacttcggctggggccgttatgtaggccttgacggcgcaactgtatgcatggaaggcttcggtgcatccggccctgcagcacagctgtttgagaagtttggatttaccgcagagcgtgttgctgagactgta

SEQ ID NO: 1151 - DNA, 2139 bp, Unknown
  Artificiall/Consensus sequence
atgcataagatggataaatatgagtttaatattaaagttgagcagataaaaaagctggtcaataaaagtgattatgagacagccatgaagattgcggataccattgactggagaagggtccgtaatgtaaatatcctgtctatggtcgcaggcatttatgagaaaaacggagagttccaggaagcaaaagatattctgcttctggcgtttgagagagctcctattggcaaacgcctgctttataagctggcagatctggctttaaaagaaggcaatgttgaggaagcagaagattattacaaagaattctgcaacctggcagcagacgatccaaggcagtatattttaagatatatgatcttaaaggcaaaaggtgcgcctgtagaacagctgatccataccctggagcagtactgcaacgcagaactggatgaaaagtggatgtatgagctggctgaactgtacaaccaggcaggaatggagcagctttgcgtcatgacctgcgataagatcatgcttatgtttggtcttggaaaatatgtagataaagccatggagttaaagcttcagtatgcacctttaaaccagtatcagatggatctggtagaaaataaagagaagtatgaagcaaaattaaaggcagtagagcaggaatacaaaaaaggtacttctattgtacagccgattgaaaatacagaccgccgtcagttagacagggaagaagagccggtggaagatacagcagaagatgagactgtttatgctgaggatgaatacaccgaagattaccgggaagaaccggctgttaccattcaggatgatgatataacagaggaagaaccggtttctgaggagcctgaagaagaactggcagaagagcctgaggagacttacgagacagaagaacctgaaacagaagattatgaggcaggggagtctgaagcggaagagtctgaagaggagccggaagcggatgaagagcaggctgtatatgaaacagcagcagcggatgaagaaatccgtgccagcatccatgaagcccgtgcgcaggaaaatctggcaagagaaatgtcaaaattatctgcagcagcagaggaagaagatctgccggaagatgaaatgggacagaccagagcgcttacagatatccgtgagctgagaaaaggtcctgtttatacaggttccaaccatttgatgatcgaggcagaggttcctgaaaagggacttgcgctggcagtggaggcactgcgtaaaatacataaagaaacaggcgcaaagaaccaggcagcaaagatctccggcgaaaaattaaaccgcagaggtgtatttgcgctggcagataagctgacaggaaaagacctgatcattgagcaggccggtgatatgaatgaaaacatccttcaggaactgaaccagttgatggcaagggatgagacgggtatgaatgtggtcctgatcgatacagcaaggcgcctggaagaactgcaccgtgtatatccgggactggcaaagcgctttgagtgcattggaacttctgacagcataaaagcgaagaaagcagcagctcctgtaccatctgagtctggaaaaggatctctggcaaaggctcctgaagttgttgagaagaaagtacagccagctccaaagccagtggcagcaccaaaagaggcaccggctccaaaaacggcggcaacgaaggcagttgtaacttcgaaggcagctgcgccaaagcctgcagccaaaccagcagcacagccggaaaagaaggcagctgcaccagctaaaaagcgtccggttcaggcaccggctgtaaaagaactagctcgtatggcagagacagaacagccagagcacagcgagcaggaaatggacattgatgagttcgcaaaatatgcctgccagtatgcaagcaagatcgactgcagtatttccggaaagagtatgttagctctttacgagcgcattgagatcatggaagaagatggcattgccctgaccagagaagaagctgaaaaccttattgaagaggcagctgacagagcggaaaatccatccttctttaagagacttacaggtattttctcttctaaatacgataaggatggcctccttatactgaaggaggagcatttcttatga

SEQ ID NO: 1152 - DNA, 3051 bp, Unknown
  Artificiall/Consensus sequence
ggaggatcttacatgacaactctgccggaaaaaggcgaagagatttttggatataaagtgatggaccagaccactgtttccatgttgggagcccgtataacggaactctcccatgcctgcagcggtgccagagtcctgtatatagaaaatgatgaccgggaactgggttttaacctgatctaccgcacgccccagttagaccagtcggacagcaaccacattttagagcatctgatgctgtgctcctgctcccgctatcccagccgggatattttctttgatatggacagcaaaagctattctacctttatgaacggccttacggataatacctacacctgctatccggtgtgttcccagagtgaggaccagttattaaagataatggatgtatttttatgctgtatggaggaaccggatgccttaaaagaagattatttcttccgtcgggaagcactgcgctatgagctggaaagtgaagatgaggaactgtctttagaaggaaccgtctttaatgaagactgggggcatttaacggacattcaggaaaatgcagacagctttatggcggaaactctttatgaaggccagactgcttcccatttacttggccgtgcacattttcattacaaggatatttcttttgggcggatcagggagcggtttgaaaaattttaccgttattccaactgcctgatcgttttatacggaaaaatggatattgcccgggttctgacttttctggacaaagaacatttatcccgttttccagttgcagcgggcatagtggatcatgatcttctttcttatttccatgaaccggtaaaacagggatttttcaaacgtcaggcggaaagtccggcttatgagggaaatccgggaaataataacgggatcattgattatggcatcgacctttccggctgcagtgagcaggacctgattttctgggacatggtaacagatattttggatcaggacacctctgccattcatcgtgccgcccgtgaaaagggtcttaacaatgtgatcgaagtttatctggatacagcaccggctctcccttctttaaaattccgcctgcacaatgcaaaaccgggacaggatgaggagtttttagctgctgtaaagacaggtcttaaagaagtttccgaaaatggcgtttcttcagatctgtttcatgcagttttaaaagaaaaccgtctttctgactgtcttaccagagaggcgcctcatcttgggttccatatttctgaggagatcggtaaatactggagcacaacggataagaccggatattttactctttatgaaaactgttttgataccttctttcaggatgagaaacaggatattttgcgcagacttgctggagatgctttaactccttctttaagtgccgttgtcaccactgttcccaaaccgggtctggcggaagccatggaagaagaaaaggaacagtatttgaaagaaaaaaaggcttctttaagcaaaaaagagattttaaaattaatggaggacacaaaggatttccagatctggaaccagaatgaccagtgcaatctggactttctcatacagccggaagatctgcccggcccggaagcagagccggtgatctctgaaaccgttttacatgatatacactgcctttccagtgcggtttctttaaaggggatcggctgctatcagcttttctttgatatcagcggtttgaagccttctgactggaattacctgaccctctatcagatgcttttaacagaactggataccagtcattttacagtagaacagcagaaaaacaaggaacaggaactgctttatgactgtacttttgatgaactgtatccggaaagggaagctggcaagaacagtcatcctatgatgagcgtgttctggtatggacttacagaggattttgaagaaggtctggaactgcttttggatcttatgggcggctgcgattatgaggactgtgagaccattttacgggtcattgacaagtatctgccggattatgacatgtccaggtctgacaatggtccatctctggcttacagccttacagagcggtatatcaggcgggacagttgcttccggtatctgctgaaccagccaggtatgtatgactttttgaaggagatacgggatgtgctggagcgggcgcaggaggttgaaaagtcagtcaattctactgattatactgatatgcaactcagcagctcacataccccaggcaccactgagactgcgactctggacgtcaaagccctggaagccgcaaaacagatttctaaaaacctgcgccgggtggctgactgcattttaaataaacacaggcttgtattccttgcctgtgcagatgaaaacagcctggcatctattctggaacatagtacaaaacggctttcagctcttcatgaggtcacagaagatgcacctcttccggacagcattttcacctgcccacgcagaagtgccgctgctattgacagtcctttggaagaagtgcgtatgaccggtgattttggcaatgtttctgaatttatgggccgtcatcttccatttttgctggctgcggctgacaaatatattaaacctgctatccgctatcagggctgtgcctatgacagcggtgtggattttctcctgccaaaccggtattttaccttgtggagcacttccgactcacggatccgctctactcttgaaacattcgcctctgcaggagaacagcttgaaaacctggcgatcagtgaggaagacctgcggggctatattttaagcgcctatgcccaggcactgccaccgtccggcatgttaaacggccggatgcgtttcctgcgccgcagattatttggtatttcaacggatcatatcaataaaatgataatggatatcaggaacagttctttgaaagaccaaagaacggctgccaagctgatccacaagatcttgcagaacagtccggctgccgttgtaggaaatgaaaagttgatcgaggaaaataaagatttatttgatgaagtgatgaagttgcattcataa

SEQ ID NO: 1153 - DNA, 2949 bp, Unknown
  Artificiall/Consensus sequence
atgaacagacagcagatgcttgaaaaagtagaaaacctttctgcctacgaggtaaaagaccgtcgttttgtagaagagatgaattccgaaggaatggtgctggaacatagaaaaagcggtgccagactgttcctcatgagcaacgaagacgacaacaaagtattttcaatcggcttcagaacaccgcctgcggacagtaccggactgcctcatatcctggagcacagcgtactggaaggttctgaaaagtttccggtaaaagatccctttgtagagttagtaaaaggttccttaaataccttcttaaatgcaatgacttatccggacaagaccgtatatccggtagccagttgcaatgataaagatttccagaacctgatggatgtatatttagatggtgtattccatccgtccatttacagagagccaaagatcttcaaacaggaaggctggcattatgaactgccttcagaggatgcacctcttactgtcaatggtgttgtatacaatgagatgaaaggtgctttttcctcaccggaaagtgtgctggagcgtttcacttcatcagtcctttttccagataccccgtacagcaatgagtctggcggtgacccggcagtgatccccaacttaagctatgagcagttcatccaattccacaaagactattatcatccggcaaacagctatatctatctttatggcgatatggatatggaagaaaagcttttatggctggataaagaatatttatctgcctatgacaaaaaggactttaccttagactcttccattgcattacagaagccatttacagaaccggttgaaaaagagaccacctattctgttactgcgaatgaaggcacagaagacaacacctacttatctctgaacacagtggtaggaacagatatagatccaatcctctatgttgcattccagatcctggactacacgctcatcagcgctccgggagcaccattaaagcaggctctgatcgatgcacatattggtcaggatattatgggcggctatgaaaatggtattttacagccttatttctctgttgtggctaagaatgcaaataaagagcagaagggtgaatttttatccgttgtaaaaggcactttgagaaaactggctgatcagggaattgacaaaaagagcctgttagcaggtttaaattactatgaattccgttacagggaagcagattatggttctgctccaaagggactgatgtacggtttatggtctatggacagctggctgtatgatgcagatccaatgcttcacttacagtatcagaagacctttgattatctgaaaaaagcagcccaggaaggctattttgagcagcttatcaaagattatctcttagataaccctcatgaggcagttgtgatcgtaagccctgaaattgacctgactgcaagggaagatgcagaactggcagagcgtctggcaaagtataaagactccttaagcagtgaacaggtaaaagccctggtaaaagagacggcagagctgaaagcataccaggaagaaccttccacaaaagaggatctggagaagatcccaatgcttggaagagaagatatcaaacgccagtcagaaccgttttcctacaaagtaaaagaggaagagaaaaccacggttgtccacagtccaatgttcacttccggtattgcttatatcaaactgctttttgatatgaatgtgatcccgaaagaggatctgccttatgcatcccttttaaagtctgttttaggctatgtggatacagaaaattttacctaccgggatcttaccagtgagatccatttaaacagcggcggactggacttttatgtttcttcctgggaagacctgaatgaaaagggtgcttttaagggggcatttacagcaggcatcaaggttctttatgaaaaagtaggttttgcttttgacattatcaaagagatccttacagcttctaaattagatgatgagaaacgtctgggtgagatcttagatgagatgcgttccagatccagaatgcgcttggaaggtgcttcccacagcgcagcagttgcaagagcctgctcctatttctcaccggtaagagcctttgacgatatgacaggcggaattgaatatttccatttcctggaaaaaacagcagatgcctacagcaaggatgagaaattccgtaaggaactggtcagaaagttgaaggaaacagcagaaaaattgtttgcagcagataatcttatggtaggttatacagcagacgaggaaggctacaaggctcttccggaagaattaaagaaattcaaggctgcattaagtgataaaccaagcaggagatatgcttttgaatttgtgccggagctgaaaaacgaaggctttaagacctcttccaaggtaaattatgtggcacgctgcggttcttttgacgcagaagcttacactggtgccctggaagtattaaaggtcatcatgaactacgaatatttatggcagaacctgcgcgtgatcggcggcgcctatggctgtatgagtaattttggaagaagcggaaccggctgtctggtatcctacagagatccaaagcttgcaactacagataagatctacgaaggtatcccggaatatttaaagaacttctccattgatgagagggatatgacaaaatatgtgatcggtgccatgagcagcgtagatacaccattaagcccggcagtaaaaggttccagaaacctgactgcctatttatccggaattaccgatgaaatggtacagaaaaagagagaacagatcctggatgtgacccaggaggatatccgcgcattggcagatatcctggagtccatcttaaaaacaggtgctttctgtgtcattggaaatgaacagcagatcgaagcagataaaaacatgttcaaagaagtgaaagaactgtttcactaa

SEQ ID NO: 1154 - DNA, 2226 bp, Unknown
  Artificiall/Consensus sequence
atgaagtataaagtggatgtggtccgtatccgtgaaaattccattacactgaacggatgggctctgggaaagaccccggagagcaaggtcactttccgggtagaagatgaacatcaccagccggtgaagtgcaaaatggtttctaccagaagagatgatgtaagccagatctattttaagaaagtgatcgataaggaatttggctttgatatccagtttccatatgagagaggaaaaagttactggctgctgatccgctgtgatggcagacaggcaaagatcaaatataatgaagaactgatcaccaagagagccagtgttgcccacaagcgcatggaaaagatcaaagatctgatgaacatggaaacggtccatgtagctcttgatttctggaaggaaaatggtctccgtgcccttattaaaaaatcctgccataagatccagggactggataatgattacgattatggtgagtggtatgagctgaccaagccgacagaggaagaactgaaggcccagagggaaacacattttgaaaaagaacctttattttccgtagtcataccggtatacaaaacaccggagcgttatctgaaagagatgttagactccatcctggaccagacttatggaaactgggaagtatgtattgcagatggaagccccagaggccaggatgtggaaaaggtattaaagaaatatgcacagaaagactcccggatccgttatgagatcttggggggaaacaggggcatttccggaaataccaatgcagctcttgctatggcaaagggggaatatgtgatcctggcagaccatgatgataccattccgcctcaggcattttatgaggtggcaaaggctatcaataagcatccggactgtgatgtgctgtattcagatgaagacaagctggatatggatgggaaggctttatttgatcctcattttaagccggattttaacccggacctgcttaccagtgtgaattatatctgccatttgttcgtggtgaaaaaagagttattagaccaggtaggcggcttccgccaggaatttgacggagcccaggattatgactttatcttccgctgcactgagcaggcaaaagagatcgtccatatcccacaggtactttatcactggcgctgccatcaggactctactgccagcaatccggaaagcaagatgtatgcttttgaggctggttccagagcgatcatggcccattatgagcgtatgggcattccggcagaacgtgtggaaaagggcgtagattacggtatttaccatactacctataagatcaaaggagagcccctgatctccattattattccaaataaggatcacagcaaggatctggatgtgtgtgtccggtctattttagagaagtctacttaccggaacctggaatttatcattgtggaaaataacagtacagagccggagacttttgcgtattataaaaagatgaaagaaaaacatccgtccttccatgtagttacctggaaagaaggctttaattattctgccatcaacaattttggcgcatcctttgcaaagggagagtacctgctgcttcttaataatgatacggaactgttagagcctgacagcattcgtgaaatgcttgggttctgccagagagaagaggttggtattgcgggagcaaggcttctgtatgcagatgataccattcagcatgcaggtgttgttattggtttcggcggtattgctggacatacctttatcggtcttcacaaagcggaaaacagctatttccaccgtgcaatgtgtgcccaggattacagtgctgttacagctgcctgccttatgacaaagaagtctgtgtttgaggctgtgggaggtttaagtacggaactggcagttgctttcaatgatattgattactgcatgaaagttcgtgctctgggaaaactggtagtatatgccccttatgcaactctttaccattatgagtccaaatccaggggactggaagatacgcctgagaaggtggcgcggtttaacagggaagtagctattttcattaagaaatggccggacatcattaaaaatggtgatccttactacaacccgaacctgacgttaagaaagtccaattttgccctgcgtgatctgttaaaagaaaagatcggtgaaccttacgacctgtcagtttatgataagtttgcacctgaggagaaaaagagtgatgagtaa

SEQ ID NO: 1155 - DNA, 2829 bp, Unknown
  Artificiall/Consensus sequence
atgccaaagcagtatataaaaatacgcggcgcaaatgaacataatcttaaaaatatatccgtagatatcccaaggaatgaactggtggttctcaccggtctttccggctccggcaagtcatctctggcgtttgatacgatctatgcagaaggccagagacgctatatggagtctctgtcttcctatgcaagacagttcttaggacagatggaaaagccggaagtagaaagcatcgaaggcctttctccggccatttccattgaccagaaatccaccaaccgaaatccacgttctacagtgggaaccgtgacagagatctatgactatatgcgtcttctctatgcccgcattggtatcccccactgtccaaagtgcggcagggagatccacaaacagaccattgatcagatggtagaccagatcatggctatgccggagcggaccaagatccagcttttggctccggttgtccgtggaagaaagggcgaacacgtaaaagtgctggagcaggccagaaaaagcggctatatgcgtgtgcgcattgacggaaatctgtacgaactttccgaagagatcaaattagagaaaaacattaagcacaatattgatattattgtagaccgtctggttgtaaaagcgggaattgaaaaccgtctgaccgactctattgagacggttatgtccttaagcaacggcctgatgactgtagatgtgatcggtggggaaccggtgaatttcagccagagtttttcctgcccggactgtggtatcagtattgacgaggtagagccccgaagcttctcctttaacaacccatttggagcatgcccggagtgcttcggtttaggctataagatggaatttgacgaggatctgatgatcccggataaatccctttccatttcccagggtgccattgtggttatgggatggcagtcctgtacggacaaaggaagctttaccagggctatcttagacgcactggcagaggaatatcatttcagcctggatactccatttcaggattatccaaaggagatccacgatattatcatctatggtaccggcggtcatgaagtaaaagtccgctataagagccagagaggtgaaggcatctacgatgtagcatttgagggcctgatcgaaaatgtaaaccgccgctataaagagactttttcagaagcttccaaggcagaatatgaaacctatatgcggatcaccccatgtccggcctgcaagggacagcgactgaaaaaggagtctctggcagttacagtaggcggtctgaatatttaccaggctactaatatgtccattgtgaaatttaaggaatttatggatgggctgacgctgacacctatgcagcagaccattggtgcctctattttaaaggagattaaagcacgtatcagtttccttattgatgtgggactggattatctttccctttcccgtgctacaggcacactttccggcggcgaagcccagagaatccgtctggctacccagatcggatccggtctggtgggagtagcctatatcctggatgagccaagtataggacttcaccagagagataatgataaattgttaaaaactttattgcatctgcgtgacctgggaaacagcgttctggtagtagaacatgacgaagataccatgcgtgcagcagactgcattgtggatatcggacctggagccggggaacatggtggacagatcgttgcagtgggaactgcagaagagatcatgaaaaacccggagtcaataaccggtgcctatctcagcggccgtctgcagattccggttcctgatcagcgcagaactccaacgggctggatcacggtgcggggagcagaagagaataacctgaaaaagatcgatgtttccttcccgttaggcgtgatgacctgtgtgaccggtgtatccggttccggtaaaagttctcttgtaaacgagatcttatataaagccctcgcaaagaagttaaaccgcgcaaggaccattcctggaaagcataaatgcattgaaggagtagagcagttagataagattatagctattgaccagtccccaatcggacgtaccccacgttccaatccggctacctataccggtgtatttgacctgatccgggacctgtttgcctctacagcagatgcaaaagcaaagggctacaacaagggcagatttagtttcaatgtaaaaggtggtcgctgtgaagcctgctccggcgatggtatcatcaagatcgagatgcacttccttccggatgtatacgtgccctgtgaagtctgcggcggaaagcgctataaccgtgagacactggaagtaaaatataagggtaaaagcatttatgatgtcctggatatgacagtggaagatgcattgaaattctttgaaaatgtgccctccattaccagaaagatccagaccttatatgatgtaggtcttggttatgtccgtctgggacagccatctaccgaactttccggtggtgaagcccagcgtatcaaacttgctaccgaactttccaagcgcagtaccggaaagaccatttatatcctggatgagccaactacaggccttcattttgccgatgtccacaagctgatcgagatccttcgccgcttgtccgacggtggaaataccgttgttgtcattgaacacaacctggatgtgatcaaaacagcagactatatcatcgatatcggtcccgaaggcggcgacaagggaggaactgtcattgccaaaggaactcccgaagaagtggcagaaagcccggtttcctatacaggaaagtatgtgaagaagtatctggaacagtga

SEQ ID NO: 1156 - DNA, 2331 bp, Unknown
  Artificiall/Consensus sequence
aagcagcaactgttcttatacacagatacagaggaaagaaaaatggcaaccataacaggatttattgaaaaaataaaattcagaaacgaggaaaatggctatactgtgctgtcagttaccgaccagagcgatggtgatgaagttatcatggtaggtacgctttcttatgctgctgaaggagacatgatccaggcatctggacgcatgatcgagcatccggtatatggagaacagcttcagatcgaaagttacgaaatgaaaacgccccaggacgcagagtctatggagcgctatttaggttccggtgccatcaaaggtatcggcgcagcactggcagcccgtatcgtccgccatttcaaagccgacactttccgggtcatggaagaagaaccggagcgcctttccgaagtgaaaggcatcagtgaaaaaatggcaatggccattgctgaacaggtagaagagaaaaaaggcatgcgggaagccatgatgtttctgcaaaattatggcattactttaaatcttgcagctaagatctaccaggaatatggcccgaagttgtacagtatcatcaaagaaaatccctataagctggcagatgatattccaggtgtgggatttaaaatggcagacgagatcgccgaaaaagtaggcatcttcacagactccgactaccgtatcagggcaggtctcctttacattcttctccaggcatcagccaacggccatacctatcttcctcagaaagaattattttcccaggcggcagagttgttaaaagtagaaacgactgctatggaaaagcatctgatggatatgcagatcgaccgcaaagtagtggtaaaaacagtcccaggcagcgaaccgccggaatatctggtctattcttcccactactattatctggaactgaacacggcccgtatgctccatgacttaaacatccgtggcgatataccggaaacagagatccgtgccaatctggcgaaagtccagaaaaaagaagaaatccatttagatgaattgcaggaaaaagcagtttttgaggcagtaaacagcggacttttagtgatcaccggcggtcccggtacaggaaagactaccactatcaatgctattatccagtattttgaaaatgagggaatggagatcctactggcagcgccaaccggccgcgcagccaagcgaatgactgagactaccggttatgaggcccgtaccattcaccgcatgctggaactggtgccatccggtatcccggactctggttctatgtctgggaataatgccccttccggtaaaaatggctctttcagttccggtggcatgcattttgaccgaaatgaagaaaatccgctggatgccgatgttattatcatcgatgaaatgtccatggtagatatcagtctgatgcattccctgttacgcgcagtaaacgtaggaacacgtctgatactggtaggcgatgtggaccagcttccaagtgtaggacctggaaatgtgcttcgcgacattatcgagtccggctgttttaatgtagtaaaactgactcacattttccgtcaggcggcccaaagcgatattattgtaaatgcccacaagatcaacgaaggggaacgggtagatctgacaaagcgcagtaaagactttctctttatccgcagggaaaatcctgatgcagtgatcagcgcagccattacactgatccagcagaaacttcccggttatgtccacgcccaacccggtgatatccaggtaatgacgcctatgcgaaaaggtgctctgggagtagaacgtctaaaccagattctgcaaaattacttaaacccaccggatccgtctaaaaaagagaaagagtccggcggtatcatctaccgcaccggggataaagtgatgcagatcaaaaataattaccagatggaatgggagattcgcagcaaatacggcattcctacagataaaggtgccggtgtatttaatggtgatatggggattatccgggagatcaatgaatatgcggaaaatcttaccgtggaatttgatgaagggaaaatggtagaatacagttttaaacagttagaagaactggaacttgcctatgccattaccatccacaagtcccagggaagtgaatatccggcggtgatcatccctatgtattccggcccacgtatgctgatgaccagaaatctgatctatacagcggtgacaagagcccgctcctgtgtctgcctggtcggccggccggatgcattttatactatggcagataactccatggagcagaaacgctattgcggcctgaaaacccgcatagaagaaatatacgcctga

SEQ ID NO: 1157 - DNA, 1677 bp, Unknown
  Artificiall/Consensus sequence
gtggtcctgagtgaaactagtggaagcgaaatcttcagggattggatttacagaagcaacaaacaacaagcgaggatacatttcatgaatgaaaaatatacatattatctgcgatatgcctgcatatccagtgcgctggcggcagcgttggcgttaggaggctgttcttcaggggaaagaggagttgcaactcagaatgaggctgtagctgcaaatgcccaggacggacaggcagcagtttcagatggaacagatgagaccatagcacctttaggaatggatgggcagatccttcctggactggatgatgtagaattgccggaagatgcacaggcagcgcctcagtatttaagagaaggtgtacgccatgagatcgtaaagaagttacagcagcgattaatggacttgggctttatggataacgatgaacctactgactattttggtcaggtcactcttacagcagtgaaacatttccagagacagaatgaactgcctcaggatggtattgtaggtgataccacctggaatgaactgatggcagatgatgccaaacattacgcagtatcaaagggaacccagggggatgatatccagaagatccagcagcgattatacgaactgggctatctggcttctgcagaccaggtaacaggcaactttgacgatgccacagaaaccgctgttttaaaactccagggcgtcaatggccttgcagaagacggcaaggtaggccagcagacctataacctgatgtacagcgatgacattaaggcaaatatgcttgcatatggcgaaaagagcgatgtggtattagcatgccagcagcgtttaaaggatctgggctatctgactactacaccggacggtacctacggtcaggacactgtgatcgcagttaagcagttccaggcaagaaacgaccaggtagtagatggttacttaggaccatccacacgtattgtattaaacagttctgacgcaaagccaaacggcctgatgatcggcgaacagggcgattctgttaccagagtacagcagctgttaagcaagtacggctatctgccgtcttccaatgtaaccggctactatggtgaagcaacagaagacgcggtaaagaacttccagtcacgaaacggcctgtctgcagacggtaaagtaggcgtacagaccatggcaaagctgaccagtgataatgttaagaagccggcgcctactacagcagcgtcaactaagagtaataaatcaaatagcagcagcaataagaataatagctcaagtaagggcaacagcggtggaaataccagctcaccggctccgagaccagcttccggtgcaggtgtttcagctttaatctctgtagcatcttccaaactgggaagtccatatgtatggggtgcaaagggaccaagctcctttgactgttccggttttgtatactggtgcttaaagcaggtaggcgtaagccagagttatatgacttcttccggctggagaagcgcaggacgttatacaaaggtaagcaattttaatgatatccaggcaggagatatcgtagtagtaagaggccatgtaggtatcgctgcaggcggcggaacagtcatcgatgcttcttccagtaacggtaaagttgtccacagaggtttaagttcctggtggagaagcaactttgtctgc

SEQ ID NO: 1158 - DNA, 3261 bp, Unknown
  Artificiall/Consensus sequence
gtggctgattcagtaaaaaaacagcagggaagaacgggtaaaccgggaagacctaagggaagtacgacaaaaaaagaaaccacagcaggaaacagcagaaaacgatccacggcatccggcacaaaaagaagttcctcaagacaggcgccggaagcggtttatgaagaagacgatttagggtttatgagggcagaagtgatcattatctgttcttttgccgttgccatccttttatttttaagtaactttggtttatgcgggatcgtaggacagatccttaaggggatacagttaggactgtttggcatcctgggatatcttttaccgatcctgatctttgtaggaacctgttttcatttatcaaatcagggaaatatccatgcagctattaaattaggagctgtgatcggggcgctgatcactctttgcggactgttccagttgctttttggaaggatgcctcagggcggatctgtaatgcagatctatgcagatgcttcgaatggaggcgccggaggcggtctggtaggcggagcgctagctatggctcttatgttctttgttggaagagcaggcgcttatctggtatttttagtaatcctgatcctgtgcatggtatgtataacaggtaaatcctttgtttcggcagttaagcagggcagtggacgggcttatcagtatgcaagagaagatatggaccgtagaaaagagatccatgcccagagagcagaagagcgtaaactgttaagagaagaacagagagtacgtggtgtcaacttaaatgccaccagactgacggctgtagatgaaggcagacgccctgttccggaagatgcagaatacgatgaggaagcctttgagcgggagtttggtacaaagcagcaggctgctaaacctgagatggatgagatcccggaggaaaaaccggcagctacaggaaagaaccgggtagtctatgaggaagaagaggagatcccttctccagcagacgagttcaggggcaagatccagatgccatccggctatgagaaaaataaggatgaaaaggatgagacagaggctcttgctgatgagttagaacagcagtatgagacgatccacgttccaaaagatcgacggaccttagaggagatggagataccggctcctgatgtgatccctgccggacggcccactgcctgggagcagaaagtatctgctgtgtctgaacatgcgataaaagaagaggaagaaccccttccaaaagaaatacagagagttcctgttgaggaaccgttgtgggatgaagatcttccggaagaaacagtcagtctggctgatctggaggaagagaaaagagcagctgagaaagcaacggagacacctatatacaacagcggaaaagctgaatatgaggaaaaaactcacataaatgatgagaaaaaacctcaaacgcaaagagactttgaacagtcagaagactgggaagagatcacagaagagccagaggagtccccctgggatccaaaactggatgagagtgtttctcctgatccactggctgctgcttccggttccatctatgtaccggaggagaaaaagcagatagtgacagcttccggaaaagtgatcgaagcagaaacagatctgttaaagaagaagctggaaagcacccgggcggcagaagctgctgcatctgtgccaaaggcagatccttttatggcacctcgatcttccaatgaaaaagtacggatcactccgccttcagaagaagagtcatctgaggcagttgccaaagagatcgcaaaacaggaagtagaaaaagaatacatattcccgccaacggatcttttaaagaaaccggtgagaaataataatgccttctcagaaaatgaatataaggcaactgctattaaactgcagcagacgttacacaactttggtgtcggtgttacggttaccaatatcagctgcggtccttctgttaccagatatgaattactgccggaacagggggtaaaggtaagcaagatcgtaggccttacagatgatatcaagttaagccttgcagctgcggatatccgtattgaggcgccgatcccgggaaaatctgcggtgggtattgaagttccgaataaggagaacaatatcgtatacttaagagaacttcttgactccgactcttttaagaaccataaatcccgccttgcctttgcagtaggtaaggatatcggcggacaggtagttgttacagatattgccaagatgccacaccttttgatcgcaggtgctaccggttctggtaaatccgtctgtatcaataccctcatcatgagtattatctttaaatccgatccaaaggatgtaaagatgatcatggtagatccgaaggtagtagagttaagtgtatacaatggtatccctcatctgctgatcccggttgttacagatccgaaaaaggcatccggagcattaaactgggcagttgcggagatgacagaccgatataagaagtttgcagaatgtaatgtaagagatttaaagggatacaacgaaaaagtagacaagctgacggatattccagatgataaaaagccaaagaaactgcctcagatcgttatcatcatcgacgagctggcagaccttatgatggttgcgccgggagaggtggaagactctatctgccgtctggcacagttagcccgtgcggccggtatccatctggtaattgcaacccagagaccatctgtaaatgtcatcaccggtctgatcaaggccaatgtaccatccagaattgcctttgcggtttcttccggtgtagactcccgtaccattattgatatgaacggtgcggaaaaactgcttggaaagggcgatatgctcttttatcctgcaggtttcccgaaacctcagcgtgttcagggcgcctttgtctctgatgaagaggtaggacgggtagtagaatttttaacagaacagggaatgactgcccagtataatgaagatgtgatcagccgtgtggctgcgccttcttcggatggaggcagttcctcagccgaacgggatgaatattttgcccaggctggtaaatttattattgaaaaagacaaggcatccattggtatgctgcagagagtctttaagatcggttttaaccgggcggcccgcattatggaccagctggcagaagccggagttgtaggcgaagaagaaggaaccaagccgagaaaagtattaatgagcccggagcagtttgaagaactgcttgaacagggcagataa

SEQ ID NO: 1159 - DNA, 2352 bp, Unknown
  Artificiall/Consensus sequence
atgcagaccacaccagcaccgtatatcaggaggaacaaagatattgcaaagaaggccggcgtggcccagggaacggtttccaatgtattaaatggtaaagggaacgtaagcagtgacaaaatacgccgggtaatggaagctgcaaggcaattgggctatgttccaaatgaaagagcagctttgctgcgcaagggaaccaatgactgcctggctctgatcatgccggattcccgggcaaggcagtatgaagatttttatttcagttttaaagactatgcccaggaacatggttatcttgtatcccgccatctgaccaatgaaaattcaccggaaagtgaagcgactgcattttcagaggcaaaagtaaagcaggtaaaggggatcgcctgcatttccgcagtagcgggaactgccagcgaggcggcgatctataaaaataatgggatctttggggaaatggaaccggcccagaataatggctcggatattccggtactttttgtagaccggaaaacaggtttcccttctgattttattgggtttgattatgaaaaagcgggacaggctatggcagagaaagcactgcaggcggggtatcgcagcatctgcctgcttacaggaaatccggattattccagtgaaaaggatttttgcaggggctttctgaccatgatggaaggttctacctgccaggtgatccagatctggacagactcatttagaaaataccagaatatcatgcagatatttaacggaacactgccccaggcattctttatatccaattatggatttgcagaaagtgccaaggatatgtgtaccactttttatggaaaagaagagggctcaccggatatctatacggtggcgccgctgtttaccattccggaaaatgactttattaaatatgaaatgaattaccgccagctaggaaaaagggcggcaaagatgctgatcagaaaggcagaggagtccggtgcggaagaaagcacagcacaggaaagtgcaacggaagaaaatacggcatcagaaaaaataccggataatgtcgggacagagggacatgccaattggatgatcccgggagacggatttcagaactggttcgtgaatatccgaaagccggaaagtacccagccattaaatattgtaactctggacagcccggaagcttatattatgaaaacgttttccagactgtttacccagaaaacgggaattgatgtaaatgtgtgcattctctcttatgatgaaatctatgaggcatttaactcgttagatgaaacctcccgttttgatatcctgcgactggatgtgacctggctttcctggtttgcccagaagcttctccggccattgtcagagatcgatgaaaatattgaaaacagcctgggacagtacgtggaaggagttccggagcattactgccgggtacatggtcagatctatgcgctgccggttacgcccagcgtgcagattctttattataggaaggacctgtttgaaagccctatctgcaagcggacctattttgagcagttccatgaagaactgcagccgccgaagacatttgaggaatataacaggatcgctgcatttttcacaagagatctgacaccctcatcaccggttccttatggatcgacgattacactgggctctaccggtgtggctggttctgagtttctggcaagattatttgccattcaggaaaacctgtacggtgcggacggacagatccatttagactccctgcagtgccagcaggctcttgcggagttagtacagctgcggcgttgtacatcgccggagtactgtggctggtggacccagactgcaaggcggtttgcagaaggaaattttgccatgtccattttgtacagcaactatgccagtgacctgtcggctcacagttcccatgtagtaggaaatgtagggtactctatgatgccgggaaataacccggtgcttggcggcggcagtttaggtgtttctaaatattgtaagcggccgaaggatgccctttcttttattaaatggatgtgcagtgagccgctttgttcagcgtcggctttactgggaagtacatccccatgccgcaggacctatgataattatgaggttttacataactatccatggctgaagcttaccagacactgcttccccattgcaaaagggaaccggcttccggcggagctttctgtaccctttgatgagcgtaagtttttgagcatcctgggactggcagttaagaatgcttataccggaattgtgaccccaaaagaggccctttccgatgcccagatgcagttttcaaattatttccatacttctttagaaaaacgttag

SEQ ID NO: 1160 - DNA, 1923 bp, Unknown
  Artificiall/Consensus sequence
gagaagatgaagttcttaagcattaccggccccaaggcagacattgaccgggtggtggatacctatctttccagatatgagatccatctggaaaatgccctgtcagagttaaagacggtaaaagacttaagaccttatattgagaccaatccatataaggaaaaattgaatattgccagagaactggcagaaaagatcggcggacagctgccagaggtttcagagacggaacttcctacacaggaagaagcagcaaagatggtagatgatctgaacagccggttaaaggaattaaatgataagaaagaagagcttcaggcgcagatccagactttaaagcgctctaaagaccaggtagcaccatttacagagttaaattacagcgtaaaagagatcctgggcttccagttcatcaagttccgctttggccgtatttccagggaatactttgacaagttcaacagctatgtgtacgagaccattgacacggtgatgtttaaatgcctggaagatgcggaatatgtctggatcgtctatttcgtgccggagaagctggcagacaagatcgatgccatttacgcgtccatgcattttgaacggtgtttcctgccggatgagtatgaaggtactccgatggaagcggaacatgtgttagatgacaggatcaaggcgttagaggctgaaaaacaggaagtggaaggaaagatccttcagacactggatgaaaataaaaaagagctggcagcagcccgtaccagactggagcgcttctccgtcaactttgatgtgcgtaaaatggcagcctgcaccaagcatggagatcatactttctacattctctgcggctggatgagcgaaacagacgcaaagaagttccagaaagagatcgagtctgacgcagatactttctgcatcatggaagataaccacaacaacattatgagcactccgcctacgaaaatgaaaaatccggggctgtttaagccatttgaaatgtatgtggagatgtatggtctgccttcttataatgagatcgatcctacgatcctcatcggtatcacctattctattttatttggatttatgtttggtgatgcgggacagggactctgccttctcattggtggatttttactgtataagttcaaaaaaatgcgtctggcaggcattatttcctgctgtggcttcttctctaccatattcggcgtgctgttcggcagtgtgttcggatttgaggatatcattgacgcagtgtggttaagacctcaggaagccatgacagatcttccatttattggaaaattaaacactgtatttgtagttgctattgccatcggtatgggcattatcctgttatgcatgatcttaaatatcatcaacagcgtaaaggagcacaacacagagaaaacatggtttgacaccaacggcgctgcgggactggtattttactttgcactggcaactgtcattgtcctgtatatgagcggaaatgcgcttccggcgactattgtactgactgtattatttattatcccgttactgcttatgttctttaaggaaccgttgtcagcaatggtagagaagaaggcacagaaaatggaaggcggcgtgggaatgttcattacccagggcgtatttgaactgtttgaagtgcttttaagctatttttccaataccctttctttcgtccgtgtaggcgctttcgcagtgagccatgcagccatgatgcaggtggttttaatgcttgcaggcgcagaggccggaagtcctaactgggcggttgttatcgggggaaacctgtttgtatgcggtatggaaggcctgatcgtaggtatccaggtacttcgtctggaatattatgagctgttcagccggttctacagaggaagcggacgagcatttgagccgtatggcaagcattag

SEQ ID NO: 1161 - DNA, 1884 bp, Unknown
  Artificiall/Consensus sequence
atgaaccgacaggcgctggtatgcagaaatatactggaaaaaccggatattacacagcgggaaatggcgaaaaacatggacatatccctgggtacagtcaatgggctggtgaaggaatgtctggcagagggatatattgcagaggaagaaaatgggaaagaaaaatatctcatccttctggaaaagggaaaagaactgttaaagccttataaagtagatggggcgctgatcattgcagccggtttcggttcccgttttgtgcctcttaccttcgagactccaaagggtcttttagaggtctttggagagcgcatgatcgagcgtcagatcaaacagctccatgaagtggggatccacgacattaccattgcagtaggctatttaaaagaaaaatttgaatacctgatcgataaatacgatgtgaaattattatacaatccggaatactcctgcaaaaacacgctggctactgtatacagagccagaaagttcttaaaaggccggaacgtatacattctttcatcagataactggatgcgggaaaatatgtaccattcctatgagtgcggtgcctggtacagcgcagcccacgaagaaggagagaccaaggaatggtgccttacctttaataaaaagggccgtatcagcgatgtaaatgtaggcggaaaagatgcgtggtttatgtacggtcccgtatatctttccagggagttttccgctaaattccttcctgtattagaggcttattatcagatccccggaacagagcagttttactgggagcagccttatgtggacatgttaaagggagaggcaaaacgccgtctggaaaaagaggacaaggagctgttgaaacagacagaagaagcctgcggcatacctgcgtccaaatggaacgagatcgagatgaatatcaaccgccagccggataaccaggtatacgaatttgaaaatctggaagagctgcgcctctttgatacccattatcagaaccactccgataatgcggccatggagctggtagcagaggtattccatgtgccggagtttcagatcacagacatcaaatgcttaaaatccggcatgaccaataaatccttcctgttccgcaccggagatcatcactgtatctgccgtatccccggacctggcacagagcttcttattaacagagagcaggaaaaagaagtttatgatgccgtccgtcctctgggcattacagaacatgtgttgtatctgaacccgaagaccggttataagatctctgaatactatgaaaatacccacaatgccagcgcagacaactgggacgatatgaagacctgtatggatatggtgcgaaagcttcatgaagcaggtttaaaagtaggccacagctttaatatcagggagcggatcagcttttacgagaaactttgcctggaacatggcggcattccttttgaagactacagtcaggttcgtgaatgggtaaatcagttgttagatgccttagataaaatggatcttccacaatgtttatgccatattgacgcaaatgtggataactttttaattttcccggatcacagtgcaaaacttcttgactgggagtacgcaggcatgtgcgacccgttaatggacgtatccatgtgtgcgatttattcctattatgaggaagagcagaccgaaaaattactggaactgtatttacagcgcagaccagatgacaaagagcggttcatcacctatgcagacgcagccttagggggcttcctctggtgcctgtgggctgtatacaaggcaagtctgggagatgagtttggagagtacaccattattatgtaccggtatgcgaagcggtactataagaagctgatgaaggagttaccacagttcttttag

SEQ ID NO: 1162 - DNA, 2358 bp, Unknown
  Artificiall/Consensus sequence
atgacacttcgcgatctacccattggaaaaactgcaacgattttgtctgttggcggagaaggagctttgcgccagcactttttagacatgggccttatccccaaaggagaggtgaccatggtgaaatatgcccctatgggcgaccctatggagctgcgcatccacagctatgagctgaccttgcgccttgcagatgcagaaaaaatagaaattacagatgtaagggacggcgttcttccccgcccccagaatccggacttaagcaccattgaacagtccaagcctcatccaggccttggtgaaggcggaaaataccatattaaagcaacggaaaatccactgccggatacagagctgcttacctttgcccttgcaggaaaccagaactgcggcaagaccacactgtttaaccagcttaccggttccaaccagcatgtaggtaacttccctggcgttaccgtagaccggaaagacggtatgatccgcggaaagagcaatacccttgtaacagaccttcctggtatctactccatgtccccttattccagtgaagagttggtaacccgaaactttcttttagatgagcatccaaagggcatcatcaacattgtagatgccaccaacattgagcgaaacctgtatctgaccatgcagttaatggaactggatatccctatggtccttgcattaaatatgatggatgaagtgcgggataacggcggttctattatggtcaaccagatggaggaaatgcttggtatcccggtcattcctatttctgctgccaaaaatgagggcatcgacgagctggtagaacatgccatccacgttgccaaatatcaggaacctccaagaaccatggacctttgtgatgcaaatgatgacggcggtgctgtccatcgttgtcttcacgccattatgcacctgattgaggaccatgcaaaagccgccggtatcccactgcgttttgctgcctccaagctggcggagggagatccccttattataaacagcttgaacctggatgagaacgagaaacagaccttagagcatatcattacccagatggaagcagagcgcggcctggaccgtgcagcagccattgcacatatgcgctttgattttattgcaaaaacctgtgatgcttccgttatcaagccaagagaaagcaaggaacatctgcgcagcgtgaaaatggataagatacttaccggaaaatataccgctataccctgttttgcaggtattatgggactggtattctaccttaccttcggcgtgatcggaagtttcttatctgacctccttgacagctgcatttccgctctttccacgctggtagaccatttcctgatcctttggaatgtaaacccggtgatccattcccttgttatggacggtattttcaacggtgtgggaagtgtattaagcttcctgccgatcattgttacactgttcttcttcctgtctttgctggaagacagcggatatatggcaagagtagcctttgttatggataagctgctgcgaaagatcggtctttccggccgcagcatcgtgcctatgcttatcggctttggctgtaccgttccgggcgttatggcaagccgtactcttccatcggaacgtgaccgtaaaatgaccattttgctgaccccgtttatgagctgttccgcaaagctgcctatctacgccttttttaccgcagcattcttcccggagcatggcacccttgtgatgatagccctgtattttggcggtattatcatgggtattttaatggcacttattttacgtggaactttatttaacggagaagctgttccttttgttatggagctgccaaattaccgtatgccaggtgccaaaaacgttggtctgctgttatgggataaggcaaaggatttccttcagagagcctttaccgttatcttcatggcaacccttgctatctggttcttacagaccttcagcctgcgtttaaacattgttacagactctaaggacagtatccttgctatgatctccggcctgatcgccccattaatgcatccaatgggactgggagactggcggatcgccactgcccttattacaggatttttagcaaaggaaagcgttgtttccacgctgtctatcctctttggaaaaaccagcacactggtatccagtatgacttctctgtccgctgccagcctgttagttttctgcctgctgtatacaccatgtgtggctgccattgcttctattaagagagagctgggtggaaaatgggcactgaccgttgtgatcttacagtgtgtggttgcatggatcgcagcttatattgtttatctgatcggaggatttttcttttaa

SEQ ID NO: 1163 - DNA, 2157 bp, Unknown
  Artificiall/Consensus sequence
atggatattattaaagcactggcagaagaactgaatattggacgccaccaggcagaggcagctgtaaagctcattgacgaaggcaataccattccgttcattgccagataccgtaaagaagcaaccggttcattaaatgatgaagttttaagaaatttagatgaacgtttaaaatatttaagaaacctggaagacaggaaagagcaggtcatcagtgctatttctgaccagggaaaaatgacagcagaactggaaaaacagatccgtgaagcggcaactttagtggcagtagaagacttatatcgtccatacaagccaaaacgccgtaccagggctatgatcgcccgtgaaaagggcttagagcctttggcaaatgtgatccttttacagaatttaaaagaacctgtggaaaaagcggcagaggcctatatttctgttgaaaaaggcgtagaaagtgttcaggatgccattaacggtgccatggacattcttgcagaaggcatttctgacgatgcaaaataccgcacctatatcagaaacattaccatgaacaagggacttctccagtcaactgcaaaggatggggaaaagcagtctgtttatgagacatactataattacgaagaaccggtgaaaaaagcagccggacaccgcatccttgcattaaacagaggagaagatgagaagatccttactgtaaaggtggcagcgccaacagagcagatcttaggatacctggaaaaacaggtgatcacaaaggaaaatccatataccacacctgtattaaaggcagtgatccaggacagctacagccgtcttattgctccttctgtagatcgtgagatccgcagtgaactgactgataaggcacaggaaggtgctatccgtgtatttggaaagaacttagagcagcttcttatgcagcctccaattgctggtaaagtagtattaggctgggacccggcattccgtaccggctgtaagctggctgtagtggacagtaccggcaaagtattagatactgtagttattttcccaactgccccacagaacaaggtggcagagtccaagaaaatattaaaagacctgatccataaatatggcatttccctgatctctgtgggaaacggaactgcttccagagagtctgaacagatcatcgtagagctgttaaaggaattaaaagagcaggtacagtatgtgatcgtaaatgaggccggtgcttctgtttattctgcaagcaagctggcaacagaagaattcccgaagttcgatgtaggacagagaagcgcagtttctattgcaagaagacttcaggacccactggctgaactggtaaagatcgatccaaaatccattggtgtaggccagtatcagcatgatatgaaccagaagaacctgggagaagcattgggcggcgttgtagaagactgtgtaaataaagtaggcgttgatttaaatacagcatctgcttccctgttagaatatgtttccggtatcaacaagactcttgcaaagaacattgtggcatacagagaggaaaatggtgcttttaagaaccgtaagcagctgttaaaggtagcaaaactgggtccaaaggcatttgaacagtgtgccggatttatgaggatcacaggaggcgataacccattagacggtaccagcgttcatccggaaagctatgaggcagcaggaaagctgttggagaaattgggatacacagaagatcagctgtcccatggcggtttaaatggtatcagcaaaaagattggtgattataagaaaatggcccaggaaatgggcgtaggtgagatcacacttcgtgatattaccgctgaactggaaaaaccggccagagacccgcgagatgagatgccgcgtcctgttttaagaagtgacattatagaaatgaaagacttaaagccgggaatggtattaaagggaaccgtgcgaaatgtcattgactttggtgcgtttgtggatatcggcgttcatcaggacggcctggtacacatttcccagatgacagaccgttatattaagcatccattagaggcagtaagcgtaggcgacgtggtagatgtgaagatcttaagcgtagatatggacaagaagaggatcgctcttacaatgaagggagtaaaggatggtaattga

SEQ ID NO: 1164 - DNA, 2592 bp, Unknown
  Artificiall/Consensus sequence
atgaatatcaataaatttacacagaaatcaatggaagcagttcagaactgcgaaaagctggcatatgaatatggaaaccagcagatcgaccagccgcatctgctgtacagcctgctgacgttagatgacagcctgatcatgaagctgatcacaaagatgggcattcagggcgacatgtttaaaaacgaggcaaagcaggccatagagaaactgaccaaggtaagcggtggcggacagctgtatatcagcaatgacttaaacaaagtcctgatcaatgcagaagatgaagccaaggccatgggagatgaatatgtttccgtagaacatcttttcctggctctgttaaaacagccttctaaggaaatgaaggacctgtttaagacctatggtattaccagagaaaagttccttcaggcactttccactgtaagaggcaatcagagagtggtaagcgacaacccggaggcaacttacgatacattacagaaatatggttacgatctggtagaacgtgccagagatcagaagctggatccggtcatcggccgtgacagcgagatccgtaacgtagtccgtatcctttcacgaaagaccaaaaataatccggtgctgatcggtgaacctggtgttggtaaaacagccgttgtagaaggtctggcgcagcgaatagtccgtggtgatgttcctgacggcctgaaagataagaagctgtttgccctggatatgggttctctggtagccggtgctaaatatagaggtgaatttgaggaacgtctgaaagctgttctggaagaagtaaagaagagcgaaggacagatcatcctgttcatcgatgagctgcacaccattgtaggcgcaggtaagacagaaggctctatggacgccggaaacatgttaaagcctatgcttgcaagaggcgaacttcactgtatcggtgcaactaccttaaatgagtatcgtcagtacattgaaaaagatgctgctttggaacgtcgtttccagcctgttatggtagcagagcctacagttgaagatactatttccattcttcgtggtttaaaagagcgctacgaagtttaccacggcgtaaagatcgcagactctgcgcttgtaagcgcggcagtgctttccgaccgttatatatccgaccgtttccttccagataaggctattgacctggtagatgaggcatgtgccatgatcaagacagagcttgacagtatgccggcagagctggatgaactgtcacgtaagatcatgcagatggagatcgaggaagcggctcttaagaaagagacggacagactgagcaaagaacgtctggaagacttacagaaagaactggcagaacttcatgataaatttgctgcaggcaaagcccagtggcagaatgaaaaagccagtgtagataaattatccagtctccgtgaggagattgaagctgtgaaccgccagatccaggatgcacagcagaaatacgacctgaacaaggctgcagagctgcagtacggtaaactgcctcagttacagaaagaactggaagctgaggaagaaaaggttaaaaatgaagacctcagcctggtacatgaaagtgtaaccgaagatgagatcgcccgtatcgtatccaagtggaccggtatcccggttgcgaaactgacagaaagtgagcgcagcaagaccttacatctggatgaagtccttcacaaacgtgtagtaggacaggacgaggcagtagaaaaggttacagatgccattatacgttccaaggccggtatcaaagatcctacaaagccaattggttctttcctgttcttaggacctaccggtgtaggtaaaacagaacttgcaaaggcactggcggagtcactgtttgacgatgagtccaatatggtgcgtattgatatgagtgagtacatggagaaacattcggtggctcgtctgatcggagcgcctccaggctatgttggctatgatgaaggtggtcagctgacagaagcagtacgccgtaaaccatacagtgttgtcctctttgatgaggtagaaaaggcacatccggatgtatttaatgtactgttacaggtactggatgatggccgtatcaccgactcccagggccgtaccgtggactttaagaacaccattatcatccttacttccaacattggttcccagtatctgttagagggaattgatgaaaacggaaatatccgtgaagaagcaagagatgcggttatgggagagttgagagcccacttcagaccggagtttttaaaccgtctggatgaaatgatcctgtttaagcctctgaccaaggacaatatcagccgtatcgtagacctttgcgtagcagatgtgaacaaacgtctggctgacagagagttgaagctgcgtctgacagatgctgccaaggtatttatcacagatcatggctatgatcctgtatatggtgcccgtcctctgaagcgttaccttcagaagaatgtggaaactctggctgcacgtatcatccttgcagatggagtaggagaaggctccgtgatcgtgatcgatgtagatccacagggagatcacctgactgccaaggcagaataa

SEQ ID NO: 1165 - DNA, 3504 bp, Unknown
  Artificiall/Consensus sequence
gaagtatttcacaaaggagggtttatggcatttacgcatctgcatgtccatacagaatacagtcttttggacggctcttccaagatcagagagctgaccgccagggcaaaagagctgggaatggacagcatggcaatcactgatcacggcgttatgtacggcgtcatcgacttttaccgggctgccagggaagtggggatcaaacccatccttggctgtgaggtctatgtggctcccggttcccgttttgacagggaaaatggtgccggcgaggaccggtattaccacctgatccttttggcggaaaataatacaggctataaaaacctgatgaagatcgtttccaagggctttgtagacggtttttattataagccaagagtggacttggaccttttagaaacttaccatgaaggcattatctcattaagcgcctgccttgcaggtgaggtacagaaatacctggcaagaggcatgtatgaagaggcgaagcggtctgctttaagatattctgagatctttgggaaagaccatttttatctggaacttcaggatcatggtataccggagcagaaaatggtaaatcagggactgctgcgcctttctcaggagacggggctggaactggtggctaccaacgacgttcattatacctttgcggaagatgccaaggcccatgacattttattgtgtatccagacaggcaaaaaggtaacagatgaggatcgcatgcgctatgaaggaggacagtattactgcaaatccgaagaagagatgcgaaagctgttcccttatgcacaggaagccattgacaatactcataagattgcagagcggtgtaatgtggagatcgagtttggtgttaccaagctgccaaaatatgaggtaccggaaggttttgactcctggacttatttgaaccacttatgccgggagggctttaagacccgttatccggatgatgacggcacgttaagccgccgtctggattatgaattaggtgttatcaaaaccatgggctatgtggattatttcctgatcgtatgggattttatcaattatgcccgttcccagaatattatggtgggaccagggcgtggttctgcggcaggaagtatcgtttcttatacgcttggcattaccaatattgacccggtgcgttataatctgctctttgagcgtttcttaaatccggagcgagtgtccatgcctgatattgacgtggatttctgctacgagcgcagacaggaagtcattgactacgttgtgcgcaaatacggcaaggaccaggtggtacagatcgtcacttttggtacactggcagcaaaaggtgtagtccgtgacgtaggccgtgtgctggatctgccttatgccatgtgcgactccattgcgaaaatgatccccaatgacctgggaatgaccttggataaggctcttacggccaatccggatctaaagaagctttataatgaggatgagcaggtaaaatatcttatcgatatgtcaaaacgtctggaaggactgccaagacatacctccatgcatgcggcaggcgttgtgatcggcagccgttctattgatgagtttgtgcctctttccagggcagcagacggaactattaccacccagtttaccatgacgaccattgaagagctgggattgttgaaaatggacttcctgggccttcgtacactgacggtgatccagaatgcagtgcgtctggcagaaaaagactacggcataaagctggatatggatcatattgattacaatgataaaaaggtactggagtctattggtacaggccgtacagaaggcgtgttccagcttgaaagcggcggtatgaaagggttcatgaaggaattgaagccggagaacctggaagatatcattgccggtatctccctgtaccgtccgggcccaatggattttatcccacgctatttaaagggtaaaaatgataagacctctattacctatgagtgccctcagctggagcccatcttaagcccgacctatggctgtatcgtttaccaggagcaggttatgcagatcgtccgtgacctggctggctataccatgggccgaagcgatctggtgcgccgtgccatgagtaagaaaaagacggctgtcatggaaaaagagcgtcagaacttcgtttatggaaatgaggcagagggagtaaagggctgtatcgccaatgggattgatgaaaagacggcaaaccatatttacgatgagatgatcgattttgcaaaatatgcatttaataagtctcatgctgcagcttatgctgtggtttcttatcagacggcttatttaaaatattattatccaaaagaatttatggcagcacttatgtcttctgttatggataatgtaagcaaattttcggaatatatcttaacctgccgccgtatgatggatattgccatcctgccgccggatatcaacgaaggagaaagcggcttctctgtatcaggagatggtatccgctatggactttctgcgatcaaaagcgtgggaaggccggtcgtagacgcaatcctggaagaacggaagaaaaacggtattttcagttccatggaagattttatcaaccgtatgaccaacaaagaggtgaaccgccgtaccattgaaaactttattaagtccggagctatggactctcttcctggcaccagacggcagaaggtggcagtggcgccgatccttcttgacaataaagcaagggagcgtaaaaacgcctgggaaggccagatgagtctgtttgacctggtatcagaggaagagaaaaaggaatatcaggtatctttcccggatgtgggagagtattccaaggaagagctgctggcttttgaaaaggatattctgggcgtatacatcagcggtcatccattagatgattatgaaggtctctggagaaagaatatcactgccacatctgctgattttattgtagatgaagagacagaagaagcagtggtaaaagatggcatgaaggtggtaataggcggtctggtggccggaaaagtggtaaagaccacaaggagcaaccagctgatggcatttatcacactggaagatctgatgggctctgtggaagtgatcgtttttccgaaaaattacgaagcggaccgggatgttttaacagaagactccaagatctttatcaagggcagagtgtccttaggagatgaaccggtgggcaaactggtatgcgagcaggtgatcccattttcaaaggttccaagacagctgtggctgcagtttgaagataaagaaatatatcaggccatggaaggggaaattttaggcattttaaaagaaagtgaaggcccggacagcgtagttatctatttaaagaaggagcgggcaaagaaaatactgcctgcaaactggaaagtagaggctgcaggggagctgatggaaacattgatttgtaaacttggtgaaaaaaatgtcaagcttgtagaaaaaaacttgattaatctgggaaaatga

SEQ ID NO: 1166 - DNA, 2139 bp, Unknown
  Artificiall/Consensus sequence
atggctgagaaaaatgattatgtaaaccgcgaactaagctggatcgagtttaactaccgtgtgttaagcgaagcaagagataaaagtacccctttgtttgaccgcctgaaatttttaagcattacagcttctaatctggatgagttttacatggtccgtgtagcttctttaaaagacatggtccatgcgaaatatgccaaaaaagatattgcaggacttactgcaaaagagcagctggacaagatcagtgaaaagactcaccagctggtagatctgcagtattccacctacaaccgctccctggtacctgctttaaagcagaatggtctgcgcattgtcatggaacatgaagaccttaccgaagatgaggctgcttttgcagatgaatatttccacaaaaatgtatatccggtccttacaccaatggcctttgactcatccagaccgtttcctctgatccgcaataaaacattaaacattgccgctcttttgaaaaagaagaatgaaaaagaggcagagctggaatttgccatggtacaggttccatctgttatcccaaggattgtagagctgccggaagaaaaggatgagaacggagaaacccagagagtggtcatcctgttagaggagatcattgagcggaacatgcagtcattattcttaaattatgacattgtggcatcccatcctttccgtatcatgcgaaatgcagatttctcattagatgaagaagaagcagtagaccttctggaagagatccagaagcagttaaagaagcgtcagtggggcgaagccatccgccttgagatcgagtccaatgtggataaacagcttttaaagatcttaaagaaggaactttccatcagctccgaagatatcttccagatatccggaccactggatctgacctttttaatgaaaatgtatggtcttgatgggtttgaccatttaaagactccgaaatacacaccgcagcctgttccggaactgatgaatgaggacaatattttcaccaatatccgcaaaggcgatatcctgctccaccatccataccagagctttgacccggtcgttaattttgtccgcagtgcagcaagagatccggaagtccttgccatcaagcagaccttataccgtgtcagcggaaattcaccgatcattgcggcactggcagaggcagcagacaacggcaagcaggtttctgttctggtagagctgaaagcccgttttgatgaggaaaataatatcaactgggcaaagatgttagagaaagctggctgccatgttatctatggtctggtgggcttaaagacccacagtaagatcactctggttgtccgtatggaagaagacggtatccgccgttatgtccacctgggaaccggaaactacaatgactccactgcaaaactgtatacagactgcggtatcttaacctgcgatccccagatcggtgaagacgcaactgctgtatttaatatgctttccggctattcagagccaagagcatggaacaagctgtcagtagctcctttatggctgcgccatcgtttcctgcgcatgatcaaccgtgagacagagcatgcaagagcaggaagagaagctcacattatggcaaaaatgaactccctttgcgataaggagatcatttccgccctttatgacgcttcctgtgcaggggtaaaaatagagctgatcgtccgtggtatctgctgcctgaaagcaggagttcccggtcttagcgaaaatatttccgtgcgctccatcgtaggaaatttcctggaacacagccgtattttctatttctttaatgacgcaagtccggaagtttatatgggcagtgcagactggatgccaagaaacttggatcgccgtgtggagatcctgttcccggtagaagatgaaaacctgaaagaaaaggtgatccatatcctgaaactggaactggaagacaatgtaaaagcacatcttctccagccggatggaagctacgagaaagtggacaagcgtggaaaggtccttgtaaattcccaggatcagttctgcgaagaagccatcgaaatggcaaaggcctgccaggagtcaaaagacccggcagtgaccaggatcttccagccgatcgaaagcagtaatgaataa

SEQ ID NO: 1167 - DNA, 3582 bp, Unknown
  Artificiall/Consensus sequence
atgagagaacggatcaaccgcctggcccgcgggatcattgacagcagcgtgccagagctggtgataaaaccagagaggatcgaaggggtcctttcaccgggagagtccgtgcggggagaattttccgttcaaagcggaaatgacctgtatattaaagggctggtgtattccggaaatgagagagtaaaattagaaagcgaagcatttggtggacttcgcaatcacattatatataacatcgacacccgatacttagaggatggagatacagttaagggatctttttacctggtcacaaacggaggcgagaaagagattccttattctttgcgcatacagacaggaaacaggacagaggaactgggaagcttaaaaaccccaagggattttgcagctctggcaaagaaaaactgggaactggccctgcgcctgtttgaatatcaggattttacagaagcgccttttatgcaggatgtgcaggcaaggacgatctatgagggtttaaagggaagaaacggcagaaataatctgttagaggaatttttagtagctcttcatgtaaaggaagcggtttccctgcgtacagacggggaaaagatcctgttaaatgcaccggaaaccattacagaaggtgtgatcgggcttacagccagtggctggggctatgtaaaaatacaggtagaagcagacggggattttcttgctgtggaaaaaaatgcagtgaccacccgtgagtttgaccagggcaactgccagatccattaccagatccttccacaatatcttcatgtcggaagaaactttggttctgtgcgcatccgttccctgcgccaggaatttgttttccctgtagaagtaataaagaaaaatgttcagggagcagatggaagagagaaaaaaacagcagataaggcatctgtctgtgaattttcccgtctgcgcctgaaacaggaatttacagatgagggagatttttctgtaaacagcgggttattaaagaaaacagaaaatctccgtgccagatatccggaagatatagctgtacgtttgtggcggacagaacagctttttaaagcaggaagaaaagatgcgtatacagcggctcttgcagagatcggagatcctgttttaagatgcagggatacaagaccggaaatctactgcttttatcagtatttagagctgttaaatgagccttcttctgaagagaaaaaggcagcactggcccgctacatacgtaagctcttaaatgaaaacaggaaaacggatggctggcttcttaacctgttagtaaaaacagacaggacctgcctgcaaaatccgctggagctttatgaacagatgcgctccatgttcggatatggctgcagaagcccgtttttatatggactggcctgccgccttcttaagatgcatccggatctgtttgtaaaaatgggagaatttgagatccaggtcttccttggtggattaaaaaatggctggctggaccagaacctggctgtaaaagctgctttatccctttcagaggtaaagcattacaggaagatcctggaaagactgttagtaaatttatacagatcctatccggaaatgcaggtattagaggcattgtgcggtcttctgatccggggagaaaagaaagacagatccgcctttggctggtatgagaaggccttaaaagcccatatcaatcttacaaggctttatgaatatttcctttattctctgccggatgattatggacatgcccttccaaaagaagtgctattgtatttctcttatgataaatctttagaccaggccaataaaagtgtgctgtataaaaacattttacagtatgtaaacccttctacggaactgtatcaggtctatgtgcgggaaatggaacagtttgccatggaacagctgcttgcaggcagaatgaacggctgtctggctgtgatctatgagcacatgatctatacagatatgatcgatcccagggctgcagggatcctgccaaagatcctttgttccagccgcgtaaaatgtgatgatccgagaatgaaatatgtgatcgtgcgctgtgaggaattaaaagaggaagaggcatttttattagaacatggggaagcttatgttccggctgtttctaagaatacagtcctgtttttccaggatgcatatgggggaagatatctgaatataagccacaggaaactgccggtcatggaccggaaagagctccttgaccgctgttatgaggtatatccggatcatcctatcttaaagcttcgcgcctgtgaggctgtgttaaaaaaaggtgtggaaaaagaggaggaagcccttcttttagaagataccttaagccagttaaagctgaatcctgtatttgagaaaaagcttcttcatctggtaacagaatattactgtaaaaaggctgtttccaaggaagaagaaggagaagagcggtgcgctttcctgatccagttagataaggacctgctggagccgtccatgcgaagaaagatctgtgagatctttatagactgtaattatttaagagaagcatataatatgcttttaacttatgaaatagaagatgtggatccggagaagctgttaaagctttgtacccgtatgatcttacagcagctgtttgaccaggatgaccgtttactggaactgtcctggagagtgtttgaggctggcaaagcggacagcgtgatcttagattatctctgtgaacattttaacgggaccacttcccagatgtatgagatcctgatccaggcagtaggggaacatgtggaaacctatgatctggaagaacgtctgttagctcagatgttgtttacaggcagctgtgaccagatcgattctgtatttgacctttacatgaagcgcaagcgcaccagggaaagtatggtaaaagcatattttacccagaagtgtatccagtatttcctggaagaaaaggagatcgacagtcagatcttccagtacctgaaaaatgcagtgggcgcggatcctggcaaggaaaagatccctacgatctatctgctggctcttacccgttactatgcaggacaggcagagatcacggcagatgagaagaaacagctgcagatcatggtaaatattctgttagagtcagaaatggtatttccatatatgaaggatctgggacggtttgtttctatcccggaagacattatggataagaccatgatcgagtaccggggagacaaaaatgtacagccctggatcgaaatgcgtatccttccccaggaggaccattttaccagggaagagatgaaacgggtatatcagggcatttatgtaaagaaactgaccctgtttaagggagaacttttagaataccagatctatgaacggggcgaaaagggcgctgttcttgtaaaagaaggccgtacctgctgtgacccggaaagagccggaagagaaaacagccgctttgcctgcttaaaccagatgtcagaggcagtggcaaagcaggatgcagaagggcttttaggggcaatggaagattatgtaaaacgatcagctgccctggggatcctatttcctgtgaactga

SEQ ID NO: 1168 - DNA, 1833 bp, Unknown
  Artificiall/Consensus sequence
atgagaagaagaaagaaggactctggtttaaaaacagcgctgttgctgatcgtggccattatttttatgatcatggccatcagtgttatagtgatcgtttttggaaagatccattcagattatgaaaaattggatatgaccagggcaagtgaaaaacagacactggaaatatcggcagctgagacaaaagaaacggatcagctgggctgggaggaaacagaggacggctggaagtataagatcgatgaaaagacctatgccgtggatcagtggctggaaataaaaggatttttgtatcattttgatgacaaggggatcatggcaactggtcagtggaaaggagatggccagatctttacctgccatgatgtaaaaggatacctgaaaaatattgagccggatcccaactatgtaccggaagatacaggggaagacatggacagttttatcaggaccaatgctttctggtgctatctggacagtgaggatacaggactttttaagaccattctgtataagaaaacggtagacaataaggtaaaaccacttggcaatgaaaagaacccggagaaagccacgaaaaactctttaagagcttatggagactatgtgtattatctcccaaaggtggcagaaagcaaacgatcttctctttcagaagaggagaaggaacggtgtgatgtactggtacgtatgataccgggacagaatacaaaagagatcattgctgaaaatgtagacggatatcttgtattggatgaaactatttactatgcccaggaggggaagatccatacagccacttccggtacggagacagaactttctgaaggtggatatcaggtaaagattgacggagatgcatgttatcttgtaaatgcacttggaaagccggtaacatctgctggaagcgcaggtattaccgtagaagatcgtgtatacaaggttgatgaaaatggtaagatcagttatgtaaagaaaaatccggttgctgcagatgacagttcttacgaacttcagggaacaggatcacagatgcagcttgtacgacggagttcttctggaagcaaaactattgcaagagcagattatggtgtacaaagttactgcattgtggataattccatttttttcagcgcttatgtggaaaagactgcagatggaaaatggtacagccgtatttataaaacggatctgaatggcaaagagaaaaaggtagtcagcggtatttttccaggagctgtttttaatctctactattttgaaagccagggagaaatatatggagagtatcatccgaagatctgggaaaatgcgtatggtgtagtggtcaatgtaaagcaggatggtactatttatgcagtaaaagacacttcggaaagaacgggaaagaaagttacaggaaatgatatgatcgagatcctggcacttcaggatgggaagatgatcggttattggcatgactgcaactggagcagaactggtgggatcacaagtgtactttggagtttaccggtttccctggatgtttcggcaaaaacgagagttgaaacagtggaagagatcaaagaagaggaaacagggaccagcgtagaagaaactactacaacaactgcagaaaaaatcgttcctgtaacgccgacacatagttcggtgtcacctgtagagacaggaaaggtgcatccgtccgtaaatccaacagaagttgtgatcggaacagatgcacctggaaaacgagtagaagagactacggtagcgaccgcgcctattgcaccggcgacaacggctgctgaaacaacagcagaagaaattaagatcgtgccgttatcataa

SEQ ID NO: 1169 - DNA, 2004 bp, Unknown
  Artificiall/Consensus sequence
tccttgataaagtcttttttgggacatgtaaagaaaggaaaatgcgataagatgggggaatgtaatatgagggatctggcttatctgcagcttctggcgcgtgaatatccgtcagttaaggaagctaccagtgagatcgtaaacttaatggcgatctgtagtcttccaaaaggaacagagtattttttcagtgatcttcatggagagtatgaagcgtttatccatttactccggtcttcttccggtatcatccgtgaaaagatcaaggaaacattcggacatttgatcccggaggaggagcagttacagttagcaaatctgatctattatccagagcgtcatcttccaaggatgatgaaagttggacggtatacagaagactggcagaagatcaccatttacagactggttaagatctgccgcgaagtttcttccaaatatacccgttcgaaggtaagaaaaaagatgcccaaggagtttgcttatattattgatgagcttctccatgtagactacagcgatgagaacaagaaactttactacaatgagatcatccattctattattgataccagtatagcagacaagtttattgttgcgctgtgccgtttgatccaaaatctgaccattgataatcttcacattatcggcgatatttttgatcgtggaccaagagcggatattatcatgaaggagttaatgaacttccatgatgtggacatccagtggggaaatcatgatatttcctggatgggagcagctgccggcaatctggcctgtatctgtaatgtgcttcgtatagccatcagctacaacagctttgatgtgctggaagatggatacggtatcaatctgcgtccactgtccatgtttgcggcaaaagtttaccaggatgatccatgtgtccgctttatgccaaagatcctggatgaaaatatttatgatgcagtagatcctggcctggcagctaagatgcacaaggcaattgctgtgatccagtttaaggtagaagaagcgatgatgcagcgccatccggagtatgagatggaaaaccgcatgcttttaactgcagtggattacaagaaaggaaccgttaccattgaaggaaaagaatacccaatgctggatatgaatttcccaaccattgacccgcgaaatccactggagctgaccagaggagaaaaggaactgttacgcactctctgcgcgtcattccgccacagcgaggttttacagcgtcaggtgaaatttatctattctcatggtggtatttacaagtgctacaactccaatctgctgtatcacggatgtattcctatgacaaaagatggagcatttgataccattatgatcggtggaaatggttataaaggaaagtccctgatggatttcttaaaccgccaggtacataatgcctacttccttccggacggtgcagatggaaaagaagaagcactggatctgatgtggtatctctggtgcggagcaagatctccggtatttggaaagtcaaagatgactacctttgaacactattttgtagaagataaggcaacacataaagaggtgatgaacccttactacaaactgtgtgaaaaagtagagatctgtgacaagatcctggaagaatttggcttaaaaacggaaggttcccatattattaacgggcatgtgcctgttaagttaaaagacggggaaaaaccggtaaaagcagggggaaagctttttgtgatcgacggtggtctttcaaaggcatatcagagcactaccggcattgcaggatatacattgatctacaactcacaccatctggcactggcagagcatatgccatttgacccgaagaaagacagtacaccgaaggtgtctgtggttgaaaaactgaaggtcaggatcatggtggcagatacggataagggccgtgaattaaaggaacagatcgcagacctgaaagaattagtggcggcataccgggaaggcgtaataaaggaaagggctgaataa

SEQ ID NO: 1170 - DNA, 1713 bp, Unknown
  Artificiall/Consensus sequence
atgcagaacagaccaacaggacgaagcagaaaacgtaccagaagaaaaaaaggcggctgcggaccggcgttgcttgcaggttttatatttcttgcagcagcaggctgtggagccggatttttatatggaaaatatttaaaaccgggaacggtgatggcagataagtgggatgttttccagatcaaagggaatcaggtggctctgatcttagataacgagcttcaggaagcaaaaggtatttacgaggatggacaggtatatctgccggtagactgggtggatgactatgtaaaccagcgtttttactgggatgacggggagaaacttttagtttatgcccttccggaggagatcgtctatgcggatgagtccacagaaggggaagcagggcctcttttaaaagaaaaggacggggaaacctatctttctttagggcttgtgaaaaattatacggatatccgggaagaggcttttgctaccagtgagatcaaaagagttttcattgatacggactgggatacatatgagacagccacactccgtcataaaacagctcttcggataaaaggtggtatccgcagcgagatcatcaatacagaagaaaagggaacctctgtgcagatcttagagcagatggataaatggtctaaagtgcgcacagaagatggttatatgggctatgtgccaaacagccgtttaagcaaagtggaggaagaaacaccggtcagcgaatttaatgcgcctgtgtatacaaacatttccatggatggaaaagtacgtctgggctttcatcaggtgacaacaaaggatgcaaatgctacctttgacaaggttgcagatacggcccagggtatgaatgtaatcgtgcctacctggtttaatataacagacaacgagggcaattatacgtcccttgcaagcaaggattatgtagataaggcacatgctttaggaattcaggtatgggccatgtttgacaatatcagtacagaagaaagcgtgaaaaatgtagactccggcaaattgttttcttctactgcgaccagaaaaaagctgatcgaaaatctgatgaaagaggcagatacctatggctttgacggttttaacctggattttgaaagcctgaaatcctcagcaggtcctcactatgtacagtttatccgtgaaatgtccgtatcatgcagacagaagggactggttctgtcagtagatgattatgttcctgctgtttacagtgcattctacaaccggaaagaacagggaatcgtggctgattatgtgatcgtcatgggatatgatgagcattttgcaggaggagatgcaggttccgttgcttccatttcctatgtggaaaatggtattaccggcacacttaaggaagttccaaaggaaaaactgatcaacagtgttcccttctatacaagagtgtggacggaaaaagacggaaagactacatcaaaggcctatggaatgacagctgccaaaaaatgggtagatgaaaataatgtagaactgacctggcaggacaaggtaggccagtactatggtgaaattgaaaatgaaaacggggtccagaagatctggatggaagaggcaaagtccctgggactgaaaaaagacctggtcaatcagtatgacctggcgggaattgcctgctggaagctgggatttgagacagcggatatctggacgattatggatgaagtaaaatag

SEQ ID NO: 1171 - DNA, 1890 bp, Unknown
  Artificiall/Consensus sequence
atgagtactaaaaagaacctgatcgtaccaaaacttcaaaaacaaaatctgggcaaagtcaatccccagaaagcagagtatttatatatatccaaagagttctgtaaagaaggactttcacagatcataaaagacgggggagtgcagtttaaagaaatccagaaatttgtaaaggatcaccaggaaccacagtatatcctggtacacgcttccaaactggaagaaggatacctggctatcagccttttagcaggtatctacaatgagattcacagtcgtggagagtgggaagaaggggcagagcctgacatccagtggtcagacagctggcaatgcctccccattattccatttaaagaagccgatgactattacaactggcaggaaaatgacttctcctcttttggaaactcctttctggccagccagaagacaaatgacacctttgttccttactgggcagaaaatgaggataaacctgtctgtatctctatggagaatatcagttttttcaggtgtgacccgatcattgataccttaaatagcttccgcagcaatgaacaggtctacgtcctgatccttcacgaagaaaatgacttcgactcctttaactcttttggaggatttggcggatttgacacctttgagtcaaatgaggataaaaacctgaaccagatcatattaagccttaccgcagaagagctggaaataccaaaaacaagctctgtctctctctattatgaaaatatctggaaacaaatggtcacaaacagcggctgcaagctggaacgtaaatttccggtccatgattttttactggatattgaaaaaatgaataaagagttttcctatgactttttagataagatcctaaaatatgccctgcggaacaaggaacatggtatcctgcgaaaaaaggattttcagtttatggaacgttttgcaggcaaacggggacctgcagagcagaagacagagacccgttctgccatccgctgtttaagagaagatctgatcggcatggaccaggtaaaagaacaggtcatggaaaccgtccaggtcatgaaattcaaccgtctgcgcaaggaaatgggcatgaaaaagagcagttaccacaacgttcacatgatgcttggtgctcccggaactgccaaaaccacagtagctaaattaatgggaaagatcatggaagaagaaaaacttctgcctggaagtcaattcacctgcgtaaacggtgctgaattaaagggcatgtatgtaggccattccgccccgaaaaccaaagctttatttgaggaaaatgacattatcgttattgatgaagcttattctctcaccggtgaccgaagcgaaccggactccttcagcagagaagccattgcccagttagtgatcgagttagaagaacatgcagaagataaactggtgatctttgccggatatggcggaacggatatagatgaaaaaaacaacaagatgaaagaatttatcgatgccaaccccggtatcaagagccgtattaactccactttctattttccgtcctatacagccccggagatggcggagatctttaagaaacatgcggaaataagtggatacgaactgccggaaaactggaaagaaccgatcactgcttatttctcaacccgtgtaaatgatgaaaactttggaaacggtcgtgaagccagagccttatttgaaaaagtttctgtccagatggcaaaacggatcatgggcgatgcaaacggaggtcttcaaaattccattaatgaaaaagccataaaacaatgccggatcagcgacattgaaggcgcgatccggcgggcaagggaagaaaacaaacagatctcaggccgtgtgaaagtgcacaacagaattggattttaa

SEQ ID NO: 1172 - DNA, 2418 bp, Unknown
  Artificiall/Consensus sequence
atggggagtagacgagggaaagaaggtcttttgctggctgtattctgggtggtggcaattgctctgattggaacagctgcaaacagactgatacttcatggccctttggggggaacattacaaaagaaagaaacaggacggatgctaatggaactgtctgtcctgtttttatggaatttatggtggttatgcctggcagtaaaaagcagggaaaaaagaggactggctatagcctgtctgatacccggctggcttttgttcctctggggacacaggatactgatcccgctgataggggctggtgtgtggatgggaacgctggctggatatggcatttgcatcaacaactgttttttggaaaatattggaagaaaaaacaaagttgtttttcctgtctgggagaagatccttctggggctgaccaccggaagcgcagcatggatggtccttgtatgtgcagtttctcttacagaacatgggggaatcgggctctggagaaagctggcgttgctgcttgctctggggattgcggcaatttctctgtggaaaaataaaaaaaattttggcaggtctgtggataactgtctgaaaacagaacagattgcagatatgtcagggatgaaaaaacagaatgtggtcagtaagtgcagcaatctattccgtgcagtcataccggaaaccgtgcttcaggcagctcttcttgcgttcatcctcaccatgttctttcttcaggcaggccgttcaaaccatgaactggactatgactctctccactatggactgcgttccgcctatgtcctggataatggaaacggtatttataaaaatctggggctgatcaatctggtgtatacctacagcaagggagcagaagtactggtgcttcccttatccggtacaccgacttacggatttgtcctttcctttactttctggacaaccatagtcagtgtagtgacagccgcagttatgggtgcgcgtttcagcggaaaaacagtcggtttctggacaggagcgctggtcagtgcgatcccaggtattatgaatatggcggtttctgctaaaagtgacagtattacgttaatgtgtcagcttattatttatgattttctctgtctggcagttgtcagagaaaatatatggctcatctttgcggtagctgtttatcttctttcactggtttacaaaccaacggctcttgtattttctacagccttaggcggtgtggggcttgtcagtctcctgatctttaaaaagacaggaaaaccggaaaaaagagcatttttaacatggatcctgccattatttgcaacagcaggattgtggtatcgaacctggctgcttacaggagttccggtaacttctgtatatgcaaatttctttgaaaagataggttttaaagtaaaatatccctataacttttcccatgtgatcggtgatccgtctgtcctttccaggggagaaaaaatacaccggctgctggaacggttaaagggagtactgatctctccggtaggagaagatatggaacacgtgatcattgcctggggaacagtgcttgtaacagcactcctgttattctggatctttcaggtaataacgaggtttataaagcatcagcagatctcccagttagatttctttgatggttttcttatgatcacactgttaattggttccgcggccagcatttacacacttgcccagatagatggaaattatttcatactggtgtatgcagtagcggcgatcagtaccgtgcggatcacaggatactggctaaaaacagaagagacagaaaacattgccgcagttacaacaggcagtgcagcagtggaaacgaaaaagatcctcaggtccggcatctgtttactgacagttccatttttcctcttcaataccctgatcgcatcctctaccagctgggcaggatgcccgggctttacctcttttaaactggtaaacagaggatattatgaccatcgtcatcatacacataaaagctgggaacgaagaggctgtaaggaactttattcccgttttacacctaaaacccgggtagtagcctttggctttcacccccaggtgttagatatggcctgcagcgtccagagttattatgatataacaggaagcggtggggatgtgtatcttgtaaaaaaactggcatattttgaagaatatttaaaatgggccggaaccgaatatatatatgtacaggcgggatatctggcagaccagcccagagccacacagatcatcgaagatatgatcgcagaagggaccttaagagatcttacctttgaatggggaaatatgctggcaaaagtagatctggatcatccatttaaagaaccggatgaacgattagtacagttgttccgtgacaattacagcatggagaaaaacgggaactag

SEQ ID NO: 1173 - DNA, 1548 bp, Unknown
  Artificiall/Consensus sequence
gaattacaacaggaggttatcatgcgtccttctctgagaaagctatggatgacgatctccataaaaagaaaaataggaatttttgcagccatggtcattttgatcatggctctttccgcttcttttaatgtgtggatcaccaacgtatccctgggaagctttggaggaattttgaatgacaactcccgttgcaatgactttcaggaggcactggatcaggaaatcagagcttttgagcattatgtgcgaaatgcagaccaggaaagccgggatacttacagggtggcatgtgtaagaacagaacgttgcctgtggtcactgccttctgagtacagaaggattggaaaagagcgcagtgccaggacatggaacataagaaatgcctatgaaggttacaaagtttatcgtgatgacgtagcggaaggaaataaaacaggcagtgaatttgtagacgaactgtattacgtatacaaaatgcaggagtacctccagggatataccggccgtctggtgcagataaccatggcagaaggaacagaagagtatcagaaagaagcagcaatgttttctaatattccgtatattattgtggccatttccatcgcacttatgatcatagcgatctggctgacaagaattctttcaaattccgttgcaaaacccattgtatctttggctgcaagtaccagaaagatagctgccaatgactttgatgagccggacctgatcatagaaaataaagatgaaatgggagaattggtcacagctttcaatgtaatgaaacacagtaccaagggctatattgccaccatgaaagaaaataacaaaatgcaggagctgctccacaaagaggaattagagcgcagtgaaatggaaaaacagttaggaagcgcaaggctggaactgttaaaaagtcagatcaatccccattttctctttaataccctgaatatgatcgcatgtaccgcaaaactggaagatgctgtggatacggaaaagatgatcttaagtctgggaaatctgttccgctataacctgaaaacaagggagcagactgtaacattagaccgggagttaaagatcgtaaatgactatatgtatcttcagaaaatgcgttttggaagcaggatcaaataccgtctgagcctggagacggatgcggcagacgtgatcattccgtccctgtccctgcagcctcttgtagaaaatgcggtggttcatggtctttctaaaaaagaaacgggaggtattctccatatccggatctggaaaaaggaccgtatgctgatcctttcagtggcagataccggccttggtatgagtcaggagcggtgcgaagaagttgctgcagcaatgaaagaacaccgcacggcaaagatcgggatcgggcttggaaatatttataagcgtgtccatatgatgtaccaaaagggagatctgcggatctacagccgggaaggaaaaggaacagtgatacaattgatgataccgcagggagaagaaacacagggggaagaagtatatgtaccgactgctgatcgcagatga

SEQ ID NO: 1174 - DNA, 1866 bp, Unknown
  Artificiall/Consensus sequence
atgacgaaaaataagatccagagactccttgccattctttgtgcagtagcggcagccttctgtatggtattaggatttataaatatgcctaagcagaatggggcggcaggtcaggagatccttcgtaccatgcgtatccagacactgctcagtgctaccggcgacagcgtagtggaaagttacgtagccattgcgaaacaggaagcacaggcggcagccaaggcatccggcggcggtatggcagctatccgtgaagcagtagaaaaggcagaaacagaaacaagagcaaaatacgaaaatggcgcccagagtgatctttccggtattgatgtaaccggtctttctgcagctgttgacgtatatacagaggctgtaaaggcctatgcagaggtggaggctcaggcccgcgctgcttatgaagaggcacattatgcagaggcagaggcagctttagaaaagaaacatgaagaaatgtcagcagcaggagaagagatcccggaagatgatgaagtagtagttgatatgtccggttttgaggcaactcctgaaatgcttgaaaagcaggaagaagcaaaggcaacttatgcaaatgtaggcgcagagctgaaaaagatctatccggtattgacggatgaagcattagaaacactggaagcgacagtagaaggcatcctttatcagtccggtgacagttttgccactcagtatgaccgttacgttgaacagagtaatattaaagagacaaatgaaggacggatcatccgtcacgcagatgacctggtttatttaggctttgcccttttagtattgactgtacttttactgtttaacagctggctggttgcaaaacttggtattccaagagtgatcatcggtgtattctttatcttactttgctttatgaccttatggtatgatctttctctttctactctgttaagtaatacagttgtacgaatgggaatgaatgccatcatggttctggcaatggttcctggtatccagtgcggtatcagcctgaatctgggtcttcccattggtctggttgcaggtctgatcggtggtcttttaaccattgagtttggtattccaggatggggaggtttcctcttcgctattgttgcaggttccgctctggcagctgtctgcggttatctgtatgcacttatgttaaaccgcttaaaaggttctgaaatgtctgttaccacctacgttggtttttccatcgtatctttaatgtgtattgcatggctggtactgccgtttaagtccctgaagcttcgctggccattaggaaccggtcttagaaataccattggtctggacggaaccaacttccgccatatcttaaatgatttcctggcattccagatcggcgattttaccattccgacaggactgctgttatttatggcacttagctgctttattgtatggatgttttcacgcagctgtaccggtcaggcgatgcaggcagtaggaaacaatcctcgttttgcagagtctgtaggtatcaatgttgacaagatgcgtattacaggtactgtattttcaaccgtacttggcgcggtgggaattctggtatattcccagagctacggctttatgcagctgtatacagcaccccgccagatgggctttatcgcagcatctgctatccttatcggcggtgcttctacaagccggtgcaagatcagccatgttctcatcggtaccttcctgttccagggtgttttaacactgggaatgccggttgcaaacgtattagtacctggttccactatttccgaaacactgcgtatcctgatctccaatggaatcattctgtacgcacttacaaagtcaggaggtgagtctcgtgcgtag

SEQ ID NO: 1175 - DNA, 2331 bp, Unknown
  Artificiall/Consensus sequence
atggcatatacacagatcaatcctgctacaggaaagaaattccgtctgatcggcgctcctgttgtaaagaaagacgcaaaggcactggtaacaggtaagccggtctacactgatgacctggcattaaaggactgcctgatcgtaaaagtgcttagaagcccacatgcccatgcactgatcgaagagatcgactgcaaggtagcttccagagtaccagggatcgaatgtatccttacatggaaagatgttccgcagaagcgttttaccatggccggacagacgtatcctgagccaagtccttatgaccgtttgatcctggaccagagagtccgctttgtaggtgatgcagtggcgatcattgcaggtgagacagaagctgcagtagaccatgcaatgcgtcttattaaagtgaaatatcaggtgttagagcctgttttagatatgcatgactccaaggacggtaagatcctggtacatccggaggacagctggaaagccctgtgtaatgtaggcgctgataataagagaaacttatgtgccagtggcggagagactcatggggatctggaggcggcatttgcaggctgcagccacattgtggaaaaaacataccacaccaaggcgaaccagcaggctatgatggagactttccgtgcctttacttatatggatgtatacggacgtttaaatgtagtagactccacccaggttacattccatgtgcgccgtattctggctcatgcattggatgtgccaaagtcaaagatccgcgtgatcaagccaagaatcggtggcggttttggcgcaaagcagactgttgtagcagaggtttatccggctatcgttaccatgaagacgggaaaaccggctaagatcatttacagccgttatgagtcccagatcgcctcttctccacgtcacgaaatggaagtaaaggtaaagatcggctgcgatgacaatggtattttacaggcaatggatgtgtatacattgtccaatacaggtgcatttggtgaacatggaccgaccactgtaggtctttccggccataagtccattcctatgtacggcacaccaaaagcattccgctttgcttatgatgtcgtttataccaaccgcatgtctgcaggcgcttaccgtggatatggcgcaacgcagggtatttttgctgtagagtctgctatggatgagctggcagcccagatgggaatgaacccgatcgagcttagaaagaaaaatatggtccgccagggacaggtgatgcctgcttactacggcgagactgccaatagctgcgcccttgaccgctgcgtggacaaggttatggagatgatcggctgggatgaaaaatatccgagaaaagatatgggaaatggaaaggtaagagcagttggtcttgcaatggctatgcagggctccgcaatttccggcgtagacgtgggaagcgttaccattaaggtaaatgatgacggcttttacagcatgaccattggtgcagctgatatgggtaccggctgtgataccacactggcccaggtagcagcagagtgtctggactgtgagctggatgatatcgtagtttacggtgttgatacggatatttccccatatgactccggttcctatgcttccagtactgcatatttaacaggtatggcagtagtaaagacctgtgagtcactgaaaaagaagatattaaagaaggcggcagaatatctgaattgctctgaggatgaactggagtttgcaggaaagacagtgcgcagattaaatgcccctgaaggcgaaccggcagagatcacattaaaggacattggaaacagagccatgtgctttaatgaagaagccctccaggctacagaatcccattcttcacctgtttctccgccaccatttatggcaggcgccgcagaagtggagatcgacaaggaaaccggtcatattgagctgcttcagtttgcagcagctgtagactgtggaaccccattaaacgagaacctggcaagagtacagacagaaggtggcctggcacagggaatcggtatggcaatgtacgaggatgtaacctattccgaccatggccgtgtccatgaaaattccttcatgcagtacaaagtaccaagccgtctggatattggaaaagtccaggtagaatttgaatgcagctacgagccaaccggcccatttggcgcaaaatccatcggtgagatcgttatcaacaccccatctccggctattgcaaatgcagtgtataatgcagtaggcgtaaggatcagggaactgcctattacagatgagaagatctttattgggatcatgggtggccgatga

SEQ ID NO: 1176 - DNA, 2511 bp, Unknown
  Artificiall/Consensus sequence
atggaaaaaagagcgtttggtctgagaaaatggaaggtgctcctgtcagtgtttcatgtgatatttcttgttatcacactggcagggatcagcgccatgtacttaaacggcggatatggaaatgggatccgctggatctatgatgaaacatatgaagactcagatgccttctgttcccagcttggcatagatatcagcaatatttttacctatatcggatataaggatatgtttgagaccaatggtgtcctggatatgcacaaacccattgtgcgtattatagacggtcccggtgtagatgaggatatgacactggatcagatcgtccgctatgccaagatccggggatattatctgggagaagattttacagtacagggatctcctatggccatggatgatgatgacatggagataacggtagagtataaatccgcaaaaacggacctggcagatgttgatggcctggagaccaggatgaccaaagaggaaatggcactggacatcctggaccggttgggaaaatattataccatttattataatttcatcagcaataacacaaatgtccgtttccgtatcctctataaaagcaatgatggaagagaagtggtttataccaatgttccttctatgtctttagatgagctgcggggatttggaaaatatctgttcattcccggaaataccattcgtatggaaagcaatcttgcaacgatcccggacaatgcggcttctcttctggaaacatggaatccctttgacaatgaccagaactatatggtggtctctgtggataccacctatccttattctgataattatgcagaggaagccggggaatataaaagtgccagatccacgtttatcatgggaatgggcggtgtgatcgtaggaattgcaggattttttgctacactggtaacattggtccttttatccggccatgaagatggagcagatggcaagatccgtcttttccccatcgacaggatctatacagaaacctgtgtccttttgtgggcggtggtgacagctgtgatcttgtacttctgtaaaagactggggatgatggtgatcggcttatttgcctccgaagaacacctggcatactggagtaaactgctgaaatatgtgatcatctacgggtgcagtattctatgtggtttcagtcttttaagaagatacaaggcagataccctgtggaaaaagagtattgcgaaaaaggtagtaaaggcttctaaggattatattgcaaaagccagttttgtagccgggaccggactttgctatcttctgtttttaggagccaatggcgtaatgctgtggggcattttattcctgtttgcctatatagatgagaaactgactttccgtattctcttttatgtatgcgctgttttgtttgttggtctggatggatgggtattccataagctgttcaggaaagcggagcagaaggatcttttaaataatgcgatcacctgtattgcaaaaggcgataccggtttccgcctggatacgaaaaagctgacaggaaaagagcggacagtgggagaccacattaataacattggaagcggcctggacacggctcttcaggagaaggtaaagagcgaacgcctgaaagcggatctgatcaccaatgtgtcccatgatattaaaacgcctcttacgtccattatcaactatgtggatctgttaaaacgccagaagatacaggatcctaagatcgcttcctatctggaagttttggaccagaaatcccagcgtttaaaaacactgacggaagatctggtggaagcttccaaggcaagttccggaaacctgaagctggagatggcagatattgacctggtagagctggtgcagcagaccaatggtgaatttgaagagcgttttgaacagcgccatttaaagatcatctctgatttcccagatggtatgatcattattagagcagatgggcgcagattatggcgtgttctggaaaatctttataccaatgcttttaaatatgcccaggaaggcagccgggtatatgtggatgtggcttctgtagatggaaaagccattttcactatgaaaaatatttcggaaaagccgttaaatatcagcccggatgaactgacagaacgttttgtcagaggagatgtggcgcggacaacagaaggcagcggattaggactttccattgcccggagcctgacccagctgcagaaaggtgagtttgtgatcaccattgacggcgatctgttcaaggctcaggttattttcccgcaagtgcgccaggagaccagggcggaaatgcgtctggaacgggctgcggaagagaagcaggcagaagaacagtccggggagaaaatgtccggggaaatgcctgtgggagagaacctgctggaaagtgccccctataactgggatgtaatggtagaaaatgacaagaatttaacagcaaaagaggaaatcctgatccagaatggaaaacgggagcataaaccggaaacgtaa

SEQ ID NO: 1177 - DNA, 1785 bp, Unknown
  Artificiall/Consensus sequence
ggaggcaatgtaataatgaaaaaagattcacaaaatcaaaattcacaaaaaacctccagccagacagttaaaaaagtaataataaggataaaaaaatactgggtatttttgatattatcaattattatggcgacaataacagtagcatcgtcactgtatgtgcctatacttgtcggtaatgcaattgattatattattggaccatctaatgttaatttcaggctgattgcacagattcttgctgaaattggcgttgttataggaataacagcactttcacagtggattatgaatatatgtaataataagattacatatcatgtaacaagagatataagagatgaagctatagaaaagatagaacatctgccattaaaatatatagatggacattcatacggtgagattgtcagtcgtgttattgccgatgtagaccagttcgctgacggcttattaatgggatttacacagtttttctcaggtgttatgacaatacttggaacactcggatttatgttatcaataaatgttaaaattacacttgttgtagttcttattacaccggtttcattttttgttgccagttttattgcaaagagaacatataaaatgttcaagcttcagtcagagactcgtggagagcagacagctctcattgatgaaatgattggaggtcagaaagttgtaagtgcttattgtcatgaagaagaggcagtaagacagtttgatgaaatcaatgacagacttcagaaatattcgcttaacgcgatatttttctcatcaataacaaatccttcaacaagatttgtaaacagccttgtatatgccggagttgcagttacaggtgctatatcagctatatatggaagacttactgtaggacagctttcatgttttttaagttatgcgaaccagtatacaaaacctttcaatgaaatttcaggtgttgtaacggaacttcagaatgctatagcatgtgcttcgagagtatttgaacttatagaggaagagccggaagctgcagagatcagtaatgcggttaatcttgaaaatgttgacggacgagttgatttaaatgatgtagaattttcatatgtccctgataaaaagcttattgaagattttaatcttcatgtaaaaaaaggtcagaaaattgccattgtaggacctacaggatgtggtaaaacaacaattatcaacctccttatgagattttatgatgtaaacagcggctcaatagatgtgtcgagtgttgatataagggagcttacaagacgttcactcagggcgggctatggaatggttctgcaggatacgtggcttaaaagtggtacaatccgtgaaaatattataatgggtaagcctgatgcaacagaggaagaaataatcgaagcggcaaaggcagctcattcacacggattcataaaacgacttccaaatggttatgatacagtaataggtgaagatggcggcagcctttcacagggacagaaacagcttttgtgtataacaagagttatgctttgtcatccacctatgcttattcttgatgaggcgacatcgtctattgatacgagaactgaaatcaagatacagaatgcatttaataagcttatggaaggaagaacaagttttattgttgcacacagactttctacaatccagtcagcagacgtgattctggtaatgaaagacggtcatattattgaacagggtaatcacgaagaattacttgctaagaatggattttataagaaactttatgaaagccagtttgcacaatag

SEQ ID NO: 1178 - DNA, 1488 bp, Unknown
  Artificiall/Consensus sequence
atgcaggattttattaaaattaataaagatgataatgttgctgtagcattaaagcctattgcaaaaggcactactcttaatgttgcaggaattgatgtgacaactgtagaagatattccacagggacacaaatttgtaattaaagctatcaagaagggtgaaccggttgttaaatatggtttcagaattggatttgcacaggctgacattcctgttggagcatgggttcatactcataatttaaagacaggtcttggtgaattacttgattatacttatgagcctgaaggacataaagatgtagagccaacagaaccagcttattttgaaggatatatgagagagaatggcaaagttggtgttcgcaatgaagtatggattgttcctacagtaggctgcgttaattcaatcgcaagagcaattgaagcaacagcaagagcaaataagcctgaaggcgtagatgaagtagttgcatttacacatccttatggctgttctcagacaacagaagaccaggagaatacaagaaagattcttgctgaccttatcaatcacccaaatgcaggtgcagtgcttgtactcggtctcggatgtgaaaacagccgtatagaagttctcaaggattatataggtgaagtaaatccggacagagttaagtttttacaggttcaggatgttgaaaatgagcaggaagaagcagagaagcttatgaatgagcttatggcttatgctgccaacttcaaacgtgaaaaagttaatgcaaaagaacttattattggtatgaagtgcggtggttctgatggattgtcaggtatcacagctaatcctacagtaggtcttttctctgatatgcttgtatctaagggtggtacaactattctcacagaagtacctgaaatgtttggtgcagagacaattcttatgaacagatgtgccaacaaggaactttttgagaagacagttcaccttatcaatgatttcaaggaatactttattaaaaatggacaggagatttatgaaaatccatctccaggaaataaggatggcggtatcacaactcttgaagataaatcacttggatgtactcagaagtcaggttcatctcttgtaaagggtgttcttgcatatgcagaacctgttaatactaaggggcttaatcttctcagtgcaccgggaaatgatcttgttgcagctacagcctgtgcagcatcaggtgcacagatggttcttttcacaactggtagaggaacaccatttgcatcaccggttcctactgttaagattgcaacaaattcaagacttgcaggaaataaatctaattggattgattttaatgcaggtagaattgttacagatgaccttccacttgaagatgctgcaaaagaacttttccagcttgtgcttgatgttgcttcaggaaagaaagttaaagctgaaattgcaggtttccatgatttagcaatctttaagcagggtgtaacattataa

SEQ ID NO: 1179 - DNA, 1938 bp, Unknown
  Artificiall/Consensus sequence
atggagattgttatgtcggttcaggattatatgtcagctttaaagctggggaaaaaagagtatcatgcatgtgtcaataagggagcatatccatatcttccggttcttgagaatcttgtttcagatgatgagattgattctgaagtaagcctttcggttgaccagattccgttaaggcttgttgtcggaacatgtaatgcttcaagaactaatgcatttgcgggcaatttcatgccgcttcttgactggggaacggaattttctgcaaaatgggcgagtcttagtgacagccaggttaatgaaggaataagagacccgattaaagtatatgaatatatgaacaagttttatgtacttgaaggaaataaacgtgtaagtgtattaaagtattttaatgcagttacagtcaatgcagaagtaatacgaaagattcccaaaaagtcagataatccggaagttaagatttattatgaatttatggaattttacaaatgcacaaggctcaatgatatatatttcagcgaagtgggaagttttccgtcacttatgaagcttgtgggaattgagccggataaaaagatggatgaggatgccaaaaaagattttgtgtcatgctttttatcatttaagaatgcttttgattcaagaggcggcgacagatttgattatccggtaggagacgcattcctgagatttattcacattttcggatatgatacagttaaaaagatgacaccgtcagatatggcaaagaatgttgcaaaatcatgggctgaattcgtattgttgtcagaagacagtgcagttgatttaaagatgaatcctactgtaaatgagcctaagaaaaacattttgagttatctccttcctaggccagacagcggaagcaagaaactgaaagttggatttatatatgaaaatacaccacaggattcggaatggtgttatgcacatgaacttggaagacagtatatagatgatacatttggtaagcagatagagacgataagcattactaatgtcaagccggaaaaagatgatgagcatgctattgagatgatgataaaaaatggtgcagaccttatatttgtcacatctccggcaatgactatagcaagtgtaaagatggcgattgcacatccggatgtaaagattcttaactgttcgctcaatacatcgcataagtatataaggacatattatgcgagaatgtatgaagcaaagtttcttacaggggttcttgcaggagcactggcaacacagaataagattggatatgttgcacagtatcctgtttatggtacagttgctaatattaatgcatttgcacttggagcgaagtttgttaatccaagagcgaagatttatctgaaatggtcgtctgtaaaaggtatcaatattgaagaagaattcaagaaagaagatattcactatatttctgaccaggatatgataactccacagtgtggttcaagacgttttggattatataataatgaaggcgtcggcaacagacagcatatagcaatgcctgtatggcactggggtgtattttatgaaaagcttatacagagcatactcagcggctcatggaagaaagatgaggattctgacagcggcagggctcttaattactggtggggcatgtcatcgggagttgtcgatttaatctgttctaataaagttccggtagagacaagaagactggttgaactatttagaaaagttatctgtaacaatgaatttgaaccattttctgatgagttatatgaccagaaccgacatcttcagaataaaaagggacatgagatgagcccggaggatattatcacaatggattggcttcttgataatgtagttggtgatattcctgcaattgatgagcttgatgaaagtgcaagagcaataatggtaagtcaaggaattacgagagaataa

SEQ ID NO: 1180 - DNA, 1455 bp, Unknown
  Artificiall/Consensus sequence
atgacatttttgcaggagtatagggcgatgaatagaagaagagttcttaaaattcttggtaaaattcttatgacagaggcgatgcttatggtaccgtctctgatagtttcactgatatatggcgatggtgacactatgtattttattggtacaattgcatttgcggcaatagcaggatttatcctttcatgtgtaaaagcaccggaacgtaagatgggtagccgggatggatactgtatagttgcacttgcatggataattatatgcataataggtgctgttccgttgtttcttacaggacagttcaggtcttactggtctgcactttttgagatagtttcgggttttacgactacaggtgcatctgttctttcaaatcctgaatatctgccacatggtgtacttttctggagaagttttacgcactgggttggcggaatgggcgttcttgtatttgtacttatgataatgcctatggaaaatgaaaattcaatgcatcttataagagcggaggttccgggacctgtagccggaaaacttgttcctagaatgaaaaaaacatcaataattttatatggaatatatactgctatgacagcaatacttgttgttttattgttatttggcggcatgaatgtgtttgatgcttttgcaacagcatttggtactgcgggaacaggtggatttgctacatcatctgcaggcatagcaggttatgacagtgcatatatagagattgtactcgggattttcatgcttttatttggtgttaattttaatgcatattatcttatacttataaagagatttacagatgcgttaaagattgaagagattcaatggtattttgggattgtaggagtttcagttattgcaatagcaatcaatatatgccatagcctgtcggcagtttccgtgtctttgagacaggcgtttttccaggtgtcaagtattataacaacgacgggatttgcaacggttgactttgataaatggccggagttttcaaggcatcttcttgttctactgatgataatcggtgcatgctcgggttcaacgggcggtggaatcaaagtatcgcgtgttattgttatggtaaagagcttttttaatgaaataagacatattatcaatccgagctctgttacagcagtgaggacaaatggcaagcctatggataaagagacacttatagcggtgagagtttatgtagcatcgtattttattttgatttgtctgtttacactggtcatatcacttaacggacttgactttacaacaaatctgacagcagttttatcgtgttttaataatataggaccgggacttaatcttgttggcccaatgtcaaatttctcatgttatgccgactgggcacaggttatactttcagttgccatgctcacgggacgacttgagatatttccgatgttcatgctgttttcaaaatcggtt

SEQ ID NO: 1181 - DNA, 1287 bp, Unknown
  Artificiall/Consensus sequence
atgaacagacagagtgatgtgattgaaaattgggaatatgggcttcttacattgcttaataatgccctaaatctgcctgtatctgaaaaaaatgatgctattgaagtaaaaagcattattgaagatgtaagtagaaaactcgattcagattctatacagaaatttaatgaatatagtgaagatgaatggaataagattatcaagacggcagacggccacggggttctgccgttaatagcagatgagttatattttatggattgcgtgcctgataatattaagattaaggcggttgcaaaagcaaaaaaaattgttatccagaacagccgtctttcatacctgactaatgagtatatgagcattttaaatgatgccggaattacggcagtgcttttaaaaggtgccggaacggctgcatattatccggtaaagagtcttagaaaatcaggtgatattgatatactcattcctgataagctgcagtttgataaagctgtaagtgtgcttgaactgcatggcgtggttataatgggggaacagcatgcatggcatcatgttgaaatgcataatgagaccggcgtaataatagaacttcacagggcactggcagaacagttcgatgatgacgatgtgaataaaaagattgagcagtatactgaagaaatgtcagttcataatattttaaaaaatattgatggaatgaatatagtatgtcctgagatggcatgggaagcattaagtcttgctattcatatgctgcaccattttgtgagagcagggttcggactcaaacttttgtgtgactgggttgtattctggaatagcgaacatgatgaaagtcagaaaaatacattttattcaatgataagcagcattggaataacaggttttgttaaagctgtgaatataatctgtataaagtatcttggaatgaaaaaagaaaatgttttttttatgatacaggatgaaaaaacagaagttaataccgatatattccttaaagatattatcgaggcacaggaatttggcagtaccaaagatgaaagaatggttgtgcttcgtggcagcaggtttgcagactatgtaagagagttccatcatcagatgaaacttaacaatcccgataagaaagataataagctgttgtggccttatctctgggttaaaacatttgcagtttttgtaagaaataacaggactgtaaggaaaacaacaatatgtagtgtactaaaaagtgcaggtgcaagaagcagggttgcatatgatatgaaactgtttaaaaaatag

SEQ ID NO: 1182 - DNA, 1920 bp, Unknown
  Artificiall/Consensus sequence
atgggagaattcggaacgcatatgaataacgaagaacttagacgtaataaatacagaagaaaaaaggcaatgcttaggaaagtacaaaacaaaatgggcgttgccttttttgttataattcttgcactctttgcattggcagtgagaatacttctcatcaattataatcacggagaagcttattctaagacggtacttgaccatcagagttatacatctacaacaataccttacaagagaggtcagattcaggatgctaatggaacagttcttgcgtatagtgagagagtatacaacctgatacttgacccgaaacttatattgtctgatgaaaagtataaagaaccgacacttacggcattgacagaatgttttgatttaaaaagaagtgatcttgagtcaattcttgcaactaaaagcacaagccagtatgagaagctgttaaaagagctgacaaaagatgaaatctcagaatttgagagccgtgtggaagatacaaaaaataatccatatataaaaggtgtgtggtttgaagacagctatataagaaaatatccattttctacactggcggccgatgtaattggatttgcaagtgctgcaaatggcggtgagcttgggcttgaaaattattatgatgaggaactgtccggaaccgatggtatttcatacagttatgtaggtgaaaatcttgatgttgagacacaggagaaaaaagctgaagatggctataatcttgtgacaacaatagattataaagtacagagcataattgaaaataaaataaaagaattaaatgtcgaaagaccatcaaagtcaacggctgtaattgcaatgaatccaaagacgggggagattcttgcaatggcaagttatccgacatttaatcttaacaatccgagagacctgagtggtgtgtacacacaggaagaattgagcacaatgactgatatagagatgactaatgccatgtatgcattgtggagtaattattgtgtttctactatatatgagccgggttcaactttcaagccatttacggtagcagagggacttgaggaaggtgttatacatgatggcgatacattttactgcggcggtttcatggaagtcagcggaagcataatcaactgccatgaacacagcggacatggtactgttacagtaaaagaaggtcttatccagtcatgtaatccgactatgatgcagattgcagcaaagcttggtggtgtgaaaattgcgaaatatgaggcactttttggatttggtaacaggacaggcattgatttgccgggcgaggaagccggtcttacaatcggtgagaagatgaaagtcattgatgcagcatgtaactcttttggacagaatatcaatgtaaatatggttcagatggcagcggcattttcatcacttgtaaatggtggtaattattatcagcctcatatagtaaaaagaattgaaaagagtacaggagaagtcgtaaaaacgatagaacctaatcttgtaagacagactgtaacatcagagacatcacagctgctacgcacatatttaagagccggcgtagatgaaggacttgccagaaagtcaggtgttgcaggatatgctatcggtggtaaaacgggaacggcacagaaacagccgcgagaagataagaagtgggttgtatcttatataggatgtgcacctactgatgacccacagcttgtgttgtatacagtaattgatgaaccatttgagacaaacggaacatcaggaagttctcttgatgcacttaatctttcaagaagtatctacgaggaggctcttccatatcttaatatttataaagatattaaggcagaaccggttgatacaaccaatagtgcagttgaatcaactgtagaacttccggatacaacaaatacaaataataattaa

SEQ ID NO: 1183 - DNA, 2229 bp, Unknown
  Artificiall/Consensus sequence
atgctctttaaggatagcttgaagggcatccttttttatgcagacgacaaggtaatcacggcaaaaacagggaggattgttatgggacataaatcaaaaagaacatatgataaagtgtttgaagacagaaaaaatatgctggaggatcttattttgcataacgacctctatgtaccaatgaaaactaaggagcttgcaatacttatgcaggttccgaaagaggacagacatgagctgcaggcagtgcttgattcacttgtagcagagggcagaataggcgtatcaaaaaaaggcaaatacagtaagcctgaaaatacagctattattggaatataccagaagacaagccgtggttttggttttgttgttgtcgaaggcagggaagatgatatttttatcaaagaatctgacgatggcggagcatttcatatggataaagttatggttgccataacagcagaaaaacatggagataagagatgtgaaggcaagattctcaagattcttgagcatcagataaaagaggtggttggaacataccagaagagtaaaacatttggatttgttgttccggacaataaaaaaatctgttatgacatttttgtgccacaggaaaagtccatgggggccgtgacaggacataaagttgttgtagagcttacttcttatggtacattgaaaaagaacccggaaggtcgcgtaaaggagattatagggcatattaatgacccgggaacggatattatgtctataataaaagcatatgaccttccgatggaatttcctgaaagtgtaatgaaatcattaaatgatattcctgatgaactgtcgcctaaagattatgccggaagagttgatttgcgtgatttgcagacagttactatagatggtgaagatgcaaaagacttggatgatgcaataactgtatctgaggaaaatggaatctatcaccttggagttcacatcgcagatgtgagcaattatgtaaaagaatacagtcctcttgacaaagaagcatataagagaggcacaagtgtctatcttgtagaccgtgttataccgatgcttccgcataagctgtccaacggaatatgttcacttaaccagggctgtgacaggcttgcactcagctgtcttatggatattgatgaaaaaggcaatgtgatttcacataagatatgtgagtctgtaatcaatgttgacagaagaatgacttatacaaatgtaaaaaagattcttgaaaatgaagatgaagaaattttaaacgagtataaagattttgctgatatgttcagacttatggaaaagcttgcactgatactgcgtcagagaagattcaaacgcggttcgattgattttgattttccggagacaaagattacgcttaacgataagggtgaaccggtggaaataaagccgtatgacagaaatacagcgacaagaattatcgaagatttcatgcttattgcaaatgagacagtggcagaagattatttctggcaggaaataccattcctttaccgaagtcatgaaaatcctgatcctgagaagataagaaggcttggaacatttatcaataattttggatattcgataaaaataggtgatgagattcatccgaaggagcttcagaagcttttggggaaaatagagggaagcgacgaggagaatttaattgcacgccttacacttcgttctatgaaaagagcatcatatacaacggagtgcgtaggtcatttcggacttgctgccaagtattactgtcatttcacatcgccaatcagaagatatcctgatttacagattcacagaattattaaagaaaatctgcatggtggtatgagtgataagagaagtgagcattttgctgctattcttcctgaagtcgcaaagcagacaagtgctacagaacgcagggctgatgatgcagaaagagatacagataagctgaaaatggtacagtatatggaaaaacatatcggagagacatttgagggtgttgtatccggaatgaccgcatggggaatatatgtagaacttccgaatacaattgaaggaatgattagtgtagcctcgcttcgtgacggatattatatttatgacgagaatcattatgagatggtaaatgagacaacaggaaggacattcaagctgggtcagagacttaatgttaaggttatcaactgtgataagattcttagaactatagattttgaactggcagaataa

SEQ ID NO: 1184 - DNA, 2130 bp, Unknown
  Artificiall/Consensus sequence
tacgttgttatttacaataaaatttataaatggtataataatttaaaatgtttttgtttgatggagattattatgaagagcaagggcagaaatcagatttataaattgtcgggaaaactgaagtcatatattatgtggccgctatatgtaggcataatacttttaattgtcactgttgttatgtatgtcaaagatacatcctgtggtaatattatgctgggttttgtcatgctttatgcagttgtttacgggattatgattttttatctcagacccggaattatgcatgagatgatagaattctcttctaattattcacaggtacagcatcagcttttatacgaacttagtgttccgtattgcctgcttgacaataacggacgtgttctgtggatgaacagaattatgatggaaaaaactgataaaaagaaagatttccgaaaaaatatacaaagcatttttccacagattaagccggaagtatttccgacaggagaagatgcgaaagagatgcgtcttgcatataatggcagggattatcttgtagagatgaagcggattgctgttgatgcacttacgcagcaggttgatataattgagacagaacagaataattcgtttattgcgatgtatatgtttgatgagacagatattaacatgtatatccagaaaataaaggatgagcgttttgttgttggacttatttatattgataattatgaggaagcacttgaaagtatagatgatgtcagacgttcattatttataggtcttatagataagagagttaataagtattttgcgtgtggttctgcgatagtaagaaagatggaaaaagacaaatatcttgctattttcagatataagtatttagagaaacttatgtcagacagattcagtttactcgaagatatcaagagcgtaaaaatcggcaatgaaatgacacttacattaagtatcggtgttggcacaggtgcaagtgattatgcaaaaaattatgatgttgcgaaatcagccatggatcttgcacttggacgaggcggagaccaggctgttgttaaagatggcgagaagacactttactatggcggtaagagccagcagatggaaaaaaatacaagagtaaaggtgcgtgtaaaagcacatgcattaagacagattcttgaaccgacgcagacggtccttataatgggacataaacttgcagatatagatgcatttggttcggcaattggtatatatgtaatatgcagacgacttggcaagaaagcacacattgtaattaatgatgtgacaagcagtgttaagccatttatggacagattcattaacaatgatgattatccgagagatatgttccttttgaaagaagaagcaccggaatatgtagattcacagactgcagttattgttgttgatgttaacaaggctaagatgacagagtgtccggctcttcttgatatatgcaggacgataatcgtatttgaccatcacaggcagtcaagcgagcctattacaggggcagtcttgtcatatgttgacccatatgcttcatcagcggctgagatgattactgagatgattcagtatgttgaagatggtgtgaaaataaaggcatttgaagccgatgcactgtatgccggaatcaatatagacacgaatggatttaataataagtcaggtccgagaacatttgaggcagcagcatttcttagaagacatggtgctgatgtcacaagagtaagaaagatgcttcgtactgatatggcagaatacagggcagttgcacaggcggtaagcaaggcaacagtatacagggatgcatttgccataacagtatttgacggtgaaggagttgaaagtccgacgataggcggtgccaaagctgcaaaccagctgcttgacatatcaggaataaaagcatcatttgtaataacagcctacaataatattatatatataagtgcacgttctattgatgaggtaaatgtacagcttgtcatggaaaaattaggcggaggcggacatatgacaatcgccggtgcacagcttacggattgtactgttgaccaggcagtccagacaataaaagttacattggattcgatgatacaggaaggagaaatataa

SEQ ID NO: 1185 - DNA, 2115 bp, Unknown
  Artificiall/Consensus sequence
aacatggatgtaagccagtatttagagatatttattgatgaatcaaatgaacatttacagagccttagtgatcagttaatgattcttgaaaaagaacctgaaaacagtgatacaattaatgaaattttccgtgccgcacactctcttaaaggtatggcaggaactatgggctataagagaatgcagaatctcacacatgatatggaaaatgtattctcagaagtaagaaatggtaatatgaaggtcacatcagaccttgttgatgtattatttcagtgccttgatgctcttgaagaatatgttaataatattcaggagacacaggatgaaggaactaatgataatgagcctataattaaggcactcaatgcatttattgcatcagaaaataaagatgctgcaccagctgaagaaaaacaggaacaacaggcagaatctgcaccggcagagaaacttcaggcagatgaacatggtatcagcatggaacttgctgattttgaaaagaatgcggtaaatgaagcacttaaaaaaggaatgcatgtttacgagattaaagtaacagttgacgaaaattgtatacttaaagctgcaagagcttttcttgtatttaagaatcttgaaggacatggagacattataaaatcagatccttcagtacaggatatcgaagatgaaaagttcgattttgattttcagattgttattttaacagaggaaagttttgatgatatcatcaagataattaagaatgtatctgaaatcaaagatgctgatggtgaagaaataacgaaggcttttccggaagaaaagaccgaagaggagccaaaagaagaaaagacagaagaaaaagctaagcaggcttcaaaagcacagtcatcaaatgataagaaagatgctaatggttcaaagaagccggcaggtgcaaaacagcaggctgccaatagtaaagcaaagcctgtcggacatactgtacgagttgatattgaaaaacttgatgtgcttatgaatcttgtcagcgagcttattattgcgaagaatggtcttgtttcagcaagcagtgaagaaggctcagagagcattaaccagagctttaatgaacagattgaatatcttgagagagtaacaacaaacttacatgaatcagtaatgaaggtacgtatgatgcctatcgagagcgtagtaagtaagttccctcgaatgataagagatttgagcaagaagcttgataaaaagatggaattatacatgtcaggtgaagatacagaacttgacagaacagttattgatgaaatcggtgatcctcttatgcacctgttaaggaattcagctgaccatggactagaaagtgccgaagtcagaaaagaaagaggaaagagcgaagttggttctattttccttgatgcatatcaggatggtaacaatgttgttattgaagtccgtgatgatggtaatggtattgatattgaaaaagtaaagagtaaagctatagaaaaaggaaatattacagaagaacaggctgcaataatgtctgataaagaagtaatagatctgcttttcaaaccaagtttctcaacttccgataaggttactgatgtatcaggccgaggcgtaggacttgatgttgttaaatcaaagattgaagcacttggcggtgatgttgaagttaagtctgtatatggtgaaggaagtacatttattataagacttccattgacacttgcaattatccaggcacttatggttaagctcggagatgaaaaatatgctatttctcttggctcaattcagacaattgaagatattcctgtaagtgagataaaatatgtacatgcaaaagaagtaatacatcttcgtggaaatgttattccgctcattcgtctcagagagcttcttgatgtaccgggagaacaggaagaacaggaaaatattactgttgtcatcgtcagcaagggagataagcaggctgggcttgttgtagatagtctcattggacagatggaaattgtaattaaatctttaggcaagtatatcaacattaataagatgataagcggtgcaactatcttaggtgatggttcagttgctttgattattgatgcaaatactcttgtctga

SEQ ID NO: 1186 - DNA, 2655 bp, Unknown
  Artificiall/Consensus sequence
atggctgaatattcaccaatgatgcagcattatcttgcgacaaaaaaacaatataatgactgtatattattttacagacttggcgatttctatgaaatgttctttgatgatgcaataactgtatccaaagaacttgaacttacacttacaggaaaagactgcggacaggaggaacgtgcacctatgtgtggcgttcctttccatgctgccgagacatatatcaaccgccttgtatctaacggacacaaagttgcaatatgtgaacagatggaagacccgaagcttgcaaaaggcattgtaaaacgtgaagtaataaaaattgtaactccgggaaccaatcttaatgcacaggctttggatgaaacaaaaaacaattatcttttctgtatatattatcaaggagatgttataggtgtttcgatatgtgatttctcaacaggtgattattttgttacagaattaaaatcggaaaatgagcttattgatgagataaataaatttgttccgtccgaaataattgtaaatgaatactttgccatgagtggtattgatttaacagctgtaaatgaaaaactgaatatttcaatgtcaacacttgaaaactggtatttcgatgaggacagttcaatcaaaaagctgttatctcattttaaaatatcagcacttgacggtcttggtgtaaaagattatccgacaggtatcattgctgcaggtgctcttcttacatatctttatgagacacaaaaaagcgatatgtcacatattatcacgctcactccttatacaacaggaaaatatatgcttattgacagttcatcgcgtagaaatcttgaacttgtagagacactccgtgaaaaacagaaacgaggctcattaatctgggttcttgataagacaaagactgctatgggtgcaagagcactccggtctatgattgagcagcctcttattaataaagatgaaataataaacagacagaatgttgttgaagaactttgcaataaccagattgacagggaagaattacgtgaatatatgaatcctatttacgatctggagcgtcttatgacaaagataagctgcaagtcggcaaatccaagagatttgattgcattccgtaattcacttgaaatgcttccgtatataaaacaaattatcggtaatttcaaatcggatttatttaaaaaatattatgaagatatggatgatttaagggatatctataatcttattctttcagctattgttgaagaacctcctatatcaatgcgtgaaggcggaatgattaaagatggattttcagcggaagctgatgaattgcgaagagcaaagacagaaggaaaagaatggcttgcacagcttgaagaacgtgagcgtaacaatacaggaatcaagaatctgaaagttaaatataacaaagtgttcggttattatcttgaagtaacaaattcattcaaatcaatggttccggacagctgggttagaaaacagacacttactaattccgagcgttatacaacagacgagttaaaacatcttgaagatgttattcttggtgccgaagacaagcttaatagtcttgaatatgatttattcagccaggtgagagaacacattgcaacgcaggttgtaagaatccagtcaactgcaaaagcaattgcaatgatagatgtatttgcctcactttcagttgttgcaatgcagaataattatgtcaagccaaaaattaatgaaaaaggtgttattgacataaaaggcggcagacatcctgttgttgaaaaaatgatgaataatgatatgtttatcgccaatgatacttatcttgataatgcatcagaccgagtttcaattataacaggtcccaatatggctggtaaatcaacatatatgagacagactgcacttattgtccttcttgcacagaccggttcatttgttccggctgacagtgccaatatatgtattgtagacagaatatttacaagagtaggtgcatctgatgatcttgcttcgggacagtcaacatttatggttgagatgacggaagttgccaatattctaagaaatgcaacacctaagagtcttcttattcttgatgaaataggaagaggtacaagtacatttgacggtttaagcatagcatgggctgtggttgagcatatcgcaaatacgaagcttttaggtgcaaaaacactttttgccacacattaccatgaacttaccgaacttgaaggaacgcttgatggtgtaaataattactgtatagctgtaaaagaaaaaggcgatgatatagtatttttacgtaaaatcataaaaggcggtgctgataagagttacggaattcaggttgcaaagcttgccggagtgcctgatgttgtaattgagcgtgcaaaagagcttgttacggaattaagcgatgctgatatttcacagaaagcaaaagatattgcacaatattccaaaaagcttgataagctgaataaagaataccggaaagtagatgaacttgaagtaaagcagatgtcactttttgatacggtaagtgataatgacatagttgcagatattaaaaatcttgatataggacacatgacacctattgatgcacttaacacattatacaagcttcaggaaaaaataaataaccgctggtaa

SEQ ID NO: 1187 - DNA, 2136 bp, Unknown
  Artificiall/Consensus sequence
gagactatgggcagaatatttaaaaatcttgtaccatactggaagtctgtaattatgatactggtacttcttgtactgcaggcgttttgtgatttgtcacttccacagtacacatcggatattattgatgtaggaatccagaataaaggtgtcggacatgttatgcctgaggccgtaacagaggatgaatataatctggcacagctttttatgacagacagtgaaaagacaatctggcaggaaagttatgacaatgataatggtatttacagatgcaatgtaaagagcgaaaagaaactgtcatcttatgatgatgaacttgttttaccgcttataattaataatcagatggcagatgaagaaaaacagaagcttcttgctatgtcacaggcaggaatgttaagcgatgaaatggtttcacagatcagggaaaaagctgaagaaacagttgatacgatgggttctacacttgtaaagtcaatgggaatcgcatatgcagtaaagcaggatactaatgctggaattgatatggatgcattgcagacaaagtatctgttgggttcaggagccaagatgatagcgatggcacttcttgttgcacttactacagttcttgttggacttgtagcttcaagagtagcagccggaatcggacgtgatttgcgtggcagtgtatacaagaatgtaatgaatttttcaaatgcagagatggataaattctcgacagcatctcttataacgcgaacaactaatgatatacagcaggtacagcttgtgactgttcttatgcttcgtatggttttatatgcacctatactcggtgtaggcggtatttttaaggtgatgcagacaggtgcaggcatggaatggattatagcacttgcggtgcttataataatcggaattgtaatggtacttatggtagttgcaatgcctaaattcaaacttatgcagaaacttgttgataatgtcaatctcgtatcaagagaaattcttacaggtctttccgtaatacgtgcattcggacgtgaaaagaaagaagaggagcgttttgatgatgccaataaggcactcactaagacaatgctttttacaaaccgtgtaatgacatttatgatgcctcttatgacatttatcatgtacggaattaatgtacttatcatatgggtagctgcacataagattgacagcggaagcatgcaggtgggtgccatgacagcatttatcacatatgcaatgcagattgtaatgtctttcctgatgcttacaatgatgtcaattatgcttccgagagcagcagtttcagctaacagaatagatgaagttttaaatgaaaaatcatctataagagaccctgaaaatcctgaaagacttgaagaacacaaaggtgttgtaagctttaaccatgtgtcattcagatatcctaacgctgatgcagatgttctttcagatattgattttgtagcaaaaccgggagagacaacagctattgttggaagtacaggatgtggcaagtcaacacttatcaatcttataccgcgtttgtatgatgcaacacagggaagtgtcctggttgatggacatgatgttaagaatataacaatggaagatttaagaagcgaaataggttatgtgcctcagaagggtgtacttttctcaggtactatagcatcaaatttaagatatggtaaagatgatgcaactgatgcacagattgaggaggcagcttcaatagctcaagcaacagaatttatagacagcaagagtgcaaaatatgacagtcctattgcacagggcggtactaacgtgtcaggtggtcagaagcagagactctctattgcgagagccattgcaaaggatcctaagatatatatctttgatgacagtttttctgcacttgatttaaagacagatgcagcattaagaaaagccttatcatcaaaagttaaggacagcactgttattatagttgcacagcgaatcagcacaatacttcatgctgaccagattcttgtaatggatgaaggcagaattgtaggtaaaggtacacatggagaacttatgaattcatgtgatgtatatcagcagatagcacgttcacagatgtcagcaaaagagcttggagaggaggcataa

SEQ ID NO: 1188 - DNA, 1572 bp, Unknown
  Artificiall/Consensus sequence
ttatatattaaatataattataggagaaaaacaatggtaaagagtgtattggaatatctcgagaattcagcagcaagatttcctgataaaaaggcagtcgctgatgacaaaagcagcatgacatattcagaacttgtaaataatgcacggaatattgcggcagggcttcttccttacacagaaagaagacaggcagttcctgtatacatggacaagagctgtcatacacttgctctttttatgggagctgtaatggcaggatgtttttatgtctgccttgatccaagccagccggcagaaagaatcaatatgattcttgagacgcttgaggcaaaacttatggtcgttgatgaaaaatcagcaaagaagcaggcgaagcttggttttgatggccctgttcttaatattgacgagcttatgacacatgaagtgacagaagaagagaacgaaaaacttgcacagataagaagtgaagctctagatattgacccgttgtattcaatatttacatcaggctcaacaggtgttcctaagggtgttatagtaaatcaccgttcagtcatagactttatagattgctttacagatacatttaacatcagtgaaaatgatataattggcaatcaggcaccatttgattttgacgtatcagtaaaagatatttattcaacattaaaatgcggtgcaacaatccagattatacctaaacaattattttcatttcctacaaaacttcttgattatcttgatgacaataatgttacaacacttgtatgggctgtttcggcattgtgtatagttacaactttaaatggctttgagtacaaggttccgtcaaagattaataaagtaattttctcaggtgaagttatgccgataaaacatcttaatctctggagaaaagcatatccggatgcgatgtttgttaatgtatacggacctacagaaatcacatgtaactgcacatattatatagttgacagggagtacgaacttgacgagacacttcctatgggtaaagcatttcctaatgagagagtattcctgcttgatgatgacgataatattatcactgaatcacagccgggtacaacaggtgaaatttgtgtttcaggaacagcagtgacaatgggttactataacaatccggaaaagacagatgcagcatttgttcagaatcctcttaataacaaatataatgaaataatatatagaacgggcgacttaggatattataacaatgacggtcttatgtgcttttcatcaagaaaagatttccagattaagcatatgggacacagaatagagcttggtgaaattgatatggcaatcaacgcagtggacgatgttgtaagagcatgctgcatattccatcaggacgcaaataagattcttggattctatgagggagctgcagataaaaagactattacacatgttcttatgcagaaacttccaaagttcatgattccacaggaatttatccaggtagaatcaatgcctataacaaagaatggtaagattgacagaaaacttcttcttgaaaattatatcggaggcgaaaatgcttag

SEQ ID NO: 1189 - DNA, 1761 bp, Unknown
  Artificiall/Consensus sequence
atggatatgacatgtgacgcacttattaaatcacaggaaattatggattttatcatatataacaatccatggtactataattataatccgtcagataaaatagaaaacgcatgcgtaattgaagtggatgagaacttttcaattggatatggaaagctttcaggtgatatgaaaatgagcataagcaatcttggatatcagacaatacctaagctatatggaataatggatacatcaagtatggatgcggctggtattacgtcttcgttaaaccagccgtttcttaatgtccgcggacagggtgtaattatgggaattgttgataccggaatagattatacacatgaagcattcaagaaaagcccaaatgtcagccgtatagctgtaatatgggaccagacgggtgagtggaataatacagaaaatcaagagagcagaagcgactatgttagcagtgtatacaaatatgggagagtctttactaatgaagagataaatgcagcactcaaagcacagtctgacggcgggaatccttatgaatatgttccagaaaaagatactgacggtcatggcacttttatagccggtattgcagcaggaagccagacagatgaattctgtggagcagcaccggagtgtgaactggcagtcgttaaacttaaagaggcaaaagattatcttaaagaatattttcttgtaaacagagagacagcagtatttgaagagacagatataatgcttggtgtacggtttctgcttgattatgctgctaaaaggaaaatgccgcttgtgatatgcttcggacttggaacaggaagcggtccaagaacaggtgcaacgccattggcaagtatgcttagtttggttgcaataagaacaaatgtagtagttgtttcttgtatgggtaatgaagctgcaggaagaacacatatatcaggtgaggcactttcatctgtatcaccatatacaatagaattaaatgtaggtaaaaaagaaaaaggattttcaatggaaatatgggcaaatacgctcgatgtgctgtcagtttcagtaatatctccgtcgggcgagagtgtgccaagattatctgcaagaacaggcatgacaaatgtgttaaagtttatatttgaaaattcacaggtagaagtagattacagagtggtagatacattatcaggatatgaagtgatatttttcagatttattaatccggcacagggtgtatggaaaattaatgtatacagccttacaaatataaaagggagttttaatggatggcttccgattaataatttcctgcagtcagacacattttttctgaattctacgccggatacaacattgacagaaccagctgcagaatcaagaattataagcattgcatcatataatcatctgacaggtgctataagtatagagtcaggcaggggatacagtgcagataatgttgtaaaacctgaacttgcagctcctggtgttaatgtatatggcccacgcaccggaggaggatacacatatagaagcggaaccagcattgcggcggcacatgctgcaggagcagcagcactgttacttacatggggcgtatattacggcaatgcaaaatatcttggaacaaatgacgtgaaatatattcttattcgtggagcagtaagggatgagagtgtaacatcttccggcagtgaagagtttccaaataacatatggggatatggcagacttaatctgataaattcgtttctggaactccgtgtgacataa

SEQ ID NO: 1190 - DNA, 1425 bp, Unknown
  Artificiall/Consensus sequence
gtggtggcaggtatggataatacaagtaaagattcacttgaacaattaaataaagacatcctggtatctattgctgatgactgtatgactgcatatatctgccttaaaaatccgggaacggaaatctgttatggttatgaagatgttaaaaaagcattggcagatgccggtgtaaaaatgggaatcaatgatgaacttatccacagaattttatcggaaaaaagatataacagtatggaaacagtggcagaaggaaaacatgttgaagacggtgaagatgcaagatatcaattattttttaatacagatgtcagtaacaagccggtaatacgtgaagatggttcggtcgattattataatctgagactttatgaacttgtgagcgaaggagacaagcttgcagaatatatacctcctacaaaaggtgtgtttggatatgacgtaaggggtaagcttcttgtgccaaaaccgggcaaacctaagacaaagttaagaggaaaaggatttaccgtatcggaggatggcaatacatattattcagctattgacggaaaagttgaatacaggaatacggaccttaatgttattggggttttgcagatagaaggtgatgttgatcttaatataggtaatgttgattttaacggtgatgttgaaataagcggcaatgttataagtggggtttctgttactgcaaaaggaaatgttacggttggcggcttcgttgaaggtgctgtcataaaagcggataaagatattattttaaagaaaggctctaacggaaaaggcgttgccaagatagaggcaaaaggcaatgtcacagcgagctttcttgaaaatctgcgtgtttactgtgatggcaatgtatattctaattcgattcttaactgtgaaatatcagcaaaaggaaaggttatcgtttcggggagcaaaggcgtcatatatggtggtgatgtaacaggaatgcttggtgttgagtcagcatcaatcggtaactcgtcaaatgtttctacgattgtaagaataggtgctgcaaagcaggtacataaagattatcaggatacgcttgtgaagttaaaagaaattacagctgagatagatacgcttgaaattgttacacataagtatgaaaggctgcgtgaagccgcaccggaaagatttgacagggaaaattataataaaattatacagtcaaagataataaaaaattcgcagaaagccaaacttcaggaagaaaataagcagctttttgacctcataaaagaagcgacagtttcgggagtaaaagtttataagacattatatccgggcgtgaggatttatgcggaaaatgttatatatgatgcccagacggaaagaaaccatatctttctaagaagaggcggggatgcaatgagaattattgaactgggcgatgatgagtaa

SEQ ID NO: 1191 - DNA, 2040 bp, Unknown
  Artificiall/Consensus sequence
atgaagattaagaaaaatgacctgtttattggaatttatctgctctctgcggttattttctttattatttcaatcccatcgtggctgcttgatattcttctggcactcaatatagcagttgcacttattatattatttaatgcgttatatgcaaaagaagtgcttgatatggcatcatttcctacaatgttgttattcacaactatttttagaatttctctcaatgtatcttcaacaaagcttatccttactaaaggtgatgccggtaaagtcgttgatacatttggaaagtttgtaggcggcggcaatcttgttatcggtgccataatatttatagttctcgttattattcagtttatagttattaataaaggtacagagcgagtagctgaagttacagcacgattcacgctcgatgccatggcaggcaagcagatggcaattgactctgaccttaatacaggtgcaatcacagataaagaagcagctgaaagaagaaagaagctacagcttgaaaacagtttctttggttcaatggatggtgctacaaagtatgtaaaaggtgatgccactgcaggtcttattattaccggcattaacattgtcggtggtattgtaatgggcatgatgtataacgggctcagtatcaatgaagccttatcaaagtatacaatacttacaatcggtgatggactctgtagccagataccatctttgcttatatctcttgcaactggtgttcttgtaacaaaagcatcaagtgatggtgaacttggcgatgagattgttggacagctgttctcaatggacagggttcttatgatggttggtggtgctcttacagtattaggtgtatttacgccacttcctatatatgtatttgttccttttggtgtagcacttattcttgcaggaagaaagcttggagataagaagggtgaagaacagatagaggaagaagtggaacgtgaggagacagaagcacaggaaatcaggaagccggagaacgttgtcagtcttcttaatgtagaccctattgagttggaatttggttatggtattattcctcttgccgatgtcaatcaggggggcgaccttcttgacagagttgtaatgatacgacgccaggttgccctggaacttggtgctgtagtgcctattatccgtttaagggataatatccagctcaatcctaaccagtatgtaattaagataaaaggtatacaggtgagtgaaggtgagatattgtttgaccattatatggctatgaatccgggatatgttgaggaagagattacaggtattcctacatttgaaccgtcattccatcttccggcaatatggataacagaaagtcagagagaacgtgctgaatcacttggatatacagtagttgacccgccatcaataattgcaacacatctgacagaagttatcagacagcatattgctgaacttcttacacgtcaggatgtacagaatcttattaataatattaaagaaaacaattcaacgcttattgaagagcttgtgcctaaacttcttggtgttggtgaaatccagaaagttcttcagaatcttcttgaagaaggcatatcaataagggatcttgtaactatatttgaaacacttgcagatcatgcaccggttacaagagatacagatattcttacggaatatgtgagacagagcctgaagcgtgcaatatccggaaaatattttccaccgaacgaagttactaatgttgttactctcgatccggcggttgaacaggatattatgggttcggtaaagaatacagaacagggatcatatcttacacttgaccctgaaaaaacaaaaaaaattgttgccagtcttaaagatgcaattaagaaacttgaagatatgggcaagaatccgatagtaattacatctccgatagtaagactttattttaaaaaacttgtttcggattacataaaagatataattgtgatttcatataatgaagttgaatcaaatgtggaattacagtcagtagggatggtgacagaataa

SEQ ID NO: 1192 - DNA, 1407 bp, Unknown
  Artificiall/Consensus sequence
atgaagatttataatacacttacaaagaaaaaagaagaatttgaacctcttgaaaaaaataaggtaaaaatgtatgtctgcggacctacagtttacaatcttatccatatcggtaacgcaagaccgatgatttgctttgatacagtaagaagatatcttgaatataaaggatatgaagtgaattatgtatctaattttacggatgttgatgataaaattataaagaaagccaatgaagaaggcgtttcagcagaagaaatttcaacacgttacattgctgagtgtaaaaaagatatggaaggcatgaatatcaagcctgctacaacacatcctcttgctacacaggaaatcggtggcatgattgatatgattcagacacttattgataagggatatgcttacaatgtcaatggtactgtatattacagaacaagaaagtttgaaggatatggcaagctatcaaagaaaaatattgacgaccttgaggcaggacacagagatataaaggttgcaggagaggacgaaaaagaagatccgcttgatttcgtactctggaaacctaaaaaagaaggtgaaccttcatggccgtcaccttggagcgacggaagaccaggctggcatattgaatgttcagttatggcaaagaaatatcttgcagatgagatagatatccatgcaggtggtgaagatcttatatttcctcaccatgaaaatgagattgcacagtcagaagctgcaaacggagtacaattcgcaaaatactggatgcacaatgcatttttaaatattgacaataagaaaatgtcaaagtcactcggtaatttctttacagtgcgtgacataagcaaagaatatgaccttcaggtattaagatttttcatgctttctgcacattaccgcaatcctattaatttcagccatgatttgatggaatcagcaaagaacggacttgaaagaattgttacagcagtagctaatctcaaacatttatctgaaaatgcaaaagaaggcaacatggcagcagatgaagcagaaaagattgcatcacttaaagagatgtatgacaagtttgaacaggcaatggatgatgattttaacacagcagatgctatttctgcagtttttgaaattgtaaaatttgccaactcaaacagcagtgctgaaaatacaaaggaatatatagatacactcataaagaaaattacaacacttacagatgttttaggacttaaagtagagaaaaaagaagaaattcttgatgaggatattgagaaacttattgcagagcgtcagcaggcaagaaaagacagaaactttgcccgtgcagatgaaatccgtgatgaacttcttgccaaaggaattgtacttgaagatacaagagaaggtgtaagatggaagagagcctga

SEQ ID NO: 1193 - DNA, 1734 bp, Unknown
  Artificiall/Consensus sequence
atgaaaagaatttggatgtatttaaaaatgtataaaaaagagtgtgtgcttgcacctctttttaaaatgctggaagcgacatttgaactgtttgttccacttgtagtttcagcaattattgatgtaggtattgcaggtgcagacaagggatatattgtaaagatgtgttttgtgcttgttgcactcgcaataataggacttacatcttccattacagcacagtattttgcagcgaaagcagctgtaggatgttctacacagatgagacatcatttgtttaaacatatacagagtctttcatttactgagatggatacaatcggaacatccactcttataacaagaatgacaagtgatattaatcaggtgcagaatggtgtaaaccttgttttaagactgtttttacgttcgccatttattgtatttggtgcaatgattatggcttttacaatagatgttaaggctgcacttgtatttgtaggtgcaattcctatacttgcggtaattgtattcggtataatgctttcgacaaggcctttatacaagaaagttcaggctggtcttgataagattcttggaataacaagagaaaaccttactggtgtgcgtgtaataagagcatttaataaggaaaatgaagaagtatacagattcaaaaagtctaacgaagagctcaatcatctgcagaagtttgtaggcaagatttcaggacttatgaatcctttgacatatgctgttgtaaatatttctataatcctgcttatatggattggtgctgtacgtgttaattccggcacacttacacagggacaggtagttgctctttacaactatatgtcacagattcttgtagagcttattaagcttgctaatcttgttattaatatcacaaaggctcttgcatgtgcaaacaggattgatggcgtatttgcagttaaatcaagtatggcagatggaaaacttgatatatctgaaacagggaaaaatacacaggttccggctgttgaatttaaaaatgtatgtctgaaatatgccggtggtggagaggaagctcttacagatattaacttttcagttatgccgggagagacagtcggtgtcattggtggtaccggttctggtaagtcttcacttgtaaatatgattgcacgtttttatgatgcaacaaagggcgaagtaaagattaatggcagaaatgtaaaagagtataatatagagtcgcttagaaatcatgttgctgttgttatgcagaaagcacttttatttaaaggctcaattcgtgacaatatgaaatggggcaaaaaagatgcgacagatgatgagataatggaagctcttgatatttcgcagtcaagggaatttgttgagaaaaaggacggaaaacttgatgcgtttatcgaccagggaggaaagaatctttctggcggtcagagacagcgtcttactattgcccgtgcaatggtgagaaaacctgatatattaattcttgatgacagtgcatcggcacttgattttgcaacagatgctgcattaagaaaagcaatacgagggatgaagttatcgccgacacttttcatagtatctcagagagcagcttcgcttatgcatgcagataaaattattgttcttgatgatggcaaagttgcaggaattggtacgcatgatgaacttcttgcaggatgcgaagtttatcaggaaatctattactcacagtttaaaaaggaggcaatgtaa

SEQ ID NO: 1194 - DNA, 1770 bp, Unknown
  Artificiall/Consensus sequence
atggataataacgtgttttttaaaggtaaagctataatagatgaacagtttaatattttgtcagtagatgatgagcttaaagattttttaggagacaatctcgttaatactaaaattgcacgacttatacatccaagtgatataaaccagcttgagacagctgtaaagaatgtccagagtgaatcgggatttgttacggcacttagaatggtagataatacaggaagatacagatggtttgtttatattatagatgaagctgaacctgcggataatgtttgtaacagcagaatatgcagtatatcgatttttgatataagagtattttttaaacatacagatacaaaggctgataacacatatatggaatatttcagtcttatggagtatcttatgttctcatatgacgtatcgactgacagattgagaatttttatgatggagagccaccagcaggtagatttttaccggggaactttagctgattggcgtagaacaatgcttgccaatggcaatgtatatggtgttacacgcaatatatttgattctttttgtgatgattttgccaatggaacagagatatttgaacgtgagtttaagatgaagatatttgagaattcacagggaatggaatggtgtcttgtcaaaggtaagactatcatagattttaatggcaaaaagcatgtaattgccacaatgtcaaagataagccctgtcaatgatgaagagcatgtatatcttaattcagatgcacttgatgtaggaacggatattcttaataagcgtgcgattacggaatatacaaagaggctgattgagtcaaaacccggatgtcctgttacaattgcaattatagatatcgataattttaagacgattaatgatgagtttggtcatatgtttggagatgaggtaatatgcaatgttgcagatgttattaaagagtctgttgagggaaagggtgtagccggaagaattggcggagatgagatgtttatcgttgttgaagggctcaagagcaatgatgagataagaaatgtgcttcgtacaatccgcaataacgtctcatttatgtataataaccagcctgataagccgcatgtcacatgttctatcggttcatctacatatccatgtgacggacagacatatgaagaactttttaatatagcagataagatgctttatcttgcaaaagagaaaggcagggacagatatataatatatctcccggatttgcatgaggattatgtgaagggcaaaggaatgcctaattcagaggcatacatgttctacaagtacaaaaaaatcggggttgttaatgatatagttaatgcttatagaaaaaatggaaaagactgcattatggagtcagctgataaaataaagagagcttttgcattagacagcatatttatttatcaccatacaggagaagcctgggagagaaagattataataggtaacaaagatattgctgaagataatgattatcttaacgataaggcatatatagctgattttacggaagatggtattgaagttattgataatatcaatttttttgaaagacgagcaaaaaatacggttaaggcatttattaatatgggaattaaccaggctgtccagattatagttaatgtcagtgatgaaaacgatgttattgtttcatttaacagaaacaggcagatgagcaagtggagcgagatggatatagtatatcttgcaatacttggtaatatatttggaaatggaatatacaatgattaa

SEQ ID NO: 1195 - DNA, 1518 bp, Unknown
  Artificiall/Consensus sequence
ctgcaaagtagtttacttgaaatagcagtttatgtatgttacaatggcaaaagcaataaatttaatatacgaaaggcggatttgagcatgaatgacagataccagacacctcttgcggaaagatatgcgagcaaagaaatgcagtatattttttcgcctgatatgaagtttaagacatggagaaaactttggattgcactggctgagacagaaaaggaactcggacttgatattacagacgagcagattgaggaactcaaggctaacaaagacaatatcaattacgaagatgcaaaaaagcgtgaaaaagaagtaagacatgatgtaatgtcacacgtatatgcatatggacttcagtgtcctaaggcaaaaggaattatccatcttggagcaacttcatgttatgttggtgataatacagatattattgttatgacagaggcattgaagcttgttcgtaaaaaacttataaatgtaatcggtgaactttctaagtttgcagataaatataaggcacttcctacacttgcatttacacacttccagccggcacagccgacaacagtaggcaagcgtgcaacactctggcttaatgaacttgttatggatttagaggatgttgattatgtactttcaacaatgaagcttttaggatgtaaaggtacaacaggtacacaggcctctttccttgaattattcaatggagatcatacgaaaatccgtcagatagatggaaagattgcacaaaagatgggatttgacaagtgtgttcctgtatcaggacagacatattcaagaaaagtagatacaagagttctcaatgtacttgcaggaattgcagcgagtgcacataagttctctaacgatatcagacttttacagcacttaaaagaagttgaggaaccatttgaaaaatcacagattggttcatcagctatggcttataaacgtaatccgatgagaagcgaaagaatggcatcacttgcagattttgtaattgcagatgcacttaatccggctatcgtatcatcaacacagtggtttgagagaacgcttgatgattcagcaaataagagaatgtcagttccggaaggattcctcgcagttgatggtattcttgatttatatcttaatgttgttgacggacttgttgtatacgagaaggttattaacagaagacttatgtcagaacttccatttatggcaacagaaaatattatgatggatgcagttaaggccggcggagacagacaggaactccacgaaagaatccgtgagctttctatggaagcaggaaagagagttaagcaggaaggccttgaaaataatcttcttgaacttattgcggcagatccaatgtttggtgtaacacttgatgaacttaaagctaaacttgatccttcaaagtatgtaggacgttcaaaagagcaggttgaagaatatcttgcagaaattatcaatcctattcttgatgctaataaagaagaactcggaatgacagctgagattaatgtttaa

SEQ ID NO: 1196 - DNA, 1530 bp, Unknown
  Artificiall/Consensus sequence
atgcctaatatatttgatggaatacgaaaaatgtcagacgaagatgtcaggcttgaaatagccctgattacacagactaatcttcttaatgctgcaaaagagaccggtaataagctggtcaactcgcttgcagatgcagccaattcatttatgcaggcgttcgcttcatctaagtctatagattatcagatagtgcgtgtttcagatatggtacgaaaaaatataatacagcttcatgctgatacaagaagtgaacttgaaatacggcttaaagaactcattgtacaaaaatgtgggctgacagcacaggaatcattgacagtaagtgaggaaagactttcatttctggcagcagctgaagcggcaaaattgtataatattacaaaatatgatactcctgctaataaaatagaaaatgtcagcatatactataacgaagcatttattgcggcattacatcagtgtcttgtacgtcaggatgcaaaggatgttgcagatactgatttgagaatacagaaaagaatagatgaaatatctatagaagataagagagaattacataaaagacttatgcctaaagaattttcgggtaaaggcatcggaagaatactgagattagagaaaaaaacgacgtatttaaaggatgttatacagatacttggagtacaggtttttgatgaggtagctgcatatgttacagcaagcgtcaatgtacttaaaagcttcaaaagaatatcatgtgcacttatggcacagcttgtatggaaggcaaaaaatgcatatggtacaggatttggcgtcaatgaaaaatctctgccatcatatactacggaagaaaacggggcgatgcagcgaaaagaaattacggattttcatgcaatgctaaaagagatacagacacagaaggctgcagttgaagagtatgataaaaaactggacaggctttatgagcaggtttcaaagacaggtgaaaaacttcagagtgaaaaagatttacttgaaaaagaacgtgtgcaatttgataaacttgcatcacaaaaagatgagtacaatgcagggaaacattctgagagtgacacaaaactatattattcagaagtaaataatataaacagacgcattggacaatatgagcagtctgtttcaaaacttgagcagaaaatgaaagaacttgatatatcaacaggcgagtgtgaaaataacaaggaaaatgctgcaaaagaggcagagagaatggcaaaagaggcagaattgcgggaacatgaactttctgagattataaaaaacaaatggggtgcattttattataaaatgacatttgaagatgaagtatttgtacaggctgtgacacttcttacacttgacggaagaattgcagttgaaagaatgatcaaagaatttcatgatacacctgacagtcaggcatttgatacaccctcgtcatccggatgcattatatgtgatacagtggctgatggtcaggtaaagttatatcacgaaggcatacatataactaaaataggaaaataa

SEQ ID NO: 1197 - DNA, 2094 bp, Unknown
  Artificiall/Consensus sequence
atgaataaagataaaaagatactattttcatggaaaagaataattgcggtatttatgctgtttacaatgcttgcagcatcaattgccggagtgtcgcagtatttcggacctgttgctgtaagggccgaaaatgcagtcgccacgggacatgtgaattcaggtgtttccgggctgcgtgtgcgtacacagcctgatacgcaaacaggacagattataacggttgtcgatgattcttttacatttgacatttatgaaacagtatatacaagcgatacttattattggtacaaaataggctttgactacaatggttcatatacttatggttatataagtggtgaatatacttcaaaagataattcttattcggaagatatggattttgaaagctatcttaatgagcagggatttccggattcatataaggatgggctgcgtcagcttcatgcagattatcctaaatgggtttttgttgcagatcatgtcggaaaagactggaatgaagttattgacaatgagaatgttataggacgaagccttatatatggcagtgcaaagagttcatggaagtctgttgaatcaggatgttataactggaattcgggcgagtggacagagatggacagcggtggctgggttcaggcttcaagagaacttatcgagtatactatggaccctcggaatttcctttcaaatccatatatatttatgtttgaaagtcttgcatatgattcttctttgcagaacgaatccggtgtagagcagattatatcaggaacatttatggaaaattcgagccatgatttatcttttgaaggaaatgattatacatatgcgtccggacttatgtttgcgggcagacagtcaggtgtgagtccttatcatcttgcaacacgtattttacaggagcagggaaatacgggatacggttcatgcatttccggtaatgttgcaggatacagaggatattataattattataatcagggagctgtaaagagcggaaatatttcagctgttgtaaatggcatgatatatgcaagccgctcggattctgattcgcttcgtccgtggaacacacgaatgaaatcaattgtcggcggtgcaaagatgattggcagcagttacataaaccgcggacagagcacgatttattatgaaaaatttgatgtcgtttcatcgtcaccatactggcatcagtatatgactaatgttatggcacctagaagtgagtcgcagaaagcagcaaatgcttattcagacagcacaaaatataatacaggtcttgtatttacaattcctgtatacgataatatgccgcaggagacatgtacagcacctgatggcgacggagatcctggtaatcttttatcagatatgtatgttgacggacattcaattacaccgtcattcaagaagtatactcaggattacagccttatcgttgacaataatgttgacagaataaatattaatgcatctgcaatatcaggttcatcatgggttgacggagcaggcgaacacaggcttaatgttggtgaaaataatatagaagttacggtacatgcagaaaatggttctgacaggacatattatcttacagtagtaagaaaagagccgtcagaaaatccaaatcctccatcacctgatccggcaccggaaaatccgtcatttgatacaggatataatcttgacagtgacaatatgtatatttcgggcgtaaaagctggtgacaatgcaggaactgttcttggtaatgtgaggacacaaaatgccacagcttatatctgtaacagaaatggagatagaaaaggcgatggcgatataattgcaaccggcgaccgtcttgtcataaatgataattcaggtaatgaatatgcttcttacacatttgttgtctatggagatattaatggcgatggtgagattgaccttatagatattgttaagattaagagacatattcttgaattatcacagcttaagggagaattcctgcgtgctgcggatattaacagggatggtgagattgaccttatagatatcgttgctgtaaagaggcatattcttggaatgaaagagattacacagtga

SEQ ID NO: 1198 - DNA, 1680 bp, Unknown
  Artificiall/Consensus sequence
atgtttataagcagtgtattaaaagtattagtaaggaggtttccggtgtcatatcaggcattatacagaaaatggagaccaaccgccttttctgatgtcaaaggtcaggaccatatagtcacgacgttacgtaatcagattaaatcagacaggattggacatgcttatctgttctgtggtacgagaggaacaggtaagactacgatagctaagatatttgcaaaggctgtaaattgtgagcatcccatagacggaaatccgtgcggtgaatgtccggcatgtaaggcgattgcggcaggaacatcaatgaatgtgattgagatagatgcggcatctaacaatggtgttgacaatatccgtgagattcgtgatgaagtacagtattcaccgacagagggtaagtataaagtatatataatagatgaggtccatatgctctctataggtgcgtttaatgcacttttaaaaacacttgaagagcctccgtcatacgttatatttatacttgcaacaacggaagcacacaaaataccgataacaatcttatcaagatgtcaaagatatgattttcacaggatttccatagagactatttccgacagattatctgagcttatgaaagctgagaatatcaatgttgaggaacgtgcaatacgatatattgcaaaagctgcagatggttcaatgcgtgatgcattaagccttatagaccagtgtatagcattttatctgggacaggatttaaagtatgaaaatgtgcttgaagttctgggagcagttgatacggcagtgtttgaaaatatgcttgcacttataatgtcgtcagatgctgccggatgcatgcagcttatagaacagcttataatgcagggcagggaacttggtcagtttgtaaatgatttcatatggtatttaagaaatcttttactcgtaaaaactacggatgatgaatcgaaacttgctgatataatagatgtgtcagaagacagccttgcacagttgaaggcagactcatcaaaaattgatgagggcacgcttatgcggtatataagagtgttgtctgatttgtcaaatgagctaaagttttcaacgcagaagcgtattaaacttgaagttacaataataaaaatgtgcaagccttcaatggaaaaaaatgacagcgtggaagaacttgccgggcgtgtcacacttcttgaaaataatcttgaaaagacatgtaaggagcttgaaagcggtgcgtttgcagttagttcaccagttccgtcagcaggtacatcaatcagtggaactgatggtatacaatcacagaaaccggtagaaaagcgtgtcatagaggctcttccggatgatgtaagacagattgcagcatcatggaacggcataatcaatacaattgatgacccgatgtatgttgcgtttttaagacaatgccatgttactcttgcaaaagacggcataagtcttgagataatggtaaaatccacatcggcatataatgcaatatcaagagaagaggaagtaaatcgtcttattgaggttattgaagaaagaaccggcataaaggtaaatataataattacaaagctggcagatgatgaggattttcaaaacagatttacagatataagagaacttgttaatatggatatagaagtagatgataaggaggaatacatctaa

SEQ ID NO: 1199 - DNA, 1959 bp, Unknown
  Artificiall/Consensus sequence
atgattttatcatgtaaccatataagcaaatcgtttggcactgaccagattataaatgactgctcatttcaccttgaagaacgtgaaaaagctgccataatcggaatcaatggtgccggaaaatctactcttttaaaaatcattgtcggtgaacttcccgctgattcaggaaatgtgactgtctccaaaggaaaaactctcggttatctttcacagcaccagaatctctcaactgacaagactatatatgatgaacttctgtctgttaaacaggatttaattgatatggaaaatactatccgcagtctcgaaatacagatgaaagatgttacaggcgatgaacttgacaacctgctttcacagtatacaagacttaatcatgaatttgagatgaataacggatatgcatataaaagtgaagttaccggtgtccttaaaggtcttggatttggcgatgaggatttttctcttcatgtaaacacactctcaggcggtcagaaaacgcgtgttgcacttgcaaaactgctcatatcaaagcctgacatcatcatgcttgatgaacctaccaaccatcttgatatggattctattgcatggcttgaaaattatcttctcacatataatggaagcgtcttaatagttgcacatgacaggtattttcttgataaaattgtcacaaagattatcgagattgacaacactgctgtcacggtattttccggcaattatacagactatgctgccaaaaaagctgttcttcgcaacatgaaattaaaagaatacctaaaccagcagcgtgatatcaaacaccagcaggaagtaatcacaaaactgaaacagttcaaccgtgaaaaatcaatcaaacgtgccgaaagccgtgaaaaaatgcttgacaaaatggaacttgtcgataagccaacagaattaaacgacaaaatgcatatacgccttgatcctaaggtggtaagcggcaatgacgtattaactgtcaaagacctttcaaaaagttttggcgataactttttattttcaggtcttgactttgaaataaaaagaggcgaacgcgttgccctcatcggcaataacggaacaggcaaaacaacaatacttaaaataattaacggtttaattcctgctgattatggtgaaatcactctaggttcaaaagttacaatcggatattacgaccaggaacatcacgttctcgaccctgataagactctgtttgaggaaattcaggatgcttatcctgaccttaacaacacacagataagaaacactctcgccgcatttttatttaccggtgacgaagtatttaagtatatcagggatttgagcggtggcgaacgtggacgtgtatcacttgcaaaacttatgctttcaaacgccaactttctgattcttgatgagccaactaaccatcttgatatagtttcaaaggaaattcttgaaaatgcactcaataattacaccggaactgttttttatgtctcacatgacagatattttatcaacacaacagccacaagaattattgaacttacaggacatacaattgtaaattatatcggcaattacgattattatatcgaaaaaaaggatatacttacaccaaaagcacttactgatgctacagctgccattaatgacagcatggcgtcatcagcctgtcagacaccgtcatcagcacaggggtcttcaaaggcagaatggcagcagtcaaaagaagaagctgcaagacttaaaaaacttaaaaatgagctgaaacgcacggaagacaaaatcagccagactgaagaacgcatcagtgcaattgatgaagaatataacaatcctgatattgcaagcgacacagcaaaacttgtcgaacttcacaatgaacgcacttctctctcggaaatgcttgatgaattgtacgaaaaatgggaagagctatccgaagaacttattgacaaataa

SEQ ID NO: 1200 - DNA, 2202 bp, Unknown
  Artificiall/Consensus sequence
acaaaaaagaggagaagattaatggcagctttattaattttagtcattgtggcagcactgctggcacttggatatgcggcatttaactttatcggcgtcaaaaagcttgatgaaggaacagatcgtatgtcagagatcgcggaagctatcagagttggagctaacgcatttattacttatgagtataagattataggtattgtagtggttattattgcaattatatttgcagcaattttttcagtccagtatggaaaattcagctgggagccatcagtatgtttcatcatcggagttgtgatgagtgcatcagcaggatgggtaggaatgaagattgcaacttatgcaaatgtcagagtatctaatacagcaagaaagactaagaatatcggttcaacactcaaggtagcattaaagggtggttctgtaatgggattatgtgtaggtggtttcgcacttcttggtttattccttgtatacataattttcggttacggtcttaatatgatttcaatcagtgcacttcgtgatggacagcacatcttcacacagtgtctttcatgttatgcattgggatgttctatcgtagctatgtttaaccgtgtcggtggtggtatttatacaaaggcagcagatatgggtgccgaccttgtaggtaagacggaagcacacattccggaagatgaccctcgtaacccggcaacaatagcagataacgtaggtgataatgtaggtgatgttgcaggacttggttcagacctgctcgaatcgtttgtaggagctatatcatctgcaattattcttgcagtaagcttattcctttcaaatatcgcaaataaacttacggtttcagatacacttcttatgaagatgatgtattttccacttgtttttgcggcaattggccttattgcttcgtgtcttggcatcgcatatgttcttattaagaaaggctcagatagtcctcacagggatttgaatatttcaacatggagtgcagccgtaatcacaatcataggcggctttgttgcgacatattttatgtttaagcctgaaactaaagcggtacttgatgttgcaggatttaagacaggatatacatcaccttggatagcagcgtcacttggtgttattagtggtgttattatcggtgcaatagcagaatattatacaagttatgattataatccgactaagaagattgctgagagtgcaaaagaaggagcagcacttacaattacacagggtcttgcagtgggcatgaagtcttgtatgcttccactcattatccttggtataacaacatacgtttcatatgctgtgtccggaatgtttggtattgctatggcagctgttggcatgctttcatttgtatccgcaacagtttctgttgatacatatggacctatttcagataatgcaggcggaattgctgagatgtcagaacttgagcctgaggttcgtgagattacagataaacttgattcagtaggtaatacaacagcagcaatcggcaaaggttttgccattggttctgcttcatttgccgcactttcacttatggttagtttcctttatgcattccagcctgaaggttcacagcttgaacttaactttacaaatccgcttattcttgctggtgccttaatcggtggtgcacttcctttccttttctcaggaatgcttattgaagctgtagccaatgcggcacgtaagatggttgatgaagtaagaagacagtttaaggaaattcctggaattcttgaaggtaaagcaaaacctgattataagacatgtatagagatttcttcacagggagctttaaaagagatgagaatgccggctattctttcaattattttccctgtaatttcaggtttccttttcggaccttactttgtaggcggacttcttatcggtgcaacactttcagctattatgcttgcaatatttacaggtaatgcaggtggtgcatgggataatgcaaagaagtatattgaatcaggtgtttttgagggacagggcaaaggttctccggcacacgatgcggcagttgtaggtgatacggtaggtgacccgcttaaagatacagttggaccatcacttgatattcttatcaagattatgtcaacggtttcacttgttgcagcggttcttttctacaactacaacctgttatatctcattttcggaatcagataa

SEQ ID NO: 1201 - DNA, 3081 bp, Unknown
  Artificiall/Consensus sequence
atgcaaaaatgtgataatattaaaaagaatatagtttcttcgcaaaacaaggaggataaaatcctctcctcgctggagagactcggattttgtaacacaaaacaaggaggatttatgactgatataaataaactgaatttatcaaaatatgatgtaatttccgttgaaaagcttgaagatttagattctacagggcttttattaagacataaaaagagcggtgcaaggattgccattgtttccaatgatgataataataaggtattttctataggttttaagacaccgccgtataacgatacagggctgcagcatattcttgaacattcgacactatgcggttcaagaaaatatcctgtgaaagacccgtttgtagaactttgcaaggggtcgctcaacacatttcttaatgctatgacttatccggataagactgtatatcccgttgcgagctgcaatgatgtggatttcaaaaatattatggatgtttatatggatgcggtattttatcctgatatttataataagccacagatttttaagcaggaaggctggcattatgaacttgaaaatgaggatgatgagcttaaaatcaatggcgttgtatataatgagatgaaaggtgtatattcgtcaccggatgacgtgctttcaagatatacatgtgtatctttatttcctgacacgccttacagatttgagtcgggcggtgagcctgctcatattcctgagcttgattacaatgaatttcttgattatcacaagaagttttatcatcctgtaaatagctatatttatctgtatggtgatatggatgtacaggaaagacttgattatcttgacagggaataccttagtgattttgatgcagatgatgtagatattgacgcatcaattcctgcacagaagagttttgaaaatgatgtttttaaggaatttaattatgctgtaacggatgacgaaccgcttgaaaataatgcatttctttcatataacaaggttgttggaacatcacttgatgcaaaactttatcttgcaatgcagattcttgattatgcacttatcatggctcccggagcaaagttaaaacaggctcttattgataaaaatataggaaccgatatttacagcagttttgagacatctgtgtatcagccgatttattcaattattgctaaaaatgcagatgaaaataagagacaggagttcacagatacaattaatgaagtgctcagtgatattgtaaaaaatggtattgatatgcgtatgattgatgcgggaatcaattattatgaattcaaataccgtgaggctgattatggtgcatatccaaagggattaatgtattatctcacaatgatggacagctggctttatgatgaaaataagccgtttattcatattgaggcgggaaagacatttgagcagattaaaaaagaaaaagagtcaggattatttgaaaaaataatcgaggagtggcttgtaaataatcatcatggttctgttatatcgctggttccgaaaaggaatcttgaaaaagaacttgaagataagacaaagtctgagcttgcagattttaagtctaagctgacaaaagagcagatacagcagtatgtgcgtgaaacaaaggaattaaaggaatatcaggacgagccttcaagtcaggagaatcttgaaaaaattccaatgcttgcactcaaagatattggaaaaactccggcaagactttatatcgatgaaaaagaggaaaatggtatcaaggttattcaccataatatgtttaccaacagaattgcatatattatgatgtcttttgaatgtaagagtgtatcagatgaacttgtaccatatataggactcctttcatcagtgcttggacttatggatactgataatttcacatatcctgaacttactaatgaaatcaatattaattcgggaggactttcatcagattctgcaatatatacagataataaagaacttgataagtatcagataagatatgaggtaaaaggtaaagttttatatgaaaaaataccttttatgcttgaaatgatgcatgaaattatatattgtacaaaatttgatgattataagagacttaaagagattatttcaagaacaaagtcgagaattgaaagctcaatgacaggtatgggacatacagtagctatgctttatggaatgtcacagttatctgcatcgggatattattcaaatcttatgagaggatacggattttacctttttatccaggagattgaaaaagattttgataacagaaaagaagagattgcaggcacacttaaccagcttataaagcttatatttacaaaggaaaaccttgttgtcagctttaatgccaatgatgatggatatgataaatttaaggctgcttttggtgattttgcaggaaaattaaatacagacaattatcctgtagaaataagaaaatttaagccatgtaatgttaaaacaggttttacgtcatcatcacaggttcaatatgttgcaagatgtggcaattttgttgatgcgggatataagtatacaggtgcattaagagttttaaaagttattttcggctatgattatctttggataaatgtgcgtgttaaaggcggtgcatacggctgtatgagcggttttggcaaaaatggtgacatgtatatggtatcttaccgtgatcctaaccttaaaaagacaaatgaaatttttgatgaatcagttgattatattaagaattttgatgtgagtgacagagacatgctcaagttcataattggtacaataggagatatggatacaccaatgaatccggcagctaagggcgttcgttcatttggagcatatataagcaatgtgactattgaagattatcagagagagcgtgatgaagttttaggtgcgacaccggagaagataagagaactggcaccaattgttgaagcaggacttaaacagaatcatctgtgcgttgttggtaattataaaaatataaatgatgagtcatctatgtttgatgagattaagccattatttgtatcagcagtacaaaataacagtgaagaagaatga

SEQ ID NO: 1202 - DNA, 1392 bp, Unknown
  Artificiall/Consensus sequence
tcagaggtattaggtatggaacatacaatagccgcaatttcaacaagtacaatgagcagtggtggaataagtattgtaagaatgagcggaaaagatgccattgagacggcagataaaatatttgtatctaaaaacggaaaaaaactgtttgaagtcagcagccatactgttcattatggaaatattgttgatgaagacggtaatattatagatgaggtgcttgtcatagttatgcgtgcacctaacacatatacaagagaggatgttgtggaaattgactgtcatggaggaattcttgtaacaagaaaagttcttgaagcggcgattaaagcaggtgcaaaaccggctgaacccggcgagttcactaagagagcatttcttaacggaagaattgatttatcgcaggcagaggcggtaatagatgttattaattcaaaaaatgaatacgcattgaagtcatctgtaagccagcttgatggaaaattatctgcaaaaataaaggaaataagggaagttatccttaatcatgtagcatatatagaggctgcacttgatgaccctgaacatatttcgttggataactatgttaataacatagaaaaagatgtggataactgtgtggataatgtgtataaattgttgaaaacttctgataacggtcgtataatgcgggatggaatacgaactgttattttggggaaaactaatgcgggtaaatccagcctgcttaatgctcttgcaaaagaggagcgtgcgatagtaactgatatagagggaacaacaagagatgtacttgaggaacaggtaaatctcggtggagttactcttaatcttgtagatacagccggaataagaaagacagatgattatgttgagagcatcggtgttgagaaagcaaaaaaatatgcacaggatgcagatttagtaatatttgttgttgacagttcaagacctttggataaaaatgatgatgatattatttcacttattcagaacaaaaatgttattgttcttttaaacaagtcagatatggaacaagttgtaaaacctgaggatttgaagaatcttaataaattcagcatggtttcaatttcggcaaagaatgagacagggcttgataagcttgaacatgcgataaaagacatgttttttaacggtgaaatatcatttaatgaagaaatatatataacaaatgtgcgtcataaaacgcttttacaggaggcacttgacagccttcatatggtaaaagatggaataaatcagggaatgagcgaggattttcttacaattgatttgatgacggcgtacgaaaaacttggaatgattataggcgaagaggttgaagatgaccttgcagaccgtattttcagtaaattctgtatgggaaaataa

SEQ ID NO: 1203 - DNA, 1275 bp, Unknown
  Artificiall/Consensus sequence
atggtaagattgacagaaaacttcttcttgaaaattatattggaggcgaaaatgcttagtatagaaaaaataacacagcttgcaaaagaaaattcaacaccgctttatatatttgataaagatgagcttgcagacagaatttcatcaataaagagaatagtaggagatggcgtcacaatatgttatgccatgaaggctaatccgtttctactcgatgcggcaaaaaagcttaatgtgaaatttgaggtgtgttcgccgggcgaattttcaatatgtgagcgtgaaaatattaatatgtcagacatagttctttccggtgtcaacaaggaaaagcatgatatagaacatgtcatggacgactgtggcggtgtaggaatgtatacagttgagtcagtaagccagtttgaacttctcaatgaatgtgcggcaaaaagaaatattacaatacctgtgcttttaagagttacaagcggcaaccagttcggacttgacgaagctgaggttgaaagactcgtctcacacagagaaaactatcctaatattgatatacacggaatccagtgttatacaggtacgcagaaaaagaaaattgaccatatcacaaaagaacttgaatggcttgacggaatatgtgatatgttaaaagaaaaatatggttttaatgcaagggagcttgaatatggacctggacttcctgtttcatattttggcgaagatgctttcaataattcgtatgatatgttaaaagagtttgccgagtatctcaaaccgcttaaaagtaaatacaagataacacttgagatgggtagatatattgccgcaacatgcggagtatatgtgtcatcagttgctgatacaaagactaacaagggccagaactactgtataattgatggtggaattaaccatgttaattactatggacagacaatggcaatgaaagttccggcttatacatttgtgaaagccgacggcacagctgcggcaggctatggtgcgaaagattacagcacagaacctgaaaaatggacaatatgtggttcactgtgtacagttgctgatgtaattgtaaaaaatcttccgataggaaagccggaatcaggcgatatgattattttttataatatcggtgcatattctgttacagagggaatttatctgttcctgagcagaaaaatgcctaagattatagcatacagcgaaaaagaaggaatgagtttataccgtgatttcaaattttcggataagattaattcgagagaagatcttatttaa

SEQ ID NO: 1204 - DNA, 1383 bp, Unknown
  Artificiall/Consensus sequence
atgaaaaaaaagaatgtcaaaatctgtgttgttggcggaggaaagataggttcagagatagcttcccagcttacagataatggctgtgaagtaacagtaatagatactaatcttgatttgataaataagatttctaacgctatggatgtaatctgctatcagggtaatggtgcatcgcttacgatattgcaggatgcaggtgctgcagaggctgatatatttattgctgtcacaggttcagatgaacttaatatattaagctgtcttacagcacattcgctcggtgccaagaatacgattgcgagagtaagaaatgcagaatatgccgtgcagtcagaattttatatggaaaaatttggtctgtcaatgacaataaatcctgattttacagctgcaagggagatagaaagattactgcattttccacaggctacaaagattgaactttttggcaaaggcagatgtgaacttgccgagatgaaaatagaacatggcaatgcaataattggcaagacattatttgagataaaccagaaaatgaagatgaatattcttatatgtgcaatagtgcgtgataagaatatatttataccaaatggtgatgatattgtaaaagaaggcgatgtgctttatatcacaggttctcctaaggcgataaatgagtcgcttgagaaaatgaatataaaagtaagacgtatcagttcagtacttattgccggagcgagcagaattggattttatctgtcaaagatgcttgaaaaagatggtgttaatgtaactgttgttgagaaagttcacagcaaagcagctgaacttgcaggcaatgtaccgggagtatcagttatgtgcagtgatgcaatggaatattttgagagtatgtctgaggcagacatcaaaaatacagatgctttcgttacgcttacaaataatgatgaatataatcttattgcgggcatgcttgctgaaaaacgcaatgtatataaggttgtaacaaagatgaattcacattcggcattaaaagaacttcagatgaatacaaaaatatgcagcgtttccaaagagagtgctgttacagatattattatcggttattcaagatcgcttcttgcggcagaaaattttgatgctatttcctcactttacaggcttatggatggaaaacttgagtttgttgagtttaaagtcacatcagatgaggcatatcttggcaagctgataaaggaattacaagttaaaaaaggctatattattgcttctataatacgaaacagaaggcttattgtgcctcgaggtgatgatgtaattgaaaagggtgattcagttttagtatgtactgtaaataagagtattttgagattacaggacatttttgcaggagtatag

SEQ ID NO: 1205 - DNA, 2376 bp, Unknown
  Artificiall/Consensus sequence
atgtgtaatggaagaattatgattgcaggcacaaacagcggatgtggaaaaacaacagttgtatgcggtttattaaagtgtcttttaaacagaaaaatgaacattcacgcatttaagtgcggacctgattacatagatacatcatttcataaaaaagtgctaaaaattccaacaggaaatcttgattcatggttttgtaagccggaagatttaagaaagatagtttcaaaaaaagcgggtaaatgtgatatagcggttattgagggcgtgatgggctattatgacgggatgggatttacgcagagggcaagtgcatatgaaattgctgacataacatctacacctgtaatacttataataaattgtaagggcatgtcatcatcgcttgaagctgtcctttcaggatttgttaatatgaagcaaaaaagccatataaaaggtgtcatatttaacagattatctgagaaactttacagatatgcaaaagaatgtgcattaaaacttggagtacagccattaggatatattccgtcagattcgttacttcatattgaaagcaggcatcttgggcttgtaggtgcggatgaaataaaaagttttgatgaaaaacttgagcatctggcagatgtaatggaaaagacggttgatattgatgcagtgattaaacttgcaaaaacagcggaaaaaatagaatacgaagctgaaaaagatgtgggaactgacagtaaatcttgtgtgaatattgcaattgcaaaagatgaagcattttgttttttgtatgatgacaatattgcttttctggaagaaaatggatgcaggattatgtatttcagtccgatacatgacagtgaaataccgcatgatgcagacggagttattttctggggtggatatcctgagagatatgcaaaagaattatcagaaaataagagtatgattaaaagtgtaaaaaaagtgatagacagtgggattgcctgtattgcggaatgtggaggctttttatatcttcattcatatcttgaaggaactgatgggaaaaagtatcctatggcggggattatagatggtgaagcagtaaatggcaaaagactgcaaagatttggatatatggaagttacgccggtgtctgatggtatggcatgcagatgcatgcagccgttgaaaacgcatgaatttcattattggaaaagctgtaatccgggcagcgattttcaggtgaaaaaagtatctgatgaaagtatcagcatggcaggatacaacacagaaaaattatatgcagcttttatgcacatatatttttacggaaatgaggaatttggaatgaattttataaaaaaatcatgcgaatatgctgcaaaaaaacattgggataatatagcaaagcctcttaacggactgggggattttgaagatataatagtaaaaattgcaggcatacagaatacagaacatgtagatataagtaaaaaagcattagtcataatgtgtgctgataatggaattgtagaggaaaatgttagtcagagcggacaggatgtaacagcgatagtggctgccaatatggcatcacgcaaatcaagtgtatgtcttatggcaggttataccggtgcacaggttatacctgtagatataggaattgcatgtgaaaccattccgtcaggtaaaaaaattgatgatatggatggaattttacataaaaagataagtcatggtacaaaaaattttctgaaagaacatgctatgacagataaacagtgtattaaggcaatagaaacaggaaaagaaattgtaaaaatgtgcagtgaaaaaggaataaatattattgctacgggcgaaatgggaattggaaatacaactacaagtgcagcacttgcagcaattcttcttgatgaaaagccggaaaatgtaacaggttacggtgcaggacttacgaatgaagggcttaaaaataaaactgaaatagtaagaaaagcatgtgaaatgtatagtggatataaagatgatgcacttaaacttttatcatgtattggtggattggatattgcagggcttgctggtgtatttatcggcggagctgagtatggaattccggttgtcattgacggactgatatcgggaatagcagcacttactgcggaatatatgtcacctggaacaaaaaaatatatgattgcatcacatgcaggaaaagagcctgctttaaaaaagattcttacacatcttgaattaaagcctgtgatagatgcaaatcttgcattgggagaaggttctggggcagttatggtttttcctctgcttgatatggcaatgagtgtgtacaatgagagcaatacatttgaaaatatagatatggaggcatatgagtgtttgcattaa

SEQ ID NO: 1206 - DNA, 2031 bp, Unknown
  Artificiall/Consensus sequence
atgcttttaaatatatttaatggaggattgattaatatggcaaacgaacatggtaatttatcaattaacagccagaatattttccctataattaaaaaatggatgtattctgaccatgatattttctacagagaattaatttctaatggttgtgatgcaattacaaagctaaaaaaactttctttaattggtgagtatgaagcccctgatgatattgaatataaacttgacgttaaagtaagtcctaaaaacaagactatcaaaatcattgataatggtattggtatgactaaggatgaagtaaatgaatatattaaccagatagcattttcaggtgcagaagctttccttgaaaaatacaaggacaagactaacgaagaccagattatcggtcattttggtctcggtttctactctgcatttatggttgctgacaaagtaactatcgacacgctctctttccagaaagatgcaacagcagttcattgggaatgtgacggcggtactgaatatgacatgaaagattctgacaagcagaatgtcggcacagaaatcacactttaccttaatgaagacagttatgaatttgcaaatgaatataaagcaagagaagttattgaaaaatactgctcattcatgcctgtacctatcttcttaactaacgaggatgaagaaccaaagacagaggaaattcctgaggacgaagttacagaaaaagatactgttattgagacatttataaaagaagccgagacagaagaagtcgaaaaagaagacggaacaaaggaaacagtcgaaaaaactcctgccaaaaaaatggctaaaatagtaaaacgtcctgttcctttaaatgatattcatccactttggacaaaacatccaaacgaatgcagcgatgaagattacaaagaattttaccgcaatgtattccacgattataaagaacctttattctggattcatctgaacatggattatccatttaatttaaaaggtattctttattttccaaagattaacacagagtatgaaactattgaaggcacaataaagctttataataatcaggtattcgttgctgataacataaaagaagttatacctgaattcctgcttcttctcaaaggcgttattgactgccctgaccttcctcttaatgtttcaagaagtgcattacaaaatgatggtttcgttaagaagatttctgagtatattactaaaaaagtcggtgacaagctcacaggaatgtacaaaacacagaaagaatcatatgaaaaatattgggatgacatcaatccatttatcaaattcggctgcttaaaagatgaaaaatttgcagaaaaaatgaatgattatattatctttaagaacattgacggcaaatatctcacactcaaggaatgtcttgaagagaataaagaacatcatgaaaatactgtattctatgttactgatgaaacagaacagagccagtatatcaacatgtttaaagaagccggtattgatgctgtaatccttacacataacattgatcagccattcataactcaccttgagtctaaaaacgaaggtgttaaatttgcaagaatagatgctgacttatcagacagcttcaaggaagaaacaagtgaagatgaattaaaagaaatatctgaaacactcactgaaactttcaagaaagctcttggcaaagataatcttaatgtcaaagttgaaaagttaaagaatgcatctatttcatcaatgattactctatctgaacaggacagacgtatgcaggatatgatgaaaatgtataatatgtatggcatggatccatctatgtttggtgccaacagccagacacttgtcctcaatgccaataatgaacttgtcaaatatattgctgaacataaagatggcgaaaatacaactctcatgtgtgaacagctttatgatcttgctatgctcagtcatgcaccactcacacctgaacagatgactaattttattgcaagaagtaataaaattatggaattgcttgctaaataa

SEQ ID NO: 1207 - DNA, 2673 bp, Unknown
  Artificiall/Consensus sequence
aatgagaaaaaggagaattttatgagcaaggaattagaaaagaattataatccgtctgagattgaggacagactatatcagaagtggcttgataagaagtattttcatgcagaagtagacagaagcaagaaaccatttactatcgttatgccaccaccaaatattacaggtaaacttcatatgggacatgcacttgataacacaatgcaggatattcttatcagatttaagagaatgcagggctatgaagcactctgggtgcccggaactgaccacgcaagcatttcaacagaggtaaaagttacaaatgcactcaaagaagaaggcattgataagcatgaactcggaagagaaggtttcttaaagagaacatgggaatggaagaaagagtatggcggaacaattacaagccagcttagaaaaattggttcttcatgtgactgggacagagagagatttacaatggacgagggctgttcaaaggctgtccagactgtatttatcaatctttataataagggacttatctacaaaggttcaagaattgtaaactggtgtcctgtatgtaatacatctatttctgatgcggaagttgaacatgaggagcaggctggacatttctggcatattaattatccggttgtcggcgaggagggaagatttgttgaaattgcaacaacaagacctgagacacttcttggtgactctgcacttgctgtaaatcctaaagatgacagatataaggatttaattggaaaacaggtacagttacctctcacagacagaactattcctgttattgcagatgaatatgttgatatggaatttggtacaggcgttgttaagattactcctgcacacgaccctaacgattttgaagtgggaaagagacataatcttcctgaaattaatattttaaatgatgatgctacaattaataatctcggtggaaaatatgccggaatggacagatacgaagcaagaaaggctatggtcgcagatcttgatgcacttggacttcttgtaaaagtagaagaccacgttcacaatgttggtacacatgacagatgtaagacaacagttgaacctatgattaaacagcagtggtttgtaaagatggatgaacttatcaaaccggcagttgaaggtgtaaaaaatggcgatattgagcttatgccggcatctatggataagacatattttaactggacagacaatatccgtgactggtgtatttcaagacagttatggtggggacacagaattcctgcatattattgtaaggactgcggtgagatgacagtatcagctgagaaagtatgtacatgtcctaagtgtggaagcactaatgttgaacaggatcccgatacacttgatacatggttttcatcagcactctggccattctcaacacttggctggcctgaaaagacagaagaacttgattatttctatcctacagatgtacttgtaacaggttatgatattattttcttctgggtaatcagaatgattttctcaggatatgagcatatgggcaagaagcctttcggcaaagtattattccatggtcttgtaagagattcacagggacgcaagatgagtaagtcattaggcaatggtattgatccacttgaagttatcgaaaagtatggtgcagatgcattaagatatacacttataacaggtaatgcaccgggtaacgatatgcgtttttattgggaaagagttgaggcaagccgtaactttgccaataaagtatggaatgcttctagattcattatgatgaatgaccctgataataagattaagacaacagatgaacagccggataatcttactgcagccgataagtggattttatcaaagatgaatcatcttattgcagaagttactgaaaatatggaaaaatatgagcttggtattgctgttgcaaaacttaacgatttcatatgggaggaattctgcgactggtatattgagatggttaagcctcgtctttacaatgatgaagatacaacaaaaaatgcagcaatatggacattaaagactgtacttattgatgctttaaagcttcttcatccttatatgccattcattacagaagagattttctgcaatatccaggatgatgaggaatcaatcatgatttcaagctggcctgtatatgatgaaaagttcaatttccctgatgaggaagttgcaatacagacaataaaggaagcggtaagaaatatccgtaatgttcgtgcacagatgaatgttgcacctagcagaaaagctaaggtttatgttgtgtcagaagatgctttaataagagatatatttgaaaacggcagagtgttctttgcaacacttgcatatgcaagtgaagttgcagtacagagcgataaatcaggtatacctgatgatgctgtgtcagcagtaattccgggagctgttctttatattccgtttgcagaacttgttgacattgacaaagaaatcgagcgtttaaagaaagaagaaggcagattaaacggagaaatcaagcgttgcgaaggcatgcttggcaatgaaaagtttatatcaaaagcaccacaggcaaagattgatgaagaaaaggcaaagcttgagaagtatcagcagatgcttgcacaggtaagagaacgtttacaggcacttacaaagtaa

SEQ ID NO: 1208 - DNA, 1440 bp, Unknown
  Artificiall/Consensus sequence
atgcaaaggaggtggattatgaaaaaagtcttaagagcatacaaaaagacagtcagtatagtaaatgaaactgctatctggatgtatgaaaatctcggaagtgacagagttggtttccttatggaaagtaatgaaaaagaaagtggaaaatatacatttatgggtgttgatctgcaggcacttgttcagtcacaaaaagatggtcttgtgataactgaaaacaatggaaatgtaacaaaattaaaaggaaatccacttgttttattaaaagaatatttcagctcttttgaagtacattcagatgaaacacaggatgaatttaatggtggactggttggaagtctgggatatgattttataagatatacagaaaaccttccggatgataatgaagatgagattggaatcgagacaatccagcttatgcttgctcttaaattcattgccatagaccatatggcagagacagttacggcggttgttcttgacgaagataacgaagagggaaagaaaagagcacttgccgaggcagaaaagcttattgatgaagcgagaactcctggaaatgaaaataaaaagagctgtgaaataaaaaatcatcacgatggagtgataataaaaaagtcggatacgcttgaacagtattctgaaaaagtaaataaaataaaagaatatattaaggaaggtcatattttccagacagtattgtcacaaagatggacaatacagactaaacagacaggatttgatttgtataaacaattaagagttcttaatccgtcaccgtatctttattattataatttcggaaaatttgagataatcggaagttcaccggaaatgattgtaaaacagacagggaacaatgtttatacatgtcctattgcaggaacgagaaaaagaggaaaaactaaagaagaggatgaagcattggagcgagaacttctttctgatgaaaaggaaaaggcagaacatgtaatgcttgttgaccttgcaagaaacgattgcggaagggtatcgcagattggcagtgtcaaagttacagaatttatgagagtccagaggtattcacatgtaatgcatattgtttcacttgttgagggaaaaaaacacggttcatgtcatccgcttgatatggtttcctcatttttaccggcaggaacattaagtggtgcaccgaaaatccgtgcaatggaaattatagatgaattagagacagtaagaagaggtctttatggcggtgcaacaggatatcttgcatttgacggaaatatgaatttttgtataacaatcagaacaatgattaaaaaaggcgataaggtatatcttcaggcaggagccggaatagttgccgattcggtaccggaaaacgaatatcaggaatgctgcaacaaagtaatggcacttgcaaaaacgcttgttgaggaggaaaatttatga

SEQ ID NO: 1209 - DNA, 1371 bp, Unknown
  Artificiall/Consensus sequence
atgggtttaaaaaaaagaattaatattcaatatatgcttcttacactgctcgcaataattgcaactgtagcaatatcaagtgttgtgttttatgaacttataaaaaaggaagtcgtcggagatttaaagacatatactgatttgatggttgattctgatgcatggaagatagtgactgaccccgataacaacagtatggaatcggcattacaaaataataattcacatcttcgtataacgtttgtggatgcatcaggaaaagctttatatgatacaaatgcagatgtcggttatatggaaaatcacaggaagcgtccagagattgcgaaagcatttgaagatggcagtggtgaggcaataagaaaatcagagacaatggggaaaagtgctttttattatgcggtaaggcttgataatggctgtgttttgcgtgtttcaaaggaagcgagcagtcttacgagtgttatagcaaaggcggttcctgttatgcttgttctctgtgtgaatttgtttattttatgtgtgattttatcaaatttccttactaagagcatagtaggaccgatagagagacttgcgggaaatcttgatgcctcggattctataaaagtttataaggagcttgttccttttgtgactacaatcagaaaacaacatgaagacattatgcgaaatgccaatatgagacaggaatttactgcaaatgtatcacatgagttaaagactccgctgacttcaatttcgggatattctgagcttatagagagtggtatggcaagcgatggtgatgttgtccgttttgcagcagaaatacataaaagctctaacaggcttctcacacttatcaatgatataataagattatcagaacttgatgttacggtaagagaggatatatttgagaatgttaatctgtatgaaattgcagaaagctgtgttgatatgcttcagatgagtgcggataaacataatgtgactctttcaattaaaggaagcaaccggacagttaaggcaaacagacagatgatggacgaacttatatataatctttgcgataatgctataagatataataatccaggtggaaaagttgaagttacggttgatgaagataatggtaaaacatttgttgaagttaaggataacggaataggaattccgaaagaacatcaggaacgcatatttgaacgtttctacagagttgataagagccgttcaaaatcaacaggcggaacaggtcttggccttgctattgtaaagcatattgttgcaaaacatcctaatgctgaactgaaacttgaaagcgaagtcggtaagggtacaactataagagttggtttaaattatatatgtctttttgactatcttttt

SEQ ID NO: 1210 - DNA, 1518 bp, Unknown
  Artificiall/Consensus sequence
gcaatacaaaaggaggagaaaatgcgaaaatatatgctcgcagcactatgctgcataatgtcgctttttattcttaccggatgtaaatcatctgttccggaaaatactgttttttccgttgatgacttatccggcaagaaaatcggtgtacagcttggaactacaggtgacacattagtttctgactatgaagaagatggttccggcacagtagttgaacgttataataaaggtaacgatgcaatccttgcattaaaacagggtaaaatcgatgccgttgttattgatgtccagcctgcacaatcatttgtcaagacaaattctgaacttatgatacttaatgaagaatttgttacagaagattacgccatgtgtatctcaaaaaacaagcctgagcttaaagcttccattaacgaggcattaaatgtaattaaggcaaacggcactcttgataaaatcattgacaattatatcggtgaaaatgccggaaaaacaccttatatttcacctgacggtgtaaagcgtaacggcactctcgtaatggctacaaacgcttactttaagccatacgaatattatgataacggtaagatagtcggtattgatgccgatatggctcaggctgtcgctgattatcttggaatgaacttaaagattgaagatatggaatttgattcaatcattaccgctgtccagtcaggaaaagccgacttcggtgctgccggaatgaccgtaacagccgaaagacttaaaaatattgatttctctgatacatatacaacttcaaaacaggttgtaatcgtaagagataatgatgccattaagaattccggcaatgtagttgaaaaattcaaaaatgatttccttacagataacagatatcagtttgtgcttacaggtttgaaaaatactgttttaattgcattctgtgctgctcttatgggtatcgtgataggttttgtagttgctgttatacgttcaacacacgataagacaggaactcttaaaataggtaattttatatgtaacctctaccttacaataatccgtggtacaccaactatggttcagctcctgattatttattatgtaatatttggttcagtaagtattaacaaaatacttgtagcaattcttgcattcggtattaactcaggtgcttacgttgccgaaattttccgttccggaattatgtcaatcgacaacggacagtttgaggctgcaagcagccttggtctttcatacaaaaagacttttatatatgtaatacttcctcaggcatttaaaaatgtacttcctgcacttgccaatgaatttattgttctcttaaaagagacttcaatcagtggttatatcggtcttacagaccttacgcgaggcggagatattataagaagtatcacttatgatgcaatgctcccacttcttgttgtagcattagtttatcttgtaatggttgtaattctttcggcactggttaaaaaacttgaaaggagattaagaagcaatgagcgataa

SEQ ID NO: 1211 - DNA, 1605 bp, Unknown
  Artificiall/Consensus sequence
aaagggggaaacattttgaaaatcaataaagaaagaatccgtgaaaacagcgttaaatgtaagaatacaatgcagattacacttgatgatgattttaatgtacctgacagcaaagcggatatagattcgattatacgtgagtggggaaatccacatgcggacagcgtgaaagtaagcggagaacgtgcagaggtgaagggaagtctcgattttgcgtttctttactgtggaagaaatgaaactaacggaaaagttatgccgtataaaatggcaggcagcatgaattttaatgaaaatgtcaatctgcctgataatgcagatggtacatatgcggtgtgcgatgccaagctggaggatttaacagtcaaggcaattaattcaagaaaagtcagtattaaggcaataattgcaattactgttgtgtgcgaggaattaagtgagattcaggcagcagcaggagtggaagaagacgatggatggcatatacagacacttagtgaggatgtggtatattctgagcttgcggttaatctcagggataatctgagaataaaagaaagtctgtctgtaccggctggaaagcctgaagttggtgaaattatctgggaagaatcctgtataaaatcatttaacagcagacttacagatgatggggtatcacttaacggtgaggcaggaatattttttatgtatattccggttgatgaaagccagcctgtacaatgggttgagacaacatttccatttgagggaaaacttgatataaatggatgcagtgaggatatggtgagctttgtgcagtacagactcatcagttttacaatggaggcacgtccggactatgacggcgaaaacagggaaattgcagttgagatggtgcttgatttgtccgtaaggggatatgaagaaaggcaccagacggtgataaatgatatatattctcctgtaaaaaatataaccgtaaaatgtgatgagacaaaattaaagaagcttattgtcagaaataacggaaaatgccgtgtatcacagagggtaaagacagacagatatgccggtataatgcagatatgtaattgcagcggaactgcacagattgatgatatatcggttgaagaagatggaattgtaataaatggtgcagttatagcagctgtgttttatgtgacatcagacgacgctgtacctatgggcgggcttaaagctgtcgtaccgttttcatacaaattgcagctgacatcatgcaaggatatggattatacgcttgacatatgtgttgagcagctttcggcagtgatgacgacaaaagatgaaatagagataaagggaagtgtttcaattgatgccatttgttttgaaatgtatacatgtcaggcggcaaatgaatgtgaaataacagattatgatgagaaagagtacctggcacttccgggaattgccggatatatatctgacggaacgcagaatatgtggaatattacaaaaaaatatcacactacaatggatatgataaaacagcagaacagccagctttctgatattgatgatttaaattacagaccgccgagaggacagaaactgctgttaataaaaactccggccatctag

SEQ ID NO: 1212 - DNA, 861 bp, Unknown
  Artificiall/Consensus sequence
attatggcctcaatgagagacataaaaagacgtaaagactcgattcagagtaccggtcagataactaaagccatgaaactcgtttccaccgttaagctgcaaaaagctaaaggaagggcagagaatacaaaaccatatttcgatttgatgtatgagacagtccaaagtattctggcaaagtcaggacacattaaccataagtatcttaaagagtcagaatctgacaaaaaagctgtaattgtggttactgcaaacagaggtcttgccggcggttacaattccaatataaccagaatgattattgatgaaggttttactaaggaaaataccgttgtatatgctgttggtaaaaaaggacgtgaattgcttgaaagaaaaggatatgaaataaaagctgattattctgaagcaattaatgaccctatttacaaagatgcgaaagaaatttgtgatgatgtgctttcagcatttgcagatggtgaggtaggagaaatttatcttgcatatacagtattcaaaaatacagttgtgcatgaacctcagttaatcagactgcttcctgtagaggcagatgatgccgcacatgaaacagacggaagtgaagcacttatgacatatgaaccaagcgaggaagaagcacttgatatgattattcccaagtatgtatgcagcctggtttatggtgcacttattgagtctgttgcaagtgaaaatggtgccagaatgcaggcaatggatagtgcaacaagcaatgcagaagagatgatttcaactctgtcgcttaagtacaacagagcccgtcaggcatctattacgcaggagcttactgaaattattgcgggcgctaatgctatcgaataa

SEQ ID NO: 1213 - DNA, 1263 bp, Unknown
  Artificiall/Consensus sequence
ataatgagcagagtattagtaatcggatgtggaggcgttgcctcagttgcaattcacaaaatatgtcaggtgagtgatgtatttactgatttgtgtattgcgagcaggacagtgagcaagtgtgatgtgcttgcagaagaattaaagggaaatacaaagacaaacattacaacagcaaaggttgatgcggataacacagatgaggttattgcattgataaataaattcaagcctgatgttgttcttaatgttgcacttccgtatcaggatttaacgattatggatgcatgtcttgcatgcaaagttccttatgttgacactgcgaattatgagtgtgaggatacggataatcctgagtggagaaaggtgtatgaggaaagatgcaaacgcctcggttttacagcatattttgactattcatggcagtgggcttacagggaaaaatataaagaggcaggaattacgggacttttgggaactggttttgacccgggtgttacaagtgtatttacagcatatgcacagaaacactatttcgatgaaatacatacaatagatattctcgactgcaacggtggcgatcacggttatccttttgcaacaaactttaatcctgaaataaatctgagggaagtttctgcaccgggttcttattgggaagacggacactgggttgagattccgcctatgtcaatcaagcgtgaatatgattttgagggcgtaggaatgaaggatatgtatcttttgcaccatgaagaaatagaagcacttgccgcaaatattcctcatgttaagagaatccgtttctttatgacattcggacagagttatcttacacacatgaaatgcctcgaaaatgtaggtatgttaagaacagatcctgttgaatttaacggtcagcagatagttcctatacagtttttaaaagcacttcttccagatcctgcttccctcggtccaagaacagtcggaaagactaatattggctgtatatttacgggaattaaggacggaaaagaaagaaaaatatatatttacaatgtatgcgaccatcaggagtgttacagagaagtcggttcacaggctatttcttatacgacaggtgttcctgcgatgattggaacaatgcttgttgcaaaaggagtatggaataaaccgggagtatttacgacagatgagtttgatcctgatccatatatggacgcacttaacaaatacggacttccgtggaaagttgatgaaaatcccgtactggttgattga

SEQ ID NO: 1214 - DNA, 1185 bp, Unknown
  Artificiall/Consensus sequence
atggaaataaaaatgatgaataatttaaaacaaaaacttggaaaatcaatagaaaaccgtcgcgatgagcttacggcaatggctgataaaatatttgatttatcagaagtgagcggtgaagaatatcaatccgcagaacttctttgcagctatcttgaaaaagaaggatttgaggtggaaagaggaacgggatttcctacagcgtttcgtgctgaatggagaaacggaagcggaggtcctgtaatcggtatccttgttgaatatgatgcacttgaaaagataggacatgcatgtgggcatcatcttcagggaccggcagggattggtgcagcaatagcagtaaaagaatgtatgtcagagtatccatgcacaattgttgtgtatggaactccggcagaagaaactcttggtggaaagattgtgatgcttgataaaggatatatgaaagaacttgatcttgcatttatgtcacatggttcacctaatacttctgtagatgaaaaatgcatggcactggagaattttgttgtaacttttcatggcataaagagtcatgccgcaataagtcctgaaaagggcagaagtgcattagatgcggcacttttatcatttcatgcaatagaaatgcttcgtgaacatgtaaaagatgatacacgcatgcattatacaatccgtaatgcaggaggtccaccaaatgttgtgccggatttaacggttgcggaatatacacttcgatcttacagtacaaaatatcttgatgaagttgttgagcggttttataatataatcaaaggtgcttcgcttatgacggatacaacttatgaaattcaaagggaccttccgtttaagagtaaagttgtatgccataaggtaaacaatcttctgatggaaaatgcgtcatatgaaaatgcacctgcaattgcacctccgcgtgagaaaacaggctcaacagattttggaaatgtgctgtatgaagtgccgggttcatgtataagaattgcttttacacagcctgatgcacagccacattcacaggaatatcttgatgccggaaaatcacaggcggcacatgatgcaattgtttatgcagctaaaatcatggcggattcaataagtgatgtgcttactaatccgggacttttagaagaaataaaagaagagtttaatgctgcaaaagaaaaataa

SEQ ID NO: 1215 - DNA, 1824 bp, Unknown
  Artificiall/Consensus sequence
atgaaaaacaggatgttgtccaaaagagtatattttacagttagttcactgatgatgctggttctttttatgttccagttttcaggcattataagaaaaaagtacaataattttgacgaaaataaatatgctgtttcagaaaaaaatgatttgaacaataataatgtgtttacagttttgacagatgaagataaggtcgttaaaagcatcagcggatatattgtatacattggagatattaatacaaagacaggaaatacagtatacgagtggtgtaattatactaagcggaatctccttgtatacaaaacagtctcacaatatcacagatataatgagaaatatcccgatgccgttcttatagattcagattatgtaaacattgacagtgacatagatacattttctcttctgactgattatggaattaatcttgtattctgtacacttccatcttattccgcaatcagtggaaaccagcgttttgagcagttgtgcggaataagtccgcacagagaatctgtcaatgcttccggattaaagctttacagtggctttttacttggaggtgaggcatggtatacgaaagagaatgatcctgacggaaaattccagaatatgaaacttacaatgccatggtataacacaagcaatgcgacaaagacatacatgtctgctgtggttgaatcagaggatggaagtaagattgataatgaagaccagcctgcggttatctggcgaaagagccatgatcatgcatatgtattctgtattaacggagactatataaaagatatatcggggataggaatccttactgcaataatgtcagaatcaaaggatttagatatatatccggtagttgattcacagtcggtaatagtaaataattttccgatgttttcatttgaaaatgatgatgctgtagagaaatattatctcagaaatacaagttcgcttcttgaaaatgtaatatggcctgatatatctaatctggcagagtcaacaggtgcgaggtttacatttatggcggcaccacagattaattattcggacaacaatcttgtttctgtacgtgaaatggactattttttcaggcttttctcggagataagttcggaggcgggacttacaactacaagagatgatgcaacatccattgatgaaaaactgacagcagatgccggcattttttcaaattatttatcaaattataaatttacatccataattgcaaggaaagatgagcttgaaaatgtattatcatcgaaaaacagccttatagatgatgtaaatacgatagttactgattcacaggattatggtggtacaaaattattttcgtatgtaaatgataatgtgattaatgttgagtgtcctgtgacaagtgataagtatacatattcagatgatttcagacagagatgttttcagacggcacttgcatataccaatatagaatttaacatgacaggtgtatgtaatccggatgatgaaaaagagttgtggaatgaagagataaagttaaagtccacggcacttacttcatatatgaaaaattcaaagatgtttactaaatgcagtatttcacaggcagataaacgtatacgtgaatttatggcggcagattattcatataaacaaaacagatcatatgtaagtcttgatataacaggtgctcaggaaacggcacgttttattgtaaggctgcgtacaggggaagttgaaaatgtatcgggagctgtgtgtacgaaagttgaaaagggtgtatatcttattacagcacagtctaagcatgttgaaatgacaattaagacagaatag

SEQ ID NO: 1216 - DNA, 1854 bp, Unknown
  Artificiall/Consensus sequence
atggaagataataaagatttcaagacgcctccgagacgaggcagaatgggcggacctagaggcatgggaatggcacctgaaaaggcaaaagactttaagggttcaatttcaaaacttatgtcatatattggaagatataagataggaatatttgcggtaatgttatttgctgcagttgcaacagtatttaatgtaataggccctaagattctcggtaaggccacaacagcactttctgagggacttatgcgtaaaatagcaggtacgggcggaatggattttaactatattggaaaaattcttataattgtgctttgtctttatcttgtaagtgtcattttcagtttttgtcagggctggattatgacgggaatcacacagaaagtatgctatagacttcgtaaggaaatatctgagaaaatcaaccgtatgcctatgaagtatttcgagagcagaacatacggtgaggttctttcgagaataacaaacgatgtagatacgctcggacagggacttaaccagagtataacaacgataattacatcggttgccacacttgtaggtgtattcataatgatgatgagtatttctccgcttatgacaattattgctgtaattatacttcctgtatctgcaggacttatatcattcgttgtcaaacgttcacagaagtattttaagacacagcaggagtatcttggacatatcaatggtcaggtagaagaaacatacggcggacatcttgttgttaagtcatttaataaagaaaaagacatggtaaagcagtttgatgagactaacaacgtgttgtacaaatcagcctggaaatcacagttcttctcaggaatgatgcagcccatcatggcatttgtcggcaaccttggatatgcaggtgtggcattgagtggtggatttcttgccataaagggaactataacaatcggtgatattcaggcatttatccagtatgttaagaatttttcgcagcctataacacagattgcacaggttatcaatcaggtacagtcaatggcagccgcttctgagagagtatttgaattcttaggagaagaagaggaagaccagtttgcagctaatcctgtaaagttagatacaataaggggcgaagtagagttcagacatgtgcatttcggatacagggaggatcagacaattatcaatgacttttctgcaaaggtaaaaccgggacaaaagattgcgattgtaggccctacgggagccggaaagacaactatagttaagcttcttatgagattctatgacgttggctcaggtgaaattcttgtggacggtcataatgtaaaagatttcaatagaagagatttaagagaagcattcggaatggtacttcaggatacatggctttataaagatactattatggaaaatatacgttatggacgtcttgatgcaacagatgaggaagttattgaagcagcgaaagccgctcatgcaaatcatttcatagaaacacttccgggtggttataacatggagcttaacgaggatgcaagcaatgtatcacagggacagaaacagcttcttacaattgcaagagcaattcttgctgacaatccgatacttattcttgatgaagctacatcttcagttgatacaagaactgaacagcagatacagaaagctatggacaaccttatgaaaggcagaacaagttttgttattgcacacagactttcaacgataaaagatgcggatttgattcttgttatgaaagacggcgatattgtcgagcatggaaatcacgaagaattgctgaagaaaggtggattttacgctgacctttacaattcacagtttgaagaggcttgttaa

SEQ ID NO: 1217 - DNA, 1404 bp, Unknown
  Artificiall/Consensus sequence
atgccattttgcacagaaatggagataattaacatgtcaaaaccaataagtgctgataaacgcaaattaattcttgagggtaaccttattcaggctatccttatgcttgcaattcctgtaatgctcaacagtttcatccagtcaatgtacaaccttacagatacattctggcttggaaaaatcggaactgcttcacaggcagcaataacacttgtatctcctgtgcagaatatactaataaactttggtgccggcataacaaccgccggttcaattcttatatcacagtatctcggtgccagacaggacaagcaggccaattcaatggcaaaccatatttgcctgtgttcgcttgtatttgcagtaatatgtgccggaatatgctggattgccacaccgggtatcgtaaaatggcttggagctgaacaggacatttatcaattcagtatttcatatttaaggatagttgtacttgaccttccatttctttttatgattaacctgtatacatctgtaaaacagtcacaaggtgacactgtacgtcctatgcttcttaatcttcttggcgtatcactcaacctaataatggatccggtcttccttatcgtatttaaaatgggaatctccggagccgcacttgcaacacttattgccaaaattccaagtgccgtaattgcaatacttgcattaagacgcaaaaaccagcttatccgtcttgactttaaaaatttcaaatttgataaaaataaaatgacatctatatttaaaattggtcttccaacagcaatcggtggaagcacaatgcagtttggtttccttcttatgacaaaaaatgtcaatgcatatggaactacagctacaaccgcatacggtatcggaaataaaatcaacagccttatcacaatgccggcaagtggaatcggctctgctatatcaacaatagtcggtcagaatttcggagccaataatctcaaacgtgtaaataaatcatatcatatcgcattacgaatcggtgcagtatttctttttgtatttggtactatcctttcgcgtccatttatcgctgaaccaattgtacgtttctttacaagcgatgaaaatgttgttccgcttgcaacacaatttctgtcaatcatggcaatgtgctgctggactaatgctttttataacgtaacacagggacttttccagggttccggacatacattgataacaatgcttgtcgatgctacaagaatatggattttccgttttctcacattatgggtttgttcatcaatcctcaaaatgggagttgaaagtgtatggtatgctgttgtagtaagtaatgcgacatccgctcttattctttatattctttactggacaggaatttggaaaaaacgtactattaagattgagtaa

SEQ ID NO: 1218 - DNA, 1887 bp, Unknown
  Artificiall/Consensus sequence
tccggaggtgtcatagtgaaaataaaaaggcttcatattaaaaactataagtcgataaaagaacttgaaatagatgatgcacaggatgcacttattcttgttggaagaaataattcgggcaagtcagtaattcttgatgcaatccgtgttgctcttggcgataaaacagttaatatgccggattttaatggcccggagggaaatattataatcggaatggaactggagtttgcatatgaagacctgagttttcttcatggcaacgggattgttaaaaaaatgaaaaattatgatttgtggctcaaaagcttctgccagagactgccgtcatttattcctgatgaagagggcggtggaatattgacatttgagtatgtgtttgacaggaatggaaatgagaaataccgcgatggaataaagaaaaataatacatatataagaaatgtgcttccgagaatttattttgttgatcattatagaaataatattgatattttaaaagatattatgatgttttctaatgatgataactttgcggaatttaaggctgacagatgcatattcgacagtgcaaaaaaatgcagccaatgctttgactgtatgggcgtaatcaacagaaaaaagccgcaggagcttacacttgttgagacaagcagactcatgcagtataaaatgttcagcctgaaccttaacacatttgcggacaggcttaattcgtatttttcaaaaaacggtgggggagatttgaaaatccgttatgaaattaaatttgacgcggatgaactgtttaatatagaaacaatagttgaaaatccgtcaagaaaaacatacgacagttttgattcaatgggagaaggattcaggagtatatatattttgtcgctgcttgagacatatataaattctgataatgatacggcaccatatatcattatgattgaagagcccgagacatatcttcatccacaactacagaaaatcgccagtgagattttgtacagactgtcaaaaaagaatcaggttattttttcaactcatgaaccggagatgctttttaattttacaacaaaacagataaggcagatttactgcgacgaatttcatatgacagccgtcagaaaagatacagatatagatgatattttaaatgaccttggttttacggcaaatgatatgatgaatgtgagctttgtgtttattgttgagggaaagcaggacaggagcaggctgccacttcttcttaacaagtattattctgaagtatatgacgaaaatgggcgtttaaggcgtatagcgatcatttctaccaacagctgtaccaatatcaaaacgtatgccaatctgaaatatattaacactctctatcttaaagatcagtttatgatgattcgtgacagcgacggcaaggataaacagatgctgggaaaacagctgtgtcgctattatggtgagcgtgcaaaagaagataaagggaatatgccaagagttacggatagaaatgtacttatattaaagtattactcatttgaaaattattttctgtttcctgaaataatggaaaaggttggtgttgttaagagtgttgacgagttttatgatattttgtgggagaaatacaatcaatatttgtacaaactgacaagtgtaaagaaaatgttaagcaagctggatataagtattgattcacgcaatgatttaattgcaaatatagaaaatataaggatttatgtcagaggacataatctttatgatattttttacggaagattcaaggcaaatgagaatgatgtgctttcgcgatatatagaacttgcaccgagaaaaatttttgctgatattttagataaaattgatggctttgtatattttgactcaagaagaagataa

SEQ ID NO: 1219 - DNA, 1569 bp, Unknown
  Artificiall/Consensus sequence
ggtaaggtatttatgagtattttaaacgtagaacatctctcacatggttttggagacagagcaatcttttcagatgtctcattcaggctgttgaaaggcgaacacatcggattagttggtgctaacggtgagggtaaatccacatttatgaatataataacaggaaagcttatgcctgacgaaggaaaagttgaatggtcgaaaaatgtgcgtgtcggttatcttgaccagcatgccgtacttgaaccgggaatgactattggctcagttcttgcatcagcatttgattttctttacagccaggaagaacgcatgaatgaaatatgtgcaaagcttggtgatgtagacgaggatgagatgaattccctaatggaagaactcggcgtaattcaggacatgctcacaatgcatgatttttatatgatagattcgaaagttgaagaagttgcaagggcactaggacttctcgacctcgggcttgacaaggatgtaacagaattaagcggcggacagcgtacaaaagttttacttggtaagcttcttcttgaaaaacctgatattctgcttctcgacgagcctaccaattatcttgacgccgaacatatagaatggcttaaaagatacttaaatgattatgaaaatgctttcattttgatttcacatgatataccatttttaaacagtgtaattaacctgatttaccatatggacaatcagcagctcaaccgttatgttggcgactatgacaaatttcaggaagtttatgcgatgaaaaaagcacagatggaagcagcattcaacaggcaacagaaagaaattgccgacttgaaagatttcgttgcaagaaataaggcacgtgttgcaaccagaaacatggctatgtcacgccagaaaaagcttgacaatatggatataattgagcttgctgctgaaaaaccaagacctgaattttatttcaaacaagcccgtactccgggacgatacatttttacaacaaaagatcttgtaatcggatatgacaaaccactctcggttccactcaatatttcaatggaacgcggcagtaaaatagccatggttggtgcaaatgggattggtaagtccacacttttaaaaagtattcttggaataatacaaccggtttccggcgaagttgagcttggagattaccttgaaatcggttattttgaacaggaaagttctcctgataacacaaatacatgcctcaatgaaatatgggaagaatttccttcatacacacaatatgaagtacgttcggcactcgctaaatgtggtctcacaacaaaacacattgaaagtcagattcgtgtattaagcggtggcgagcaggcgaaagtccgactttgtaaactcattaaccgcgagagcaacatccttgtgctcgatgagccaaccaaccatcttgacgttgatgccaaagatgaactaaagcgtgctttaatggaatataaaggaagcatactgatggtctgccatgagcctgaattttacgatggtctggtaaatgaagtatgggactgcagcaaatggacaacactctcagtttaa

SEQ ID NO: 1220 - DNA, 1872 bp, Unknown
  Artificiall/Consensus sequence
ctgcttgacagtgaacagcaaagggcggtggagcacttcgagggacctgcgatgattcttgccggtccgggaagtggtaagactacagttgtcacaaacagaatactcaatatgattgacaattgcaaagttaatccggagaatatccttgtaataacatttacaaggatggcagcactccagatgaaagagcgttttttaaaactggcatcagaatcagatgtgcatgataatgcagaattatatgacgatgtgacatttggaacgtttcattctgtattttttatgatgctaaagaatgcaggagaatatgcaggatataatgttataacaccgaaagctcagagggcatttataagagaacagcttttatactataatattccgttgccgtcagatggtgagatggaagatgacatattaaatgatattgccaaagcaaagggatgcagcgagtctgctatatttaatccgacatcatgcgagaacgatttttttgaaaaaatatataatgagtacgaattatttatgaatcagtacaaatatattgattttgaggatatgatgattcgtacattacatatgttagagagtgacaaagagagtcttaacatatggcaggaaaaatataagtatattatggtggatgaatttcaggatgtttcaccggttcagttacggctgattaatatgcttgcacaaaagaaccgcaacatatttgtggtaggcgacgatgaccagagtatatatggtttcaggggtgcaaagcctgatgtgtgccgtatgtttacacagatttataaagaggcagagattttcaggctgaatatgaattacagatgttgtgagactatagttaatgcatcattaagtcttattaatcataataagaacaggttttataagaatctgaaggcgtttaataaaggtggtaattctgtggaatattataattttaatgatatttcaaaacaggatgattttgttacaggatatgtatataataaaatttataatgataccagcagtgattcagatgaaagtattgccatactgacaaggacgaatgctgaagcctctgaatttacgcataagcttcaaaaacatggccttaatatattgtactgtgggaatcaatcggatttttttgataagtgggttgtgaaggatgttattgcatatttacggatatcggtgggagattacaggagacagaactttataagaataattaacaaaccgcaaagatatataagcaggatgtattttactgatgaaaataccggttttaacacgcttgaagataatatcagatgcagaggcagcaaagaaaatcttgaagagattataaagcttcaatgccatgttaagaacatgaatacaatgataccgtttgcagcagttaattatgtgagaaaggtagtcggttatgatagatatttacatgaatatgcaagcgaacgtggtacagatgtaaagatatttcttgatattattgagaaattgcaaaacatttcaaagagttttgataatttaaagcagttcatagaatatgttgataatgtatcggaagataatgtcaatgatgcagatggtcttggaaaagctgatgaatcaaagacacatttatgcagtgtatctacgatgcacagggcaaaaggactcgaatttgataccgttataatagtgagtgccaatgagaaaaatataccatattgcaaggctgtgtctttagagcagcttgaagaggaacgcaggcttttttatgttgcactgacaagagcaaaaaagaaacttattatatgttcggtgcaaaagcagtataacaggaaaatgcagtcctcacgttttataagagaactgcatctttaa

SEQ ID NO: 1221 - DNA, 2100 bp, Unknown
  Artificiall/Consensus sequence
atgaataataaaaagattttcagtgtaaaaatgttctggcagtcatttttgcagttaaaagtaataggttttatatcaacgatattaatggtgcttataacatgcgtgccaatttgcataagtgcagttaatattaaatctaatattgaatatgcaggcgttgaaaaggcatcaagatatgttcagcttgttgatgggaatgattttatacctatactgattcttacatttgcaataataacaccggttcttgttttatttgcgtggaattttcttaataaaagaaatacaagtgatttttatcattcgcttgcttatacaaggctgaatctgtatcttactaaaatagcagcctttgtattatggattctgattatgtatgcatcaatatttttgtcagctgcaattttatataaaatatttaaaacatgttatattgtaaattatggctctatacttagtgtgtttttctcggaatttatatgctgtctgttatgtgcggcagcagcaacacttgcttgttctataacaggaaatatattcagtaatatatgtcttactggacttatattgttttttccaagatttataatattgatggttcaggtgacagttgtatcaatagtatattttgcatcatcagagcattttgtttcaattcttgacaatagctataatatgattgttggtcaggtgttcagtgtgtttacaggttcgtcattagatggtgtaattaatgtagcacactcaaaaatatacacatttgttcttgcacttatttattttgttaccggttgtctgctttttataagaagaaagagtgagacggcaggaaaacctacactgtcttggaaactgcagtttgtaatacgtacagttatcggattttcaataagtattattggtgtgatttcatttgtgggtgcagtaagaaatgcagatatagaaaagtcgcagagtatattatatgtagttataacgttcattgtggctgcggttgttgttatagtatatgagttgattgcaagcagaaaaacgcaccgtgtgataaaagcaatcccttcaataattactgcatatgtgctggcagctgtttttggtgtgattgtaaatatcggaattggcagtatgattaattatcagccggatgcatcaaagattaagtatataaaaataaatacaggaaatggttcatatgtttatgataaagattatttttcagatgtattttcacaggtaaaaattgacgacatagatgcaattaattcaattgttaattcaatgaaagataatatggaaatatataatacttctgatgaatattcagcaatattccagaatggcgattacagcccggttactgtatatattaaggatggcatttggggaagatacagaactgtatatgtcaaagaaaaagatatacagacaattataaatggagcagtgaagaatgatgaattctgcaaaaaatataaaaagcttccgcagtatgaagaagctgtaataagctggtcagataatatggccgatgaggacagtaaaaaattatataatacatttttagatgaagtgtcaaaaatgtcatttgaggactggtatcttacagttaatggaaggaaaagaggtgtatcactggcttatgttgatatatcattttcacttaatggaactaaatatacttcagaagtattaatcggagataaaatgccaaacacgcttcaggcatacatgaatgcggttaataagtatgtggcagaaaataaaaaggattcttatgaatcaatgtgtaattatcttgataatattgagacagagaaaaataaagataattatacatgctatatatcagtctatgatgtagaaaataatactcaatcacgaatatggtcagaaaatatggacggcaataaaattgttcctgatttgaaagaaaacctgaaaaacatttcacctgagaaaaaatttgatttgacaaaaccggtaattgaaataattttctatggaaacaggtcaggggggtcatttagttatttcttccagatggatggatatgattctttagatgattttaacaatctgggtccaattggattgtaa

SEQ ID NO: 1222 - DNA, 2691 bp, Unknown
  Artificiall/Consensus sequence
atgatgagtaaaaagttaattttgattgatggacatagtattttaaacagggcgttttttggaatacctgatttgactaattcagaggggattcatactaatgcgatgtatggtttccttaatattatgtttaaatttatagatgaagaaaagccggattatataactgttgcttttgatttgagcgagccgacattcagacataaagcatatgaggcgtataagggaacaagaaagcctatggcacctgaattgaaacagcaggtaccgcttatcaaagaacttctccgcacgatgaatattacagttatagaaaaagccggatatgaagctgatgatattattggaactattgcaaaaaggagtgcagcggttggaattgatgtgtctgttatttcaggtgacagggatttactgcagctggcagaagataaaatacagattcgtatacctaagacaaaaaaaggtgtcacagaagtagaaaattattatcctgaggatgttgtggcactttatggtgttacaccgcttgaatttattgatatgaaagcacttatgggtgatacttctgataatattccgggagcaccgggagtcggaccaaagacggcatctgcgattatacagaagtatcactccgttgataatgttctggcacatcttgatgaattaaagccgccaaaggcacaaaagtcaattacagaaaatgctgaacaggtcaaaatgagtagattccttgcggaaattaatataaatgttccgctggattataacatagaaaatgctgaaataggagatttctataatccggcctcatatgaattgtttaaaaaatataattttaaaacaatgctcaaaagatttgacaaagatatgacagcagctccaaaggctgatgttctgaaagatattgttgtaatacaggaattgggcgattctgaaaatattataaaaaaagcttgtgaagttataaataatggcggaaatcttggattgtcaattattcatgaagaaaaatgcatatatggtcttggaatctgtctttcggaaaaagagacatattttataataaaacagggatttataacagatgaatatttaaaagatgccgtacaaaaattaggtgtactgtctgatgcaaataaaaaaaggcagatacgtgtatttgatttaaaggaaattctgtgggcgtttgaaaaagatggaaatcttaggatttcgcaggatgcttttgttgatgtaagcatagcttcatatctgttaaaacctaatgatgaaaattatgagccggagcagattgctttacagtatcttaatataacatttccttcaaaatcggagctgtttggaaaagcaggagtgcaggaaatgcttatgacaaagctggacgaacttgcagaatatgcatgtgaatcagcttatgtgagtctttttagtgctgatttgatattaaaagaacttgaaaatgaaaatatgacagagctttttgctaatatagaaatgccgcttgtgtttgtactttatgatatgcagaaagagggcgtacgcgttgataaagaggggctgaaatcttatggtgaagttctgggcaaccgtatacaggtacttgaaaaagaaatatacgatgaggccggtgaagagttcaatataaattcaccaaaacagcttggcattattttgtttgaaaagatgaacatgccgtacaaaaagaaaacaaagagcggatattcaactgctgccgatgtgcttgacaagcttgctcctgagtatccgtttgttaaaaaaattcttgagtacagacagcttgcaaagttaaaatctacttatgcagacggtcttgcagcatatataagcgaagacggaagaattcatggcaaattcaaccagacaataactgcgaccggaagaataagcagtacagagcctaatttgcagaatataccgataagaatggaacttggacgacagattagaaaagtatttataccaaaagaaggatgtgtttttctggatgccgattattcacagattgaactaagaattatggcacatatgtcaaaagatgagaagcttattgaggcatataatatggctgaagatattcacaggataacagcttcacaggtatttggtgttccgtttgatgaagttactgatttgcagcgaagaaatgctaaagcagtaaattttggcattatttatggtatcagttcatttggattaagtcaggatcttagtatttcaagaaaagaagcatctgattatattgagcagtattttaaaacatatccgaaaataaaaggatatattgattcgatggttgaagatgcgaaaaaaacaggatattcacttacaatgtttaacagaagacgtcctattccggaattaaaatcaagcaattttatgcagcgttcatttggtgaaagagttgcaatgaatgcaccgattcagggaactgcggcagatataatcaaacttgcaatgataagagtatatgatgcgttgaaaaaaggcggatacaagtcaaagcttctattgcagattcatgatgaacttcttgttgagacttatcctgatgaaatagaagatgtaaagaagataattgaggacggaatgaaaaatgcagttaagctgtctgttccgcttgaaattgatatgaaacagggaaataactggcttgaagcacattaa

SEQ ID NO: 1223 - DNA, 1179 bp, Unknown
  Artificiall/Consensus sequence
atgaaaaagaaatttatgagtgttatgcttgcggcaacacttgttgtttcattggtgggctgtggtaagaagaataacaataatactgcaacagatgctgatgatacatcaaacaaagctattacagcagaggaatataatgcaacaattgcatcgaatgcagcggtttataagaagtacattacacttcctgagtataagggaattgcagtgtcagttgataagtcgtcacttaccgtatcagatgatgatgttgagacttacataagcaatattttatcttcatatgctacttcagagcaggtaacagaaggaacaactgcaagcggtgatactatatcacttgattacagcggtaagcttgacggtgttgcattttcaggcggaacagcaacagatgtatcatacacaatcggttcaggcaagttcataacagaccttgaccagggacttgtggggcttaatgtaggtcaggaatatgatattccatgtacattccctagtgattacagcagttcggatcttgcaggaaagagcgttatatttacagtaacagttcattctattacaaagaagacaattcctgaacttacagatgagtgggttgctgctaatgcagagagcatgggaattgaaggaacaacagttgaagctttaagaaaagaggcaagagaatatcttgagaattcaggaaagagcacatatgacagcaataagtacagtgctgtttacgaggtaataaagaaagatataacagttaatggatatccacaggcagagttagacagcttaaagtcaattcttaaacagaatatggaagcagaatataatcagtatcagtcatattattcagcacagggtatctcagatttttcttcatatctctcaagtgtatacaatctttctgatgatgcagcatatgatgattatgctacacagacagcacaggaatatcttcttgagaagatggttcttacaataattgcagctgataacggaattgatgtaagtgcagatgatattaatgaaatcggtgctacatatgcaagctattatggttatacagattatcaggagattcttgatacatatggcaacgagatgaatgcagaactcggatacgagaagcttagcgaaaaggttcagagcttcttaaatgataattcagtagaacagtaa

SEQ ID NO: 1224 - DNA, 1215 bp, Unknown
  Artificiall/Consensus sequence
atgtttaagattaatgacaattatctcaaattgccgggaagttatcttttttcaacagttgcaaagaaagctgccgcattcacggctgccaatcctgacaagaaagttatcaagttaagtattggcgatgtaacacagcctcttgcacctgcaataatcgatgcattgcataaatcagttgatgagatggctcacgcagagacattccgtggttatgcacctgatttgggatatgaatttttaagaagcacaattgctgaaaatgattacaagagccgtggatgtgatatttctgcagatgaaatttttgtaagtgatggtgccaagtctgattctggtaacattggggatattttctccgtagataataaaattgcagtttgtgaccctgtatatcctgtatatgttgatactaatgcaatgtcaggaagaacaggagattatcttgttgaccagcagaagtggagcaacgtaatctatatgccatgtacagaagcaactaactttgcacctgagattccaaaggaaacacctgacatcatttatctttgttttcctaataatcctacaggttcaactatcacaaaatcacagcttcaggaatgggttgattatgctaataaagtaggtgctgttatcatatatgatgcggcttatgaggcatatatttcagaagatgatgttccacattcaatctatgagtgtgaaggtgcaagaacatgtgccattgagcttagaagcttttctaagaatgcaggatttacaggtttaagacttggatttactgtaattcctagagatttaaagagtggtgagacaacacttcacagtctttgggcaagaagacacggaactaagtttaatggtgctccttatatcgttcagcgtgcaggcgaggctgtatattcagaagctggcaaaaatcagacaaaagagcagattgcttactatatgaagaatgcaaaggttatcaaggaaggtcttaaagaggctggatattctgtatcgggcggtgtaaacgcaccatatatctggttaaagacacctgataatatgtcatcatgggatttctttgattatcttcttgaaaaagctaatgtacttggtacacctggttcaggtttcggtccaagcggtgaaggatacttcagactgactgcatttggttcatatgagaatacagttgaggctattgaaagaatcaaaagaatgtaa

SEQ ID NO: 1225 - DNA, 2169 bp, Unknown
  Artificiall/Consensus sequence
atgacagatttaaaggccataaaagatgatctggtttttggactggatataggaacacgaagtattgtcggagttgttggatacctttcacatcaggtttttcatgttgtggcaatggctgaagaaaagcatgcaacaagagcaatgcttgatggacagattcatgatatatataaagtcggtgatacaatacgacgggtaaagaacagtctcgaaagacagatcggttttgctcttacagatgtttgtattgcagcagccggacgtgtgttaaaaacagtaaatgcatcggcagagtatgcatttgaaaatgagacgagggtaacgcaggaacatatttattcacttaatcttcttgcggttgaaaaggcacatgcacaggttaatgaaaacagtacggatatacattattactgtgttggaaatacacccgttaactacaaacttaacagttttgatataagtaaccttgagggacataaagcagaaaaaatcggagttgaacttattgcaacatttcttccagaggaagtcgttgacggactttatcaggcagttgaatatgcaggacttcatgtggcaagccttacactcgagcctattgcggctatgaatgttgctattccggaacagtacaggcttcttaatatcggacttatagatgtcggtgcggggacatcggatatatgtctcacaaaagatggaagcgttatagcatatggaatgattccacttgccggtgatgagataacagaagttattgcaaagacttatcttgttgattttaatactgctgagcagattaaagttgaagcaagtgataaaaaagaagggattgttgagttcaaggatataatgggacttacacagaaaattccggcagagcagatacttaaagattcggaatctgttatagataaaatggctgatgctgcagcccaaaagataatagagcttaacgggaacagacctgtaaatgcggtatttgttgttggcggcggcggaaagatggcaagctatacacaaaaggtagctgaacatctaggcattatggcagagagagtagctgtgcgtggagaagaagtactcggttcaatttcatttgatattgacggatttaaaaaagattcattatatgtaacaccaatcggaatatgtacgaattattacacacagaaaaacagttttatgtttgttactgtcaatggtgagagaataaaaatgtatgataataacagacttacagttgttgatgctgttatgcaggtaggttttcctaatgaaaaactattcccacagagaggcgaacagcttgagtttactgtaaacggaaagacacgccttatacgtggcgaggcgggcgatggtgctgttattatgattaatgggaaaaatgccaatctcaatacaaagattgagcagaatgatattatagaagttaaagaatcaacagcaggtgcgaaagcgtcaacaacaatcggccagcttgatgaattcaaggcgactgtttcatttatagtagatgataaaaaagtaaactgtccaagatttgcatatgtaaatggagagttgaaatcagagttttatgagataaataatggcgatgatatttctatggctgatttttacacggttgagcagttgtttacttttcttgatatggatatgtcaaaccttaatatttatgtaaataatgagccggcacaaaatgatacaaaagtatatgaaaacttctctgtaaagacacacggactttctgattatacagtatcatcgggttttgatgatgaaacttattcagaagctgaagatgtacaagaaaatgctgaatatgctgaatatgcagaaaatacagagtatacagaatatgcaaagtctcatgaggataaagcggtcaaagcaggagccaatactgaaggaaatacagtgcaggaagaagttaagcagagtgatgatgttgtaaaagatatatttgttcttataaatcatcagccggttaagctttctggaaagaaaaagtatgtgctcgttgacatatttgatttttatgattttgacctcagcaagccgcagggctcggatgttgttttaaaacttaacggacaaaaagcagattatcttgcaccattaaaagatggtgatttgattgacttatactgggagggctga

SEQ ID NO: 1226 - DNA, 1371 bp, Unknown
  Artificiall/Consensus sequence
atgggatttttaaagtcagttaagaatatcttctttaaagatgaaatagaagatgattatgaagaatatgacgaatttgatgaagaactgaataagcatgccagaacaataaagtcatatcttgatgaagaggattatggcaaagaaaacgaagacactgataatcaggaatttgatgagtatgatgagagttcaggatatgaaacgccggaagatgatgagggctttgacggcttcagcgatgatgaactgcttgtgggtgatgaacgtgataacgtaaaactgggggcttttgatggaagtgacctgaaggaatatgttaaaggccagtgcgagattatggaagatgccggaaggcatattgaaatgataatggaggagtacagtcaggtatcagagagatttgctgatattgaactgtatgaaaatgcaccggataatctgaaagaccagattgcagaacaggctgaacttgttgacaatcttgcggttgacaggcggattcttaaaaattccgagagcaagctgtctaataatgcatataacagaatggacatgtatgcacaggaacttcctaagagttttaggtttatacagcagcaggaaacatattatgagacagtgaaaagagatttacagtctcttgagggcgagaggatggctcttagaatggaagccaagaatctgaaaaagaaacatgctgcaatcaaaaaggctgcaattatagttcttgcctgtcttgcggtagtttattctatttttacaatagttatggttgcacttgataatgaagatgagttatatttattctttgttgtgacatttcttggtgcaatagttgctgtgggaatatttgcatggctgagtattattcacagacaggcatcggcagtcgaaataaagataaataaaattacggcggcattaaacaagataaagataaagtatgttaatgcggcaaatgtgctttcatatgaatatgataaatacaaaataaagagctcatatgaacttggaagaaaatttgaattatatcttcagatgaaagaagaaagaaagcatgtactgatgatgacagctaatcttaatgatgcagaaaataagctgcttatgcttctgaaaagaataggaatttcagacacagttgtatggctttcacagaccaaaggactatatatacgcaatgaaatggttgaaatcaggcatgaacttgcggcacgtcgtaagaaactgagaaatcagattgagtataatgaaggcaggattgaagaagcaaaatataacataagaaaagttaataaattacatccggagtatacaaaagagactttggaaatacttgatgaatatgaaaaaaggtctataaattaa

SEQ ID NO: 1227 - DNA, 552 bp, Unknown
  Artificiall/Consensus sequence
atgcccggtttcaaacaggagcggcctgtccgcccggaaaggacagctatggaacaggaatatttcatgcagcaggccctcgctctggcacaggaggccgctgtccacggcgaggtgccggtgggctgcgtcatcgtccgcaatggcgagatcgtgggccgcggccgcaaccagcgggaggaaaagcaggccgccgtctctcacgcggagatggaggccatcgcccaggccaatgcggcgctgggcagttggcggctggacgagtgcgacctgtatgtgacgctggagccctgccccatgtgcgctggggccattcttaacgcccgcatccggcgggtgtactacggcgcccgggatgaggtgatgggcgcctgcggcggcgtgctgaatttgtttatggagggctttccccgtccgccacagctggtgggcaatgtgtgcggcgacgaatgccgcgacgttttgcagacctttttccgggaagttcgggagaaaaacgccgagaatacgaatcgttcggcagacattgttgaagatttcacagaattttaa

SEQ ID NO: 1228 - DNA, 864 bp, Unknown
  Artificiall/Consensus sequence
atgtggatcgcgaaggattggaaggattatgagctgctggactgcggtggcggcgaaaagctggagcgctgggaccggcaggtattggtgcgccccgatccccaggcgatctgggagacggacaagaccacgcggctgtggcgcggcgcaacaggacgctattcccggtcttctaccggcggcggtcattgggataaaggcaagctgccggaaagctggcaggtgcattacaaagacctgacatttcaggtgaagcccatgaacttcaagcatacgggattgttcccggagcaggcggtaaattgggatttcgccatggacaagatacggcatgccggaaggcctatccgggtgctgaacctgtttgcctacaccggtggggccacggtggcctgtgcgaaggccggggcttctgtgtgccatgtggacgcggccaagggtatggtggcctggggtaaggagaacgcccgtctatccggcctgggcgaggcgcccatccgctggatcgtggacgactgcgccaagttcgtggagcgtgagatacgccggggcaagacctatgacgccattatcatggatccgccctcctacgggcgcgggcccggcggcgaggtgtggaagctggaggacaatctgtatccctttgcggagctgtgcagccgggtgctgtcggacaagccgctgttcgtggtattgaacagctataccacggggttggcgccgtcggtgttggggtacatattgcagctgctggtagggcggaaattcggcggcacggtcacatgggacgagctgggcctgccctgcacggacagcggcatggcgctgccctgcggcgccacgggaagatggttttccgagtaa

SEQ ID NO: 1229 - DNA, 711 bp, Unknown
  Artificiall/Consensus sequence
atggtgttgctgcttcgcaaacgacatctgctgacagttgtggccgcggcagcgttgtgcggtgcactgctgctgaccgcgcgtcccggggcggcggccgttttgggcagcgcttcgccacagcgggcggtcatcttggatgccggccacggcggcgcggacggcggggcggtgtcggacagcggcgtggccgaaagcggcctgaatttggccattaccctgcgcctggcggatgtgctgaccttctgcggctatgaagtgctgctgacccggacaggggaggcagccctatgtgacgatcctgccgctacgctgcggcagcagaaggtatccgacacgaaaaagcgtgtggagatcatcaacagatgcgctgacgctcggctcatcagtatccaccagaacagcctgccgggtcatcccggtgtcagcggtgcgcaggtcttccataacggacaggacggtgcagaagcgctggcgctgtgcattcagaacgatctgaatatggctgttaatacccgggaaaaagcagcaaagcgtatcgacgacagcatttacatcatgaagcatgcggactgccccgccgtgctggtggaatgcggatttctgtcaaacccggaggagacggtgctgcttcagcagccagactatcaactgcacatggccgctgccatcgcagcgggtttttgccaatactgtacaaatgagggatga

SEQ ID NO: 1230 - DNA, 969 bp, Unknown
  Artificiall/Consensus sequence
atgcacatcggaaacgtagagatcaactcccagctgtatctggcgcctatggccggcgtcaccgacatggccttccgccagatatgccgcgagctgggcgccggtatgagctgcacggaactggtcagcgccaaggctctgtgctatcaggacaagaaaagccggggccttttgaagctggcccccaacgaaaagcccgccgctgcccaaatcttcggcagcgatatcccctgcatggctgaagccgccgtcatcgccgccgagatatccggcgcagatattatcgacatcaacatgggctgcccggtgggcaaggtagtggccaacggcgacggctctgccctgatgaaggatccggagaaggctgcccgactggccgaggcggtggtcaaggccagccccgtacccgtgacggtgaaaatgcgccggggctgggacaagggcaacatcaacgcggtggagctggcgaaaatgctggagcaggcaggcgtcagtgccattgccgtccacggccgcacccgcacccaaatgtacagcggtcaggctgactggaccactatccgccaggtgaaggaagcggtatccgtgccggtcatcgctaacggcgacatcttttcggcagaggacgccgtccgcattttacagttcaccggtgcggacatggccatgatcggccggggctgtttcggcaacccgtggctgtttcagcaggcccaggcagcgctggagggccgtcccattcctcccctgccgccactggcggagcgctgggacaccgccgtgcgccagatcgaactggctgtggaggacaagggcgagcacatcgccctgttggaggcccgcaagcagctgtgctggtatctcaagggcgtgagccacgccaactactacaaagaacagatcgtccgcctgaccacactggaggagctgtaccgggtggcggcgggtgtcaggagggatctgcgatga

SEQ ID NO: 1231 - DNA, 609 bp, Unknown
  Artificiall/Consensus sequence
atgggtgcgaaaaatacgacgcgggaggcgcgggatatggaattgcagtggtttgacatccgggagttgacggaggacgcggcccagaccgtgataggcatgatggatgagacgcggcggcggcgtgtggccgacatcgccggtgaggacgaccggaagcgcaccatcgccggagagctgctggcgcggcggatgcttgcgcagacgatgggctgcgcggagaaggacgtaccgcttcagtgggacgagctgggcaagcccagcgtggaaaaggatggcgtgtatgtgtccgtgagccactccggcccgtgggcggtatgcgtaacggcggacgtgccggtaggcgtggacgtggaggtggtacgctcggcccaggagaagttcatgcgccgggtatgcagcgagcaggagatggcgtacatacggtccggggacgacggcgactgccagcggttctgggagatatggacggccaaggaggcgctgttcaagctgacgggcaagggtccgctgctggcgctgagccgcttcagcctgccggcaggcgtaacgctggactatacggcacaaaagggctgcgccctcaccatcgcggcgcagattttgtga

SEQ ID NO: 1232 - DNA, 846 bp, Unknown
  Artificiall/Consensus sequence
atggtccagctgccccaggaaaacagcatatttgcccgcaccgtgcgccgcgccgccggggaggaccgtctcagccacgcggtcatcctgacgggccggggtgacctgaccgccgctgcccggtttctcgccgccgcccacgtctgcgaggaggcggacaggccctgcctgcgctgccgccactgccgcaaggtactggagggcatccacccggacgtgatccccgtgctggatacagagcacaaggagctgacggtggaggcagtccgcgccctgcgtaaggatgtgtacatccgccccaacgaggcccggcgcaaggtatacgtcatctctgactgccgccagctgaaccagcgggatcaggatgtcctgctgaaggtggtggaggagggaccgccctatgccgctttcatcttctgcgccgacgctcccgccgccctgctggagaccgtccgttcccgctgtgctctgctgaaatacgacggggaagacgcgcccctcagcgacggtaccgcggagctgtgccgtgcgtttgcctccgggcgtctgctgccggtgaccacggcgctgctctcccgcgagcagtccctgaagcgcgagacgctgcaggcccagctggaggagctgtggcgcgccgcggccgaagccctgctggtgcagcagggcaaggcgcggccagatccctcctgtgcggaggcagcccttctgctggcggacaggctgacggcgcggcagctgctgggactgtgcgcggccagtcagcgctttgccgaacaatgtgaccaaaatgcgggcgtgggccagatattgggcgccctcgccgtgaaatgggaggaacttttatga

SEQ ID NO: 1233 - DNA, 525 bp, Unknown
  Artificiall/Consensus sequence
tcgtggggtgagcacatgaagtggacagcaaaaaacatcgccctctgcgccgtgctggcagcgctggcgctggggctcagtaccctggaggggctgttccccatctccctgctggtgcccctgcccggcgtgaagctgggccttgccaacatcgtcacggtgttcgccctgtatcagttgggtgccggcgcggcgctggccattctgctgacccgctgtctgctgggcggactgtttgccggaaacctgtcggccatgctgttctccgtgctgggcggactgaccgccatgctggtgatgatattcctgcggcgtctgccgaagctcagcgtctacggcgtgtccatcggcggcgcggcagcgcacaacatcggccagatggccgcggcggtcatcacccttggcagcaccatggtcctgggctatctgcccttcctgctggccgtgtcccttttcaccggtgcgctgaccggcttcatcactgcgcttctgctgcgtgccacgcggcatatccgatttcactga

SEQ ID NO: 1234 - DNA, 351 bp, Unknown
  Artificiall/Consensus sequence
aaggcccgggacggtgcgtttgatctggacggcatatggcagaaaacggacggggaggtgatccgcgaactgagcagtctgaagggtgttggcatctggacagcggagatgatcctgctgttctgtatgcagcggcccgatgtgtttagttacgacgatctggctattcagcgcggactgcggatgctctatcaccaccgcagcattgaccgtaagcggtttgagatataccgccgtcggtttagcccgtatggcagcgtggcgagcctgtatctgtgggcagtggccggcggagcgattccggagctgaaagatcataatccgaaaaagagtgtggagggaaagagatga

SEQ ID NO: 1235 - DNA, 729 bp, Unknown
  Artificiall/Consensus sequence
atgaatatgtttttgaccctggcttacctattcttcattggctccaccctgggatgggtggctgagctgctgtaccgccggtttctctccggcgcaaacccggagcgcaagtggatcaatcccggcttctgcgtgggtccctatgtgcccctgtacggttcgggcctctgtattctttatctgttggcctccatcggtgaaaaaaacggtgtggatacggtgggggagaagctgctgctctttgcgggcatggccctgagcatgacggctatcgaatatatcgccggtatcgtcagcctgaagttcatgcacatccgcctttgggattacagcaagcagtggggcaatatccagggtctgatctgcccgggcttttccgtcctttgggcggcggtcagcgccgtgtactacttctgcgtccatccttatatcctggacgcgctggattggctgtcccgcaacctggccttctcatttgtcatcggctttttctttggcgtgtttaccatcgatctggtctattccgccaagctggtgtcccgcatccgcaagttcgccgacgagcatgacgtggtcatcaaggtggagaacctgaaagcccacatccgccagcgtcaggaggagcgccgcgagaagtacagcttcctctttgcctaccgctcccgcagcgagctgctggagcatctgcgcgaggcgcaggagacttgggaggaaagacgccgcaagtga

SEQ ID NO: 1236 - DNA, 363 bp, Unknown
  Artificiall/Consensus sequence
agccgcccccgtttatccaataaaaaggagtgtatcgctatgatgaagaacctcaatgtggccaccgtgctgaccctgcgggatcaggtggcctatcagccggggcaggtggtcagcaagacgctggcccagaacgacgccgtcagtgtgacgctgtttgccttcgacaaggacgaggagatcagcgcccacgagtccggcggcgacgcgctggtgacgtgcctggacggcgtgggccgcgtgaccgtggacggcgtaccccatgtgctgcacaccggcgagtccatcctcatgccggcgcggcatccgcacgcggtgtatggacaggagcaattcaaaatgttgctggtggtcgtattctga

SEQ ID NO: 1237 - DNA, 501 bp, Unknown
  Artificiall/Consensus sequence
atgtctctttctcctttatgtaaattttttgtcgacgtgagggggtgggcggggatgcggcaacatccccgccccacttatggaaaagcacgcggccaatggccgcctcagcttgacaaaggggactcgtctgcacagtttcacggtcagatggaaagcgcacggcgcctcagcttgacagtcgagttttccgcaccgcttcgctgcatacggcagcgctacagcctgacaaggagagtatttttcatgcagggcatgaaaaacaggacagagtgcactctgtcccgcgaaaatgaaacgctgcccggcgcaaagccggacagcgaacgcaatagatacgacccctgcaccacggaaagacgccgccgcccccgccgcccgcccaaaagggccggccgcgaaaaaggcggcgcaaaaaacaccgacctcccgttcaggaggtcagcgtggtacatctacatggtggtacaagattcccgcacacggagagcgcgcccgctg

SEQ ID NO: 1238 - DNA, 684 bp, Unknown
  Artificiall/Consensus sequence
atggcacggtatgcgccggacccggcgcagcgggtgacggtgtttctgggcgaggccgggtgcggcaaatctgagctggcggtgcagtgggcgctgacggcggcggagcgtggacgggatgtgcatttcttcgatctggaccagacaaagccactgctgcggtcaagggacgcggcggcccttttggagggcgcgggggtgacggtgcacttcgagcagcagtgtgccgatgcgcccacgcaggtgggcggactggtgccgctgctgctggacaagagcaagagcgtcattctggacgtgggcggcaacgatacgggtgcgcggctcatcggcggatacgcacacctgctgaagagtgcggatgcatggttcgtggtaaacccgtaccggccctggtcggggacggtggcgcacatcgacgggaccctgagcgccgtgctgaaggcggcgcggctgggcctgccgcgttttttgctgaaccccacgctgggcatcggcaccacggcggaggaattcttagtgggtgtggagcaggggctccggctgctgacgccctatgtaaaggtggaggcggcggcggtgtcggagacgctgctgccggaggtcgagggccggacggagctgccgctgctgcccctcacaccgcgaatgaccgtcccggagacgggacttgatgaaggataa

SEQ ID NO: 1239 - DNA, 360 bp, Unknown
  Artificiall/Consensus sequence
atgcttccacttgcgttttctccagctttcgggtatactatagatataaagacaaaggaggactctcccatgagcgaggaattcggccccaacttcatcaccctgaccgacgaggacggcaacgacattgaactggaatacgtggacgcgctggaagtggacggccagacctacatggcgttcttccccgtggtggaggatgatgccgacgaggaagccgccgaggagtacggcctggtgatcctgaagtccgttatggaaaacggcgaggagctgctgagcaccctggacagcgacgaggagctggataaagtctacgacctgttcatggagcagatattggccgacgaggacgagtga

SEQ ID NO: 1240 - DNA, 873 bp, Unknown
  Artificiall/Consensus sequence
atgagtggtaacaaaaaattcccccgcacccacaccggccggctggccgccgatatggtgctgcggtactatacccacgacgtagcccgggacagcgcggcgctgacgtattatctgctgttcgccatcttccccctgctgatcttcatcagcaccctgctgggtctgctggagctggacgtagcgtatatcacctccgtactggagccgctgctgccggcagatgtggtggatgtggtgcgctcatatctggagtacgtctccgccaaccagagccgtcagctgctgtggttcagtctcatcttctccatctggttccccatgcgggcctccgggtgcctgatgcactcgctccgcaaggcctttggccgcagcgcgccggagagcttgtggcgcagccagctgcggatcctgctgttcaccgtatggctgatcgtcgttatcgccgtgacgctggtgctggtggtggtgggacggtccgtgctggagtttgtcggacggttcatcaccatcaccgactcgttcatcaccgcgtggagttccctgcgcttcgtgctgctggcggtggtcatggctatcacgctggtgatcctgtatatgctctcccagggccagcgccggccgctgcgggaggtactgcccggcgtgggcggttcactggcggcgtggatggtgctgagcatggcgttttcgtactacgtagagcacctgggccgctactcggtgctgtacggctccatcgccacggtgatcgtggtgctgctgtggctgtatatgtcgggacagatactgatactgggcgcggagtttgccgccgccctgctggaaaagaggcagaccgccgccccctcgggcggagaggaggacgcatga

SEQ ID NO: 1241 - DNA, 1062 bp, Unknown
  Artificiall/Consensus sequence
atggaatttttcaaaaaacgcggcgtggcactggtggtgctgatgctggccattgccggcgcggtgttcatcggccagagccgcaaggacggctttatcgccaagaagcccacggagctgctggacgtgcagtaccaggactggatctgtgacgaggccggtctgctgaacggacagacggagcagctgatccgggactacaacgacagctggaacagcaagtattacgccattacggcggtggccagcatcgaccatctgaccggctgggacgcggaggattacgccgccaacctgggcgagaagtgggggctgggacgcaacgacatgatactgctgctggtgaaggacggcgactggcaggtctactgcggcgacaatgtgggctacaccatgaccgacacccagcaaaatcagctgcggcaggccattgaaaccacctattacagcggcgacttcgacagtgccgtgacagccttcttccggcaggcggacgtgttctacgcccaggcgaagctggacggcggcgacagcaatgacagcggctggtacgccccggcggcaccggcggccagcagcggcggcacgtccatcggcagcgtggtggtgctgatcatcggtatcttcttggtgtggatggtgctggatgctatgcggtacagccgctatcgccggcggtatatcgtgggcgcgccggtgaatgtggtacgcccggtgtactaccccattttctggggcagacggtacgcgccgccccggcctcccagagcaccccggcccccacgtccgccccacggcggaggaccgcgaccgccctacagcggtggtccccggcctcccatgggcggcggtccgagacccggcgcaccgcgaccgccccggcccaatagccggcccggcggcggtccgagacccagtgcgccccggcccagccggcccagtcgtcccagcggcggcagcgggttcagcggtggcggcttcggcggcagttcccgcggcggaggaagctcccgaggcggcggctttggcggcggcggtttcggcggcggcaagcgtcggtaa

SEQ ID NO: 1242 - DNA, 1032 bp, Unknown
  Artificiall/Consensus sequence
atgaccgacatcaaatccatgaccgagcgtcagctggctgacttttttaagaatatgggacagccggctttccgtgccaagcaggtattcacctggctgcaccgtggcgtgcgctcctttgacgagatgaccgacttgtccaagcctctgcgtgcccagctggccgagacgtgcttcatcacagcgccgaccgtggcccggaagcagacctcaaagctggacgggaccgttaaatatttgtgggagctggccgacggcaactgcatcgagacagtcctcatgcagtaccaccacggcaacaccgtgtgtatctcctctcaggtgggctgccgcatgggctgcgccttctgcgccagcaccatcgccggcaagatccgggacctgcggccctctgagctgctggaccaggtgctgtttacccagctggacagcggcctgcctgtctccaacatcgtgctcatgggtatcggcgagccgctggacaacatggacaatgtgctgcgctttctggagctggtcaacagcccccacgggatgaacatcggtatgcggcatatcagcctgtccacctgcggcgtagtgccggggatcgacgcgctggcggatcggcagcttcaattaacgctgtctgtctcccttcacgcgccggacagcgagacccgcagccgcattatgccggtgaaccgggcgtatgatgtagagacgctgtttgccgcctgccacagatacttccaaaagaccgggcggcgcatcagctttgagtatgccatgatcgacggcgtcaacgaccacgattggcaggcggagctgatcgcgaaaaagctgaagggtatgccgggccacgtgaacctgatacccctgaacgacgtggtggagagcccgtataagcccagcagacgcatcggcgctttccagcaaaagctggagagtttgggcgttaccgctacggtccgcagaagcctgggcggcgatatcgacgcctcctgcggccagctgcggcggaaggaaatgcaggaacgcggccaactgtga

SEQ ID NO: 1243 - DNA, 834 bp, Unknown
  Artificiall/Consensus sequence
atgacctatctgaaagcgatcctgttgggactggtgcagggcatagcggaattcctgcccatctccagctccggccatctggccattgcccgcaatctgctgaatatggagggagcggggagcattccggagttcttcgacgtgctgctccacctgggcacgctcattgctgtgttcgccgcctattggagcgacatccgtgacatggtggtggagttcttccggggcatcggcgacctggcgcaccgcagcacccccacaccggtgccgcccgcccgccggctcatcctgctgatcatcgtcggtacgctgccgctgtttgcggtgctgcccatccgcaagacagtgcagggcctgggcgacaatatgtatttcgtgggcgcggcgctgatcttcaccggctttctgctgttcctgtgcgaccgggtgcgccggggccgcaagaccgagcgcagcgccacctggctggacgctctgctggtgggtgtggggcaggcggtggccacgctgcccggcgtctcccgttccggcatgaccatcaccgccgggtgcttcgtgggctatgagcgtcgcttcgccgtgcgcttttccttcctgctgagcatccccgccgtgctgggcgccaacatcctgtccatcaaggacgcggtgcaggccggcatcgtcggcgcggaggtgcccatgtacctggtaggcgtggccgtggccgccgtgacgggttatctgtgcatccggcttcttaagtatatcgcggacaagggccgtttcggtgccttcgcctactactgctgggcggcgggcgtgctgacccttgttctgcagggcatcaagtga

SEQ ID NO: 1244 - DNA, 570 bp, Unknown
  Artificiall/Consensus sequence
tgggcggcgatcgggagcgcatccggacgctgtctgcccaccacgcttttgatatgctgcggcgttatcttaccaatctaccgacagaaggagaataaaaccatggcaaagaacagctacaaggccaacgtgaaccagtacgccaaccaggaggaggccatccgcaaggccaagggcaaccccaataagaatatccattccaagaagaagaacagcaactacggcgggtacaccaccggcgcgtacatggcccagaaggtggccgagaaggtgaaccagcaggagaaggtgaagctgcccacctggctgaatgtgacgctgatcgcggagtttgccgtggtgctggtgatcctgatcctgcgcctgacagccttcaaggacagcgcggtaatgacccacctgtcctccctgacgctgggcatcacctgcggcacgctgttctatatccgcaagtacaagcacacgaagaaaaccagcgccatgtacagcatcatcaccattctgctggtggtcatgtgcctgctgtacaccaccttcggcattctgggactgctgggctttttgggctga

SEQ ID NO: 1245 - DNA, 447 bp, Unknown
  Artificiall/Consensus sequence
caaagggacggttttatgaacttcttgcaacgtattggcaacgcgctgtcgcgcttcatgtatgggcgcaacggtgtggaccggctgacgctgaccatggtctggacggctctggtactggatatcatcaacatttttctgcgggagaaggtgccgctggcatacagcatcatcggcaccgtggccgggatcatcaccctgctggcactgttccggatgttttcccgcaatctggagaagcgccgggcggagaacgcgaagttcatggagaaggtctggtggcccatcagccgacgtatgaccgggaaaaggcagcagcggatggataaagagcactgctactttacctgcccgggctgcggcgcggtgtgccgggtgccaaaagggaaagggcgcatcgtcatcacctgcccccgctgcggcaatgagatacacggaaaatcataa

SEQ ID NO: 1246 - DNA, 624 bp, Unknown
  Artificiall/Consensus sequence
atgagcagaatcattaccatcagccgtgagttcggttccggcggccgtgagctgggcaagcgtctggccaaggccctgggcattccgtgctacgaccatgagatcatcgagatgattgccaaggaaaacggcttcaacgaggactatgtggccaacgtgggcgaaaagagcatcgaagccgcctatccgctgaccatcgggcaccgctttggtatgcagcccttccagatcatggagcagcccatccgcgtggcagtggcccagcgccagatcatcgagaacttcgccaagcaaggcgactgcgtcatcgtgggccgggccgccgatgttatcctcaaggactacgacccgctgaacatctttgtctatgcggataaggactccaagatcgagcgctgccagcgccgtgccccgcagggtgagcatctgacgccccgggagatcgagtcccatatgaagcagatcgaccgcaaccgtgcccagcaccaccagatgtacagcgacagcaagtggggcgacaagggctcctacgacctgtgcatcaacaccaccaagcgctttgtcaaggatatcgttccgtccatcgccaagttctgcgaggactggttcaattcccacggttaa

SEQ ID NO: 1247 - DNA, 336 bp, Unknown
  Artificiall/Consensus sequence
atggataagggggatgtgagccgcacattgtgcggcttggggttgttgccgagcagcgtctgctatttttatatggcagaggcgcctcggctgtcgctgcgggagccggacaggcttctgctggtcacaaagcatgtgtatccggacgtggcgcgctgctttgacacaaactggaagtgcgtggagcgcggcctgcgccgcgccgcaaacgttgcctggaacacggcgccggagaagctgtcagagctcgcacatcgacacttgacggagaagccttctgtttcagagctgttgtctctgttgacgatctaccttcgcgcggaagaggagaactga

SEQ ID NO: 1248 - DNA, 603 bp, Unknown
  Artificiall/Consensus sequence
gtgagaaataagttttacgcggcggcgtggcgggtgctgcgcccgctggtgctgttttttctgccggtggacctgcggggaacggagcatctggagggcggagaaccggtgctgctgtgtgccaaccactccagcgcctgggaccccatcctattcgtgctgtccatgccccagcggttcaacgtgcggatcatggctaagaagcagttgttctccatccccatcgtgggtggattcctgcgggcgatcggtgtgtttccggtggatcggggcaacagtgacattggggcggtgaagaccgccatacagagcctgcgggacgggtggaacctgttcctgtttccggagggaacacgggtgaagacaccgggacaggcggatgtcaagtccggcgcgggcatgatggctatccgtgccggcgtgaagctggcgccggtatatatcggcacgaagaagcgcatattccgcaagacgcccatcataatcggcgagcccttcgagccggagtacaccggccgcaagggtacggcggaggaatatactgccaacgcccatgaggtcatgcggcaggcctatgccctgggagggatcgaatgcaggtga

SEQ ID NO: 1249 - DNA, 981 bp, Unknown
  Artificiall/Consensus sequence
atgcgcttgtttttttttgccatccgtggtatgatggtagctatgaaaaatcaaggaggaaagactatgcacgcagcgctggtcatcatggcggcggggatcggttcccgctacggcggcagcaagcagaccgacggcgtggggccccacggagagatactgatggagtacggtgtgtacgacgcggtgcgggcgggctttgacaaggtcgtgttcatcatcaagccggatatgcgggagctgatggagcgcctgtgcggcaatatggcgtcccggctgcacacggcggacgggcggcccgtggaggtccgttacgcctatcaggacgacacgacactgccggcgtggtatacaaagccggcggggcggacaaagcccttcggcacggcccacgcggtgctgtgtacccgcgatatcgtacacgagcccttctgcgtcatcaacgccgacgatttctacggcgcggacgcttaccgcaccatatatgcggagctgcagcgtctgccggagacgggcgcggccaccatggtgggctatctgctgaagaacaccgtcactgcccacggcaccgtgtcccggggtgtgtgccatgtgaaggacgggtatctcagcgacatccgcgagacgctgaagatcgccctgctgcaggacggcgtcatccgggacgaggataccggagcggtgctggacggcgacacggtggtgtccatgaacttctggggctttgccccctccgtcttcgacgcgttggagacgtatttccacgacttcctccgcagcgaggcggggcagtcggtgaaggccgagtgcctgctgcccaccatggtgggcgacctgctggcggcgggagagctgcgtgtcagcgtgctgaagtcggcggaccgctggttcggcatgacgtatcatgaggaccgcgcccgggtggcgcaggcgctcagcaaactgcacgagacgggggcataccccgaggaattgaggtaa

SEQ ID NO: 1250 - DNA, 513 bp, Unknown
  Artificiall/Consensus sequence
gcgagccgctgtgaacggctccactaccgacaaaaggaggaaattctcttgtatacagagaaaacggcggcagcgcgggcggaaacacagcccgcctgcggcgaaggtaccggccagcttccggcctgcggtgcgctggctttcccctatgtggccatgcagggtacagaccccgtgcgctacgacgaccaggaggccctgcggcagggcacactctttcccggccttgatcttcccttccacaaggagctgcggtcccgctttccacaggtagacggtcccctgctggagctgatggcgctggattttgctatcgatgagctgggtctttacctgaccacacacgcagatgaccagcaggctttggagctgtactggtcatacatccggctgggccaggaggggcgtaaacgctatcaggaaaagtgcggaccgttgatgcagacggatatcacgccgggcagctaccaatggctgaacgacccgtggccgtgggaaggaaaggggaactga

SEQ ID NO: 1251 - DNA, 519 bp, Unknown
  Artificiall/Consensus sequence
aagactatgatttccggcatcgtctacacatccaattccggctacacggcgcagtacgcccgcctgctgggtgccgcgctggatctgcctgtgaccgacgccaagtggggcgccgatccccatccgggcagggcggtcatttacctgggctggctcatggccggcaaggtccagggatatgcgaaagcggccaaagaatttgatatccgcgccgtctgcgccgtgggcatgggtcccgccagtcaggccggagccgagaaggtccgggccaagatgggcattccggcggaggtgccggtattcaccctgcagggcggcttcgatatcaacaagctgcacggaccctataagtggatcatgcagctgaagtgcaaagagatccgcaaaacgctggcggggaaggccagtctcagccccgcccagcagctgacctacgacatggcgaccaagggtgccagcgccgtcagcgcggagaacctgacaccgatcatcgactggtataaaacgaaggagggctga

SEQ ID NO: 1252 - DNA, 834 bp, Unknown
  Artificiall/Consensus sequence
atgaccaacaaaaagctctatcttatcggcgaccccgtggatcatagcctttcgccgctgctccacggcgccatgatcgcccagaccggcgtacactacacctatgaagtccgccgcgttcagccccgcgatctggccgacttcgtggccgaggccaaggccggcggctgtgccgggttcaacgtcaccatgccccacaaggaggctatcctgcccctgctggacgagctgagccccgcggcagccgcctgcggcgcggtgaacaccgtctgcatcaaaaacggccgtgccatcggctataacactgacggccggggatttgtggacagcctgcgcgcccgcggcctggagccggagggcaagaccgtgctgctgctgggtaccggcggcgccggagacgccatctgtgatgcgctggtcggcgccggtgtgaaaaagattttcgtcaccaaccgcagcgtctatccggcccaggatctggccgcgcgttatccggataaggcgcagttcatctacttcggcattttccccgtccgccatgccatggccgagagcgacctgttcatcaacgccacctctctgggcatggccggcatgaaggagttttccgacctgggcttcctgcgtgacgccccggcaggcgtcaccgtctacgatctggtctataacccccggcagaccatgctgctgcgcgaggccgaaaagcgcggcctgcccaccgtgtccggcatcgacctgctgctctaccaggcggcccgtgccttcaagatgttcaccggcaaggacgtggatatgcccgccctgatctcggcgctggagggcaaactggactga

SEQ ID NO: 1253 - DNA, 336 bp, Unknown
  Artificiall/Consensus sequence
gagggttttggcatggcgaaccgggtaacgatgtctatctgcggcacggagtatatcctcgtagcggaggaggatgccgcctacatggagaagatcggcagcatggtggatgcggagatgcagaagctgatggacagcgcccacatgagccgtgacgcggcggcggtgctggcggcggtcaatctggcggaccagctcaccaaggcgcaggagggcgcggaaaatctgcgccggcagttgaagacatatctggacgaggccagccgcgctaagaacgaggcggcggagctgcgccggaagctgcagaacgcccagaaccagaataaccgccggtga

SEQ ID NO: 1254 - DNA, 792 bp, Unknown
  Artificiall/Consensus sequence
atgataaattttacaaggaaaccacgctatggctacgaagatctgctggagatcatccggctgctccgttcgccggagggctgtccctgggaccgggtgcagacccaccagtccatccgccgaggtatgctggaggaggcctacgaggccgccgaggccatcgatacggacaacgccgcactgctgaaggaagagctgggcgacgtgctcatgcaggtggtgttccacgccggcatcgaagccgacgccgggcgctttgacatggatgacgtttgcgacggcgtggtgaaaaagctgctgtaccgccacccccacgtgttcggcgatggtcaggcagaaacggcagacactgtgcccgccagctgggagcagctgaagcggcaggagaagggccagaaaaccactgccgatgcgctggatgccgtggcccgcagtctgccaggtctgtggcgggcggagaagatacagaagaaggctgcggaggcgggcttcgactggcgcgacatctccggcgcgctggacaagctggacgaggagactgccgagctgcggcaggcggtgcgcgacggcgccaatgtcgaggaggagctgggcgacgtactgttcgccgccgtaaaggtgggtcgcttctgcggcgtggacccggaaacagctgtcaacggcacctgtgaaaaattcattcgccgcttccgcgcgatggaggaggccgcggccgcagagggccgcagtctgtccgacatgatgctggaggagatgaccgccctgtggaacggggccaaagaatgttcttaa

SEQ ID NO: 1255 - DNA, 855 bp, Unknown
  Artificiall/Consensus sequence
atggcaactttcaccaaccaggcaacgctgacctataacggccagaccaccacctccaacgtgacggtgggtgagctgacggagacgctgaccgccgccaagaccgccgtggtgcccacctacggcaccgacggccgcgtgacgtatatcctctctctggtcaacagcggcaccgcaccgctgacggggctgaccattaccgacgatctgggcggctacaccttcaacgccgggacggtgtatcccctgtcctacaccgccgggtctgtgcggtactatcagaacggcgttctgcaggcggcacccgccgtcaccgccgggccgccgctgacgttcaccggcatcaccgtgccggcgggcggcaatgccgttatcgcctatgaggccgtgcccacggccttcgcgccgccgacggcggagggcaccgtcaccaacagcgcgtccgtcaccggcgcggggctgacaaaccccgttaccgccacggagacggtggcaccggaggcggcgccggcactgaccatcaacaagtccctctcccccaccacggtgacggagaacagccgcctgacgtacaccttcaccatccagaacaccggcaacacggcggcggacgccgcggcggccatcgttatcaccgacaccttcgacccgcggctgacggacctgacggtgacgctgaacggcacggcgctgaccgcccccacccagtacacctatgacgcggctaccggcgtattcgccacggcggccggcgtggtcacggtgcccgcggccaccttcacgcaggacgccgccaccggcgcgtacagcaccacccccggcacggcggtgctgaccgtcaccggcacggtgtaa

SEQ ID NO: 1256 - DNA, 261 bp, Unknown
  Artificiall/Consensus sequence
gcttcttgggctgataggtacggaacattgcatgacacctccatttttaagattatccggcgggacaacaaggccccgcgcttactcgacagcggtgagatattcaccgccgcagtaaacatttccacgcctgttgcacatctgcgtgcaaccacgcggagtatattatacagatacaggggggcactgtcaacaaaaatttacccacaagcgcccgtttttgcgggaaaaacagggaaaaagccggcagtttatatttag

SEQ ID NO: 1257 - DNA, 858 bp, Unknown
  Artificiall/Consensus sequence
atgcactgcactgccgccgcggcggcaggaaaaaggagggcgcatatggatcagcggcctatcggggtgttcgactccggctccggcggattgaccgccgtgcgggagatacgtagcatcctcccctctgagaacattatatacttcggcgacacgtcccgtgtgccctacggcgggcgctcggcggaaatattgctgcgctacgcccggcaggatgtacatttcctgcggagctttgatgtgaaagcgctgctggtggcctgcggcaccgtatctaccaacgctctgccggtgctggcggccgagaacgatatccccgttctcggtgtggtgaaaccctcctgcgcggcggccgctgcggcgacccgaaataagcgagtgggcctgatcgccacggcggcatccgtgcgctccggggcctatgagcgctgtctggcggcgctggacggcgccattcaggtgtatgtcaaggcctgccctctgtttgtgccgctggtggagaacgggcgtttccgccccggtgatccggtcatcgagacggtggcccgggagtatctggagccgctgcgtgccacggggatcgacaccctcatcctgggctgcacccactatccgctgctgacggagatcatcgcggacatcatgagccctggtgtgacgctcatcgactccggcgctgcggcggcgcgggtcctgcggcagacgttgtcagaccggggtgcgctggcccaacgtgaccacggcacactgacactgtatgccagcgaccggccggaggacttcggtgcgctggcagggcagtttctgcggcgaccgctggagagcgcggtacagcacgtggacatcgagaggtactga

SEQ ID NO: 1258 - DNA, 606 bp, Unknown
  Artificiall/Consensus sequence
ttccctatgaatatcgtttgtttggacatggagggcgtcctcgtccccgagatctggatcgcctttgccgaggaaagcggcattcccgagctgcgccgcaccactcgcgatgagccggattatgacaaactcatgcgctggcgcatcgatctgctgcggcagcgcggcctgaagctcagcgccattcaggagaccatctcccgcatcgaccccctgcccggcgccaaggacttcctggacgcgctgcgcaaggatacccaggtggtcatcctcagcgacaccttcgaccagttcgccatgcccctcatggccaagctgggctatcccaccctgctgtgcaacaccctcgaggtggacggcgagggctacatcacccgccacctcatgcgctgtgaacactccaagctcaccaccgtcaaggcccttcagtctatcggctacgacaccatcgccagcggcgacagctataacgatttggagatgatcctccacagcaaggccggctttctcttccggggtcccgacaagatcaagcaggactaccccgacctgcccgccttcgaggactacgacgacctgctggccgccatccgcgccgccctgtaa

SEQ ID NO: 1259 - DNA, 786 bp, Unknown
  Artificiall/Consensus sequence
cccttgtctttccgcactgctgtggtatactggaaaccgtcatttttacagaaagagggacctcccgtgcaaaagctctcccacaacgaccacatcgacctgtaccgccacctggccttctgcaccgttggcggcttcttcggctgctacgctgttcttatccacagcggcgtcatgggcaacgcccagacggtgaacctgatcgagctgctgctggacgccctgcgcggcgatctgcacgccgtgctcctgcacctgggcgcgctggtgctgtacgtgctgggcaccatgctgacggtgctgctgccccactggtggggctgggatatgcactatgtatcgcctgttatcaccgccgcagccgccgtgaccgtagccttcctgccggaaacgctgaacgttgtagtagcactgtatcccatcttctttgccatgagcatccagtggagcagcttcggcggcgcccgcggcttttacagctccaccatcttctccaccaacaacaccaagcagacttctctggccctggccaactacctgtgtgaccatgaccgcgcccacctgcgaaagctgaaggtctttgccctcaccctgctgtgcttccacatcggcgcggcagcggcttacttcgccgtgacgtggtggtatatccgcggcgcgctggccgtgctgccccttatcgcctgggccttcttcctgtccgtatgcgaacgcaggcatgaagccctggccgaggaaccggagaccatccccgacagcagcgcccaccccaccagcaacgcataa

SEQ ID NO: 1260 - DNA, 534 bp, Unknown
  Artificiall/Consensus sequence
atgcattacggagaattgaagaaatgtgatattgccaacggtatcggcgtgcgggtgacgctgttcgtatccggctgcaccaaccactgcccggactgctttcagccccagacgtgggattttgactacggaaaggaattcacggaggacaccaaggcggagatattctcggagctggacaagccctttgtaaacggactgacggtgctgggcggcgagccctttgagccccggaaccagcgggagctgctgccgctgctgcgggaggtcaaggcgaagtatcccggcaagaccatatggtgctttaccgggttccggctggacgatgagctgctggcagacggcagctatccccggtgcgaggcaacggatgagatgctcgcgtgcatcgacgtgctggtggacggacggtttatgaaggaactgaaggatatctcgctgcagttccggggcagccggaaccagcgggtcatcgatatgaaccgaacaagagagacgggaacgatctgcatttgggacaagctgagacgataa

SEQ ID NO: 1261 - DNA, 930 bp, Unknown
  Artificiall/Consensus sequence
atgatcaccgatatcgacgccgctttgctggaaaagatcgccgatctgaccggcaagcccgtgggcgccttcaatatccgcaaggactccggctgcgaggcccgtcagtccaccgagcacattgctatcgatccccgcagcgacggaaagtccggcattgacatccgcatcaagcccggcaccaagggtgagaaatgctacatccccgtcatcatcagccacagcggcctcagcgagctggtctataacgacttctacgtgggcgacgactgcgacgtggacattatcgccggctgcggcatccacaactccggctgtgacgaaagccgccacgacggcatccacaccttccacatcggcaaaaattccaaggtccgctatgtggaaaagcacttcggcgagaaggaccccggccagaccggcggcaacatcatgaaccccaagaccgtggtctacctgggcgagaacgccaccatgcagatggagacgatccagatccgcggcatcgactccaccaagcgcgagacggacttcttctgcgaagccggcagcgaggtggtggtcaccgagcgcctgctgacccatggcgctcaggaggccgagagcgatatgcgtatcgagctcaacggccacgacgcccgcggccgcgtcatctcccgcagcgtggcccaggaccgttcccaccagatcttccacccggtgatggtgggcaacgcccagtgcttcggccacgttcagtgcgacagcatcatcatgggtgacgcccgcatcgagtccgtcccggccatcaccgccaactgtcccgacgcccaactgatccacgaggccgccatcggcaagatcgccggcgaccagctgctgaagctggagaccctcggcctgacccccgaacaggcggaggagacgatcctcaagggctttctggcataa

SEQ ID NO: 1262 - DNA, 657 bp, Unknown
  Artificiall/Consensus sequence
atgcaggcgatcaagcaattcttcaaaacccatccccacgcctggtggggcgcatatctgccggtctatctggcgatgttttttaccatcgagcactttattaccgataactactgggccacacagacggtgctggacacctatatccccttctgcgagtggttcatcttcccctatgtgtcctggagcccgctgctggtggtgctgggcatctatctgatcctgaaggacgccgagggcttccgccggtatatgtggttcatcatggtgacgttcacaacggcggtggtgttctgcattctggtgcccaacgggcaggatctgcgtccggcggtgatggcgcaccacaatgccgccacctggctggtggagtacacctattccatcgacaccaacaccaacgtcttccccagcatgcatattctgggctgcatggcggctgtggcggcggtgtggcacacgccgggactgcggaagcccggctggcgctggggcgtaacgctgtacgctatcctcatcatggcggccaccgtgttcgtcaagcagcacgcggccatcgatgtgctggccggactgctgaccggcgccatcgcctatgtgttcgtgtatgtcatcgttggccggcgccgcgacaggcggctgggccgggattgctga

SEQ ID NO: 1263 - DNA, 852 bp, Unknown
  Artificiall/Consensus sequence
gtgaagggagtgaaggccatgttctatatcgggtgtcatctgtccgcctcagacggctttttggccatgggcaggacggccctgtccatcggggccaacacgtttcaatttttcacccgcaatccccggggcagcaaggccaaggccatcgatccggcggatgtggcggcgtttctggcgctggcggcggaaaacgaattcggcacgctggtggcccacgcgccgtataccatcaatccctgctccaaggatgagcacacccgggagtttgcccgcatgacgcttgcggacgacctgaagcggatggagcacctgccggggaacgtgtacaacttccatcccggcagccacaccgggcagggtatggagacgggtattgcccagatcgcggagacgctgaacgccatccttacgccgggcctccgcaccaccgtcctgctggagactatgtccggcaagggcagtgaggtgggcagccggttcgaggagctgcgggagatcatcgaccgggtggcactgtcggataagctgggggtgtgtctggacacctgccatgtgtccgacgcggggtacgacatcgcggacgacttggacggggtgctgacggagtttgaccggatcatcggtctggggcggctgaaggcggtacacatcaacgacagcctgaacccgcggggcgctcacaaggaccgccatgcccgcatcggcgagggctgcctgggcgcggaggcgctggggcgcgtggtgcgccatcccgcattgcaggggctgccctttgtgctggagacgcccaacgagctgccgggctacgcccgggagatcgccctgctgaaggcgctgcgggagggatga

SEQ ID NO: 1264 - DNA, 615 bp, Unknown
  Artificiall/Consensus sequence
gctatggaatatgacaaggaattgatcgcccacaagctgcagcggtgggacaagttcatcacggattatcatctgccggactgggagacgataccggatttcggcctgtatatggaccaggtcatcgtactgctggagcagtatctcagcttcattcccgcgccggtgggcggcaaggagcgctttgtcacgtcctccaccatcaacaactacgttcggctgaagatcatgcccgcgccagagaagcggaaataccaccgcatccacattgcgtacctcatcatgatcctgaccatgaagcagagcctgagcatcagcgatgtgcagaagatcctgcccgctgacagcaacgagacggacgtccgcgcggtgtatgaggattactcgctgaaattccgccgggtggggctgtttttcaaccagcaggtgcagtccgggtcggagggcatccgcagcgccaacgaacagaacggcaataacgccgtggagctgctggtcatcgaaagtgcgctgatcgccgggttctccaagatattggcagagaagctgatacgcctgtgcggcgcagatgccgaggatgtgctggccgcggagcagacaccgccccagccgtga

SEQ ID NO: 1265 - DNA, 2112 bp, Unknown
  Artificiall/Consensus sequence
atgggcaataagttttccaacaaatatatctgggtgctcatgctggtgctgggcgtctttgtgatggcggtcacggctctcatcggcggcaacagcagcatccgcaacgcccagcagaccgcccagcggacgctgcaatatctgcaaaaccagtgcatcagctaccgcgacatcgtcgccgccgaccggctaaagagcctcgtgcggctgacggagcaggcgcaggaggtggcggagcgcgagggtatggtggggcagaaccgctccaacgaggagctggcgcggtacgcccagcgtcagcgcgtaacctgcgtgctggtgctggacaaggatctggagatcgagttcagctccggtgcggacatggactggagcgattactacaccaatgaggcgatccgctccatcatggactacccggaaaagatcttcgcccgccgcctgacccgtgacggcgcggtatacgacatagcagccgtggcgcgcgtcgaaaatcccggcgtcgtcttctgcgtccgcctccagtcgaacacgatcatcgcctcctaccgtgcgtccatcgagagcctgctggcgggctacgagacgctgctcaatgacaaggtctacacctacatcaccgacggcgagcgcgtggtgggcagcagcgcggcggagcagtgggacctaccggtggacagcgtgccgctgatcacggcgctggagcaggcggacagcggcagccgtttggcgaagttagactgtggcggtacgtttttcggtatgcgtgggatgtaccagaagtacagcctgtatgtgttcctgccggcagactttgtgttcgcgcagacaaaaaatatgctgatctccgccttcggcgtgtacgcgatggcggcggtggtggcggcactgctgttggtcaggctcggccaggaccgcaaacggcgggagctggcgtaccagaagcagttggaaaaggaagtagagcgtgccacagcggcggaccaggccaagacgcacttccttcgcagcatgagccacgacatacgcacacccatcaacatcatcatgggtatgctggagatcatcgggcggaacccggaggatgtgacgctggtgcagtcctgccgggagaaggcgcagaccgcggcgcggtatctgctggcattggtaaacgacgtgctgacgctgaatcgcccgaagcaggaggcgctgggaaagacaccctattgtttgacaagcgagctgcacgagatgctggatatttcgcgcgcccaggcggagagcgcaggcgttgcgctgacggtgatggacctgacgctggagcatgaacgattcacaggcgacccgctgtatatgcggcagatctgccagaacatcattggcaacgccatcaaatacaatcaccccggcggatgggtgcgctgcagcttccgcgagtcccattatgcggacggcgtgtgccggctggaatttatatgcgaggacaacggcgcaggcatgagcgagacgttccagcgccatatgttcgaggcgtttgcccaggaaaacagcgataggggcagcctttccggcggcgtgggcctgggtttggccgtggtgaaaaagctggtggacgaaagaggcggtaccattcaggtggacagtgcacgcggacagggaacgcgcttccgcgtggtgctgcccatgatgcccagtgaggccgaaccggaagccgcgcttcccgacgcggcggcctccatcgccggacggcgcttgctggtggcggaggacaacgaactgaaccgggagatcgcggtctacctgctgcaggaggccggcgccatggtggatcaggccgccgacggcaaggaggcggtggagatgtttgccgcgtcggcgcccggtacctacgacgcggtgctgatggacgtgatgatgccggagctggacggcctttccgccacccgcgccatccgcgggatggacaggccggacgcccgcctgccgatcatcgccatgaccgccaacctgtttgacgaggacgtagcggcctgcctggcagcgggcatggacgcgcatatccccaagccgttggaggctgggcagatgataagaacgatcgccgagtggctggagaggaagaaacaatga

SEQ ID NO: 1266 - DNA, 861 bp, Unknown
  Artificiall/Consensus sequence
atggcagtgatgatagagacaaggaacctgacctatacgtaccctgcaccggagggggagacaaatcctccggccctgcgggatgtatcggtacagatcgaaaagggcagctttacggtggtgctgggccacaacggctccggcaagtccacctttgccaagcacctgaacgcggtgctgctgccgtgcggcggtgccgtgtatgtggaggggatggacacccgggacgagaagctgctgctggagatacggcggcggacggggatggtgttccagaacccggacaaccagatcgtggccaacgtggtggaggaggatgtagccttcggcccggagaacctgggtgtgcctacggcggagatacgccggcgggtggacgacgcgctggaggcggtgggcatggagcaattcgccagccacgcaccgcacctgctctccggcgggcagaaacagcgcatcgccattgcgggtattctggccatggagccggagtgcatcgtgctggacgaggccacggctatgctggacccggcaggacggcgtgaggtcatcgacaccgtgctgcggctgaaccgggagcagggtattaccgtggtgcttatcacccatcacatggtcgaggcggagcgtgcagaccgagtgatcgtgatgaacgacggcgaggtagcgatggacggtatgccgcggcaggtgttctcacaggtggagcgcctgcatgagctgggcctggcggcgccggatacggtggaattgctgtatcggctgcggcgggacggagtagatgtgccgctggaaaacctgacggtagacgagtgcgccgataccatttgccgcgctttcggcgaggcggaagggaagtaa

SEQ ID NO: 1267 - DNA, 1710 bp, Unknown
  Artificiall/Consensus sequence
atgatgacacccaaggagaactttctggagctgctgaagcccaatggccagccggatcgccagctgtgccagtacgaggcgctgcacatgtgcctgaacgatcccatcaacacctatctgcggggcaaccggaagcgggggaccgtcagcaaagaccgctggggcaccaccatcagctttcctgccgacgcgccggggcctatgcccgtcaccacggacggcctggcggtgtgcccggacatcacccgttggcgggagacagtgcacgcgccggacatcgccgcctgcacggagggctgggagacgtgccgcgccacggcacgggcggcctgcggggaggagaagctgctggcgggctttatgggtaccggtatcttcgagcagtgccacttcctgatgggctttgaggacacgctgacgaacctttatgagcgcccacaggagatgcacgcgctcattgactgcatcaccacgtaccggctgctgtacgtgaagctgctcatcgacaatctgcagccggatgtgatcttctctcacgacgactggggcaccaaggatgcgctgttcatgaagccggagatgtggcgggaattcttcaaggagccgtaccggcggttttacggctatatccggtcccggggcgtgatcgccatacatcacgcggactcctatctggccccgatcgtggaggacatggcggagatcggcattcaggtgtggcagggcgtactgccggagaacgatataccggccctccagcagaagctgcacgggcggctggtgctgatgggcggtatgggcgccgccatcgaccggacggatgccgcgccggaggagatctacggctatgccatggatacgctgcggcggtgctgcccgggtgggcactatatcccctccatcacctatggcctgccgggggcggtgtatccccatgtggacgagtacatcgaccgggccatagcggactacaaccgggcgctgcacgtgccgcggttcgatctgccgccggtgccacgccgggtgcgggctgtcgctgtgcggcaggagacggcggacgccgctgtcgagaacggcgacgtactggcccgcctggccgcagcgctggaaaagggacagcagaaaaaggtgctggcgctgtgccgggaggcgctggaccagggtcggacgccgcaggagatcctgtccggcgggctgatccgcggcatgaacgatctgggtgaggcattctccgccaatcgggccttcgtgccggagatgctgatggccgcccggtgcatgacggcggcgctgggggagctgaagccgctgatgaccggcggaaatgccaagacggtgggccgggcgtgtatcggcaccgtccggggagatatgcacgacatcggcaagaacctggtgaagatcatgctggagggcagcggtgtggaggtcatcgacctgggcgtggacgtgacgccggagcagttcgtggagacggcgaagcggcagcgctgcggcgtgatcgcctgctcatccctgctgaccaccaccatgggcgagatgcgccgggtggtgacgctggcccgggaggcaggtatccgagatcaggtgaagatatttgtgggcggcgcgcctatcagccagagcttctgcgatgagatcggtgcggacgtatacaccgaggatgcggcggcagccgcacgggcggcggtatcggcgctgaagggataa

SEQ ID NO: 1268 - DNA, 534 bp, Unknown
  Artificiall/Consensus sequence
tgttgggaggtgggcgcagctatgcggatactgggcattgaccccggcatcgccattgtgggcttcgggctgatcgaatcgaaccggggcagtgtgcgaatgctgcaatacggcgctgtgactaccgaggcgggactgccgctggcgacacgtctggtgcagatcgaaaacgacatgaccgcgctgatcgcccagctgaagcctgatgagatcgccgttgaggagctgtttttcagcaaaaacatcaccacaggtatcgccgtggcccacgggcggggtgtgatcctgtgtacggcggagcgactgggcgtacccatattcgaatatacccccatgcaggtgaagcaggcggtggccggctacggcctggcggacaagaagcaggtgatggacatgacaaagcggcttttgaagctgaaggcagtgccgaagccggacgacgcggcagacgcgctggccatcgccatatgccatgcccgcagcgctaccagcctgctgcggcgtaaggaccccgacgtgaaggagactgtctga

SEQ ID NO: 1269 - DNA, 648 bp, Unknown
  Artificiall/Consensus sequence
gcgctatggaataattctgcaacaattggcgaaaaaatcggaacgtgtgacgcgcgttttctgcgggatagcggaggaattgaaatgaaactgacacttttgcggcacggggagaccgagggcagccagaaaaatctgtattatggcgcggcggatatcccggcgctgccgaaatcgctggaggccttgcagcagaaagctttgaccggcgtatatcccacggcggagcactactacgtcagcggaatgacgcggacgatacagacgctgcgggccatatacggcgacgtggcatacacggtgctgccggggctgcgggagatggatttcggcgatttcgagatgcgggcctacgccggtgatctggagcacgatccacaatttattgtgtggtgtgaggactcagagcacaatatgtgccccaacggagagagtgctccgcaggtgctggcacgaaatctggccgcgatacagcccgttatcgacgcgggggaggacgcggtgtgcgtgatccacggcggggtgacgtcgggactgatgatgcactggttcggcggaacgcggtacgactatctgctggcacccggcgagggatatcaggttagttttaacgagaaaaaacctgtaagctattcgaaaataatgtaa

SEQ ID NO: 1270 - DNA, 642 bp, Unknown
  Artificiall/Consensus sequence
gtgcgtgccattgagaagcagaacagaggacggctctcgccgtcctctgcttttttcgcggggtttcgctttacaagcgggaaaaaattgcgtataataccaaaaaaggaggtgggcgatgtgggtatcgcgtttattcaggacaagctggagatcaagttcctgatcctgtacattgtgtcgcggctgacggagccggtggacggagccgacttgcaggacatgaccatgtgcgacgagggcatcgactactttgattatgcggagtgtctgggtgacctggtgaagacagagcatctgcgtgtcacggaagacgggcagtatgttatcacggaaaagggacggagaaacagcggtatctgcgagagcagcctgccatattccgtaaggcagctgtcggacaggcatattgcagcttggaacaaggcggcggtgcggcggcagcaggtgcagggacgggtgacgccgcgtgaaaacgggacgttcaccgtggagctgcggctgcgggacgatgtggatagcctgatgacgttggatctgatggtggccgataaggccgacgccgaggcgttggcggaacggttccggagggagccggagaaggtatacacgcagatcgttgcggcgcttcgcggaaaataa

SEQ ID NO: 1271 - DNA, 879 bp, Unknown
  Artificiall/Consensus sequence
atggcagatcgtatcgtaagagctatttccaccgatggcatggtgcaggcggcggccatttgcagccgcgacctgacagagcgcgcccggcagatacacaagacgctgcctgtggccacggcggccttgggccggacgctggcagcagcgtccatgatgggcaacgccctgaaaagcgatggcgccagcctgacgctgcaattcaagggcggcggtccgctgggcacggtgctggccgtcagcgacaacgagggcaacgtgcgggggtatgtgacgaacccccatgtggacctgcctctgcggccggacggcaagctggacgtgggcacggccgtgggtcatgagggcacattgacggtcatcaaggacctgcacatgaaggagccctacgtgggcaccatcgacctgctgggcggcgagatcgccgaggacgtggcgggctatttcgtggagtcggagcagatccccaccgcttgtgccttgggcgtattggtggaccgggaccagagcgtcaaggccgccggcggatatcttatccagctgatgcccggcgcgggggaggacgtcatcaccaaggtggagggcggcatcatggccgcagggccggtttcggcgctgctggacaaaaacgacgacccggagcagctgctgcgggacgtgatgagcgactttgacctgaagatactggagacgtgcccggtatcctacaagtgctattgcagccgggaacgggtggaacgggcgctgatctccctgggccggaacgagctggagcagatgctggcggaacagggcggctgccagctgacgtgccagttctgtgacgcggtgtacgacttctcggcggaggacctgaagggcctgctgaaaaatatgtaa

SEQ ID NO: 1272 - DNA, 612 bp, Unknown
  Artificiall/Consensus sequence
atgtattattatgtgaacggcaccgtggcggagatcgatgcggggctggcggtcatcgactgcagcggcgtgggctacgcctgtgccacgacgaactatacgctctcccagctgaaaaagggcgcaccggccaagctgtacacctatctgaatgtacgcgaggacgccatggagctgttcggcttcgccgatcagagtgagctgcggagcttcaagctgctgatcggtgtatccggcgtaggccccagggcggcgttgtctatcctgtccgccgtaacaccgcagcaactggcgctggcggtggtgacagaggatgaaaaagcactgactgctgccaacggcatcggcaaaaagatcgctcagcgggtgatactggaactgaaggacaagctggcacgggaggaagcgctgggcggcacatccgttaagggcggcgcgcccgcgatggctgcggtgccccacagcaagaaaagtgaggcgcaggcggcattggcggtgctgggctacggcagcgcggagatcgccgcggcgctgaaggatatcgacatggaagcgctgacgctggaggacatcatccggcaggcgctgaagcgcatgatgaagatgaagtag

SEQ ID NO: 1273 - DNA, 597 bp, Unknown
  Artificiall/Consensus sequence
cggctccacaggcaggtgacgtatatggcaaagatcgtgctggcctccgggtccccccggcggcaggagcttttgcgtcggatgggcatcaccgactttaccgtccgagtgccggaggtggaggaatacttccccgccgggctgacgccggaggagacggtgtgctacatctcccgggagaaatcccaggcggtggcgtccgacgcggacgagatcgtcatcacggcggatacgatggtgtttctggacgacaagaagctgggcaagcccgccgacgaggcggaggccctgcaaatgctgacggccctgcagggtcggcgccacaccgtctgtaccggtgtgacggtgcggcagagggagaaagccctgacccgcgcccagcacacggacgtgtatttccgtccggccacacagcgggagctgaaggcctacatcgccgggggcgagcccatggacaaggccggggcctacggcgtacagggacagggcgcgctgctggtggagcgcatcgacggtgactttttcaacgtgatggggctgccggtggtgctgctggcggagatgctgggcgaattcgggatacagctgctgggataa

SEQ ID NO: 1274 - DNA, 1314 bp, Unknown
  Artificiall/Consensus sequence
atggaacaaacagtcgtcacacaaccgaagcgcttgcagccgaaaaagccgcggcgccgcatcacgccggccacggtgtgccaggcaatccacgatgtgccctacatcgtggcccgggccctgatccgcgccgtgcgcgcagtgggccactgctttgcctggacctgggacgccatcgcttccgacgtcagggccaactggcgcgccttctgctgcggacggctggtgaccggctgccgtgacgccctgcgttccccggccctgcgggaggtgcaccacatcatgcgcgatcatccctctatccgcgccatcaccatgatcgccgtcacggcggtgatcttcgccgccgccgttatggcggagccggtacgcaccatggacgccatctgcatcgtggtggacggcgacggtccccacgtactggacgagcgcagtgaggagcgcacctatgacgatctgctgctgcgccgcagcctgggcgacaagtccatgcagctgctgctggagccgggccgcaccgtcaccatcacccacggcgacgacacacacaccctcaccaccgaggccgagcgcctgtcctccctgctgcggcgcagcggcatccgtctgggtgaggacgagatggtggagctgaatgtcgccggcgaggaccccgccatccgcatcagcgatacgctgacctaccagcactatgtcactgtggagacggactacaagatccttcgctcaccggatcccctgatggacaagggcactgaggagatcatccgcaagggtatccccggccagatcgtggagacgtatgaggacactgtggtcagcggcgaggtagtatctaccaagtatatcggtgccagccacgacacctcacacgcggagctggtgcgctacggcacccgcgtctacgaggtggaggagggcgacaccatcgaaaaagacttccccaacgaggtgggcgagggcggctacctgctgtttgcctccggcgacaccatgacctataacaaggtgatgctctgctcctccaccgcctactacagcggcggcgacggcggcgcggcctggaccacggcggtgggtgccgcggtgggcgtgggcaccgtggccgtagaccccaaggtgatcccctactacaccaaaatgttcatccagaccaccaacggccgccgtgtctacggcatgggcaccgccctggactgcggcggcgccatcaagggcaacatcgtggacctgtggttccccaccaaggcggactgctactcctggggccgccgaaacgtcaccgtgtatattctggataaaaaggcaagctaa

SEQ ID NO: 1275 - DNA, 669 bp, Unknown
  Artificiall/Consensus sequence
atggatacctataagatcatcgaagtaaaagagagcgtgtttgccgacaacgaccgggaggcggcacgggtacgggaggcgctgaagcaaaagggaacgttcctgctgaacctgatgtcctcccccggcagcggcaagaccaccacactgctgcggaccatcgaggcgctgaaggacgagctgcggatgggcgtgatggaggcggacatcgactcggacgtggatgccgccgctattgccggcgccggggtacggtctatccagctgcacaccggcgggatgtgccatctggacgcgggtatgacggaacagggcctgcgggagatcggcacggacgatctggacctggtggtgctggaaaatgtggggaacctggtgtgtccggcggagtttgacaccggcgcggtgaagaacgccatgatcctctccgtaccggagggccacgacaagcccctgaaatacccgctcattttcaccgtctgtgatgtgctgctcattaacaagaccgacgtgctgccctatttcgacttcgacatggacaaggtgatcgaatacgcccaccggcgcaatccgaagctggaggtcttcccggtatcggccaagaccggcgagggtatggacgcctggtgcgactggctgcgtaagcaggtgaaggactggcaagcatga

SEQ ID NO: 1276 - DNA, 1350 bp, Unknown
  Artificiall/Consensus sequence
gtgcgcggcgtgtcttttggtgagcaaatgcggcggcggcgggaggagctggggcggacccgccaacagctggcggacaggctgggggtgtccgtatccgccgtgggcaactacgagacgggcatcagcgcccccaaggaggaggtgctcctgcggctgtttgacgcgctggaggccgagcccaactatctgtaccggggcagctaccgcgccgccgccggcggccacagcgacgaggagcgccgtctgctggccaaataccgggatctgcccctgtccgggcgccagaccatccacacactggtggacgcgctgaccgaaatgactgacgacctgcgcaccgccgcacccgccgccgagaggcggggcattccgctgtacacatcacccgccgctgcgggctttgccgcgccggtgttcggcgaggactacgagctgataccggtcaccggcgacgtaccgcccggcgcggagctggccgtgcgcatccagggcgactccatggcgccggtcatcgccgacggcgccgtggtctatgtgaaccacgacccggtgcaaagcggcgacgtgggcatcttctgcgtggacggcgatatgctgtgcaagcagtactaccgggacccgctgggtatggtatacctgttctccctgaaccggaagcgcgcggatatggacgtgatatttcatcggggcagcggccgcagcctgacctgcttcggccgggtgatgctccacgcccagcccctcccggagggacatataaaacgaagcagcccgcctctttcgaggcgggctgcgttttcgcggtcacaatataaatcctccgtcgcaggtgagcacctgcccggtgatgaacgacgccttttcgtccgccaggaagctgacggcggcggcgatgtcctccggcgtacccaggcggcccagcggcgtctcctgcgccagctgggggagtacctccggcggcagcgcgtccagcatatcggtcttaatgacacccggcgcaacgcagttgacccggatgcccgtgggcgccagctccgacgccagggaacgggtcagcgcgatcagtgcgcccttggtggcggagtacgtcacctcgcagctggcaccacgcaggccccagatggacgacacgttgacgatgcacccggcgtgctcgtggagcatatggggcagcaccgcctgtatggtgtggaacgccccgtccacgttcacggcgaaataccggcgccacagggcgtcggtgatgtcctggaacagcgcctgtcccgccacgcccgcattgttcaccagcagcgacacggggccgagctcgccctccacccgccgcaccatctcgttcacctgtac

SEQ ID NO: 1277 - DNA, 564 bp, Unknown
  Artificiall/Consensus sequence
atgcccctgaactttttattgctgtgccccgtgctgtttgcgctgtccggtgccgcccaggatgtcggggcgcccggaatgccgaatgtggatttggaaacgccttccgggcagaagctggcggcggagaaggcgactatccgcaaattcttcgtgctgctttatttagccgttctcctgccggtcgtggaaaaccagggcgaggtattcaaggaaaaggacctttatcccctgatactggcggcttttcctgaacaggaattgaaggaatgcccgcaaaagctccaaaagctgatgaatgccagggttcaggctctgaaagaggcggcggacggaaaaagggatttgcagtccgagccgtttaatccggaagacccggaggttctggcctttctggcggaatacggcatggaggacatgtgccgccaggccttgaactggatggagcgggaagtcaacgcccgcggcaacatggaccaggactcgtttgcccaagcgttcaagcaatttcgcgatcatgtccgttcagggcgcctcgtcatgccggagacggtggaggaataa

SEQ ID NO: 1278 - DNA, 489 bp, Unknown
  Artificiall/Consensus sequence
ccgcagccatcgcgcttccgccttcttcatttcacagccatgccttccaaaacgcaccaggacattctgctcatgcggtgggccctgttctccgtagcggggatcatcctgatcgtggtgctgtattccctgggcgtcacccccgcctgggcgcaagccctgaagggagccatggcctccgctccgtttctgctggctgcagatgctccggccctctcccccggcatgggcttcctgctgtgcattgcgctgacgctggccctggtttacgacctgatcctgatccgcggaacactccgtaaaacggccgttctggccgccttccttcttctgctggcctgctttaccccggtgctggggctgtggggcatcttcttcaacgccgttccgtgcctgctctccgcggggagcgcgggtgcgctcgccatcctgtggccccagccgtcgcccggcccgcatcattccgaacatccccccactcatgaataa

SEQ ID NO: 1279 - DNA, 567 bp, Unknown
  Artificiall/Consensus sequence
atgattaaaagtttgtttgcaggtgtgatggtggcggctgcgtgcgccgtccaggccggtgaatacggagacagcgccgtccaggccgcccgggagctttccggagcggtgaaaacgggggacatgatgtggatgattgagaagatgtacgctcccatgaagaagcagcttgtttcttccttcccgggaggggaggccgccttcatgaagaccatgagggaaaagatgcagggagccgccgccgtgatgaaagagcgcggcatggtggtggagacgtatgaaataggccagcctacggcggaacatctggtgaagaatggagacgaggtgctggtggtgctccccacgcggatggtcatttccatgaagcgtccggacgggatgcctgtaaagatagagaatacaggcgttctggtgctggtgaaggatttgaaggacaaggggccctggacgttcattgatgcttccaagatgaatgcgaatgccctgcgctccatgttctatgacctgccggaaaaggtgaatctgccgccggtttcctcccgccagcttcccgtgggccagtag

SEQ ID NO: 1280 - DNA, 876 bp, Unknown
  Artificiall/Consensus sequence
atgatgaacctggctccgatattggcgggcatagccgttgcaggcttgatttatcaagcggcggccgtgcctgccccttttaaggtagaagccattccccaccaggcggaaggagagccgtacacggccatggcggcgcaggtcggaaaagacatgctcgcctccctgattccctaccgggtctttaaaaacggcggtgtgacctactaccttggggacaaggacacccctccccttcaggtatgggcccaggaaaagctcacgggcctgacgattttcaaggtggatgctgcccgcatacacgacgggcaggcggttgtgacgccctccggccttctcaagcgcggcgacaagctggcctttgccagcagccggaatgaaaccaccctgggaatttacgtgggcatggagcactccataggagacaccagcttcccgctgcgtcttgtccgcgcccaattccccaaactggctgcgccgcccatcggccagccgtgctatgacgctgaaaaccgtctggtcggcatcgtgctgggagtttcccgcaagggaacctgccacctgctccccgcccaggccatctccttcctggcaacccatccggaagccaagagggtgcgcctgggatgcctgctggatatcaatgcctccactcccgtcattgaaggcctcattaacggaggccctctcgcgcggggaggcatccagacaggagacatcctcatcagcatcaacggcacgaccattaacaactacggggacatgctggatgccacctattacctcacgggggaaaagcctctgaccgttgaagtcattcgcggcacccaggtggtaaaaagcaggggcatcatccccacgcaggactcccgttaa

SEQ ID NO: 1281 - DNA, 1140 bp, Unknown
  Artificiall/Consensus sequence
atgaatccgctgccttccgcccttctcctgggcctgaccgccgctctctgcgccgcccatgacgccattccggacggagtggaattcctgcgcgcctacatgcccgcgcaggacagggaaacgattacggaagaacggctggaccgggaagtccgcctggcgctggacgcccgcagccagttcccctgggccggcaaggttccgtgggagctttatgaaaacaacgtgctcccctatgccgtggtcaacgagccgcgcgacgaatggcgggaacagttccacaacctctttgcgccgctggtttccgcatgcaagacgggccgggaagccgccctcacgattgcctcctgcatccagaaaaccctgaatgtgcgctattccacggaaagaaggattcctcaccagggagtgaaggaatccctgcaatccggcaaggtttcctgcacgggccagagcatcctgctcgtctgcgcgctccgctccgtgggcattccggcccgcatggccggcgtccttacctggaaccatgtgcgcggcaaccacaactgggtggaagcctggtgtgacggggaatggaaaatgctggagtacaacgagaaggatttcaacaccccgtgggtgatgtccgccatcagcatgctggacccccgcaagccggagaacgccatttacgccacctcctggaagaaggagggcgccggagagttcttcccgctgatctgggaagcccgctacgacgaaaaacggcgcgcgctgaccttccctccggaaagccggaccgtccccgccgtcaggatcacggaccgttatatgaaactggcgtcggactgggtggcggcacagccggagtacctgccgggcagcaggctgatgctggatatcagggatgggaaggaaggcagcggcagaagactgcccctgcgcgtcgttctcaagtcggaagaagggaaagtcctggcggaaggcaccacccccggcccctccgacgacatgaggaagtttctggaagtgcgcctgccggacaacgtctcccgcggcattctggaattcatgctgcccgacggaacagtgcgccatgaacccgtggcccatacggaagccccggtgcagattttgaatttctccgtgaccgctccatga

SEQ ID NO: 1282 - DNA, 684 bp, Unknown
  Artificiall/Consensus sequence
atgtccgactatctctcttctctgggctatcctttccgtggaaggcccatggtttttgcctttgccgtcctcattgtatgggccatgttcctggcggcctgggcgcccctcatcggctggattgccattttttgtttcctgcaaccgttcatgtgcgcctttttcatgaagatggtgcagcggtccgccatgggggaggaggaaatctgcctctttccggagttggaggaatggctggacgatctgatgatgccttacatccggctggtgatgtgcatggcagtctccttcctgcctctggtcatttatctgggagtgatggactgggacatggacagcccccttatctggctgttcattgcggcgggtgcagcttatttcccgggcgttttcatgaggacttccgtgctggaaagtttttccgggctttctcccgcgggctggtgggggcttgtcagaaaggcgcctcttccctatgccgggctgctcggcgccatctgcgcggggggatgggtgattctgagccttccttccgggtttctgatggattttgccatggcgcccgtgaagctgtatgtcgcctgcgtgctgatgaacatgtgcggcttgttcatgctcaagcatgaatttgccggggaagaggaggagggcggtttttccatctccggtcccgccgcttcatga

SEQ ID NO: 1283 - DNA, 768 bp, Unknown
  Artificiall/Consensus sequence
atggaagatgcgcctttgaatgcggattttatcaatttaacggcggacaatctggccagtgaacatttatgctgcattatccgtagccgggtcccccatccgggcgttgaagcaaagcggcaatggctttccagccggatcagggaaggccacgtctttagaaagttaaatgccaagggagtggtttttattgaatatgcccctctggagacggcctgggtccccatccttggagataactactattatatatattgcttgtgggtttccggcagctacaaggggaaagggtatggaaaattgctgatggaatattgtctggctgatgccagggaaaagggcaaatccggcgtttgcatgctcggagctgaaaaacagaaggcctggcttgccgatcaatccttcgcgaagaagttcggctttggggcggtggatgctgtcagtcatggctatgaactgcttgctctttcctttgacggaacaacgccgaggtttgcgccgaatgccaaaaaggggagaattgagagccgggagctgacaatttattatgatatgcaatgcccctttgtacatcaaaacatggagatcataaaacgttactgtggagagaacgatgttccggtatctctcatcagggtggatacgctgcaaaaggcaaaggaattgccctgcgtcttcaataactggggcgtgttttacaaggggaattttgaaacggtgaatttgttattggacattgccaatctaaaaagaatcctcaagaaatga

SEQ ID NO: 1284 - DNA, 1119 bp, Unknown
  Artificiall/Consensus sequence
atgaaaaggaagcttatccgggttgcggcgtcccctatctcgctggacctgctgctcaagggccagttgaattacctgaacgggttttttgacgttcttgccgtggcttcccccggagcggcgcatgcgcgcatccgccgccgcgaaggcgtggaaaccgtggagctggagatggaacgggccatttccctgtggaaggatttgaaaagcctgtggcgcctgttcctgctgttccgcagggaacgcccgtggggagtgcattccgtgacccccaaggccggactgctgagcatggcggcggcggcttttgcccgcgttccggtccgcgtccataccttcaccggcctgatttttccctaccggaagggggccttcaagttcctgctcaagcagatggaccgcctgacctgcctgtttgccacccacgttattccggagggggagggcgtccggcagctcttgatggcggagaaggtgacgggcaagcccctggaaatcctggcccacgggaacgtcaacggcgttgatcctgattatttccgccgttccggctgccgggaggaagtgaggaagcgtctggaactgccggaagatgccgtgctgtttgtttttgtggggcgcattacggaagacaagggcatccgtgagctgcttgccgcgttttccgccctgcgcgcagagaccgggcgtcctcccgtttttctggctctggtgggatggacggaggattacgccggagacaagctggacgtgcccggcgtattccgccccggttttcaggaggatatccggccctggctggaagccgcggacgcgttcgtgctgcccagctaccgggagggatttcccaattcgctgctgcaggcgggtgccatggaactgccctccattgccacggatatatgcgggtgcaatgagattgtgaaagacggcgtgaacggcctgctggttccggcacgggatgaagaggctctccggcaggccatggcggccatgcgggacgacccggaacggcgcgggaggatgggcgcggaagcggcggaacaggtgaaaagccgcttcagctgccggatggtgtgggaagcattgctccatttttacgggagggcgtcggcatga

SEQ ID NO: 1285 - DNA, 663 bp, Unknown
  Artificiall/Consensus sequence
atggagagccttcctggaatagaaaataagcgcatgaaaaagaaaatagaaatcgcttcctggccgcgaaggtcccattacgagtatttccagacgtttgaatgtcccatgttttccatcacgtctcccgtgcgggtggatgccttgtaccgttatgcgaaacaggaggggatttcctttttcgccctgtgcctgtttgtgctgttgaaggcagtgaataagattccccaactgcgccagagggtggaggaaggggaggtgtgggagtatgaatccgtggacgccctggttccggtgctggctaaggatggggaattcacccagattttagtagagtaccgggcggagctggctgattttctggagcatgccgttccgctcattcaggcggccaagcaggctccggcccgggcgaatccctgccatcggacggatattgccgtgttcagctgcctgccgtggattccgtttacgcaggtggccagcgcctacagggtgttccgggggcagtaccttcccctcatccattgggggaagatggaggcggacgtttccggcaggctgatgatgcccgtggccattcaggcgaaccatgtgctggtggacggggttcatgttggtaatttttataaaaatattgattgtttttgttgcgggttttag

SEQ ID NO: 1286 - DNA, 1635 bp, Unknown
  Artificiall/Consensus sequence
atgccatcattgacccgccaggggaacatgacggcacggaaaagccttcaacccgccgcgagacgagaaaaaacgatatttttccgcctccctgaccgtatactgaaaatgaaatactacctgcggacagcatgcggcgtcatcctgggggcaatagcctgcgtgcaaggttttggagctacggcccatcatgacagctgcatccaggaaggctggaaagaagaaattccccagccggtttaccctgacaaagacctagtggacctttaccataaaacatgggaaatcgcggccggacgggtaagaaaaggccctgagggcctccccggctcgccctacatggatgaaaactgttacgaagaccaaatctggatttgggatacctgtttcatggtgctctttgccaagtacgcgccgaattcatttcccggagaaggaagcatggacaatctgtacaaacccatttgggataaggaaaaaactccgcttcgcattcacctcgttgacaatcctccgttattcgcatgggttgaaaaggaatattacgactttaccggaaacaaaaaccgcatccacgaaatcctgaatcggaaacagtaccttcaaaaacattttgactggtttgccaatgccaaagcgggggaacgtttcgaatgctctccccaaaacatctacctgaacgccattggtgaagatggttttacatggacgggcgccgccagcggaatggacaacacgcccagaggccgggacgcaggcggctacaataagattttatggattgacgccatttcccagcaagccctgagcgcacgctgcatggcccaattggaacaatcactgggcaatgcagacgcagccggaaaatgggaggccatctaccgcaagctgaaagacaaaataaacgaactgtactgggatgagcaggacgggttctactatgatgtggcgatagaaaacaggcagccctgccgcatcaggacaatggcctcctactggccgcttttagccggaatcgcttcgccggcccaggcggaaaagatggtaaaataccttcgggacccgcaggaattcggaggaaactacccgacgcccaccctttcccgcagggataaggactaccatgaccaaaccggggattactggcgcggcggcatctggctgcccaccacgtacatgaccgtcaaggcgcttgaagaatacggctaccatgaagaagccgacacgatcgctgaaaaaatcatccgccagcaacttgccgcttaccacggcatcaaaccacacacgatatgggaatgctacagccccagttccaacgagccgtctaccgaacatggccgcagggcccgtccggaattttgcggctggtcggcgctgggccccatttccctctttattgaaaacattctgggattccataaggtctctgcactccggaatgaagttcagtggagattgaaaaaagagaaaggcaggcacggattaaaaaatcttcatttcgggacgactaccaccgacatcgtttttgacggcaaaaacaccgttgacgtcacaagcaacaactcttattccctagtgattaacggtaaaaaatacgccatcaagcccggaaccgcctccatcaccctgaaataa

SEQ ID NO: 1287 - DNA, 615 bp, Unknown
  Artificiall/Consensus sequence
atgaaagtttccgtcctgtttttgtcactggtagcctcctgcatggcctgcgccgaagttcttccgttcaagacgccctcttttgataccaagagatgcgctgacagcgccaagtcctccgtgtccatggagcagaaggaaacgtgcgttgaagtgaagctgctggacggggagaacagcatggaggcaatgattcccttccgggacaagaacgattacagtaacctggccgtttttgaaaaggcatttgccaaggagaatatttcaaagaagcttgatattttgaagaaggtggaaccgaggctggtcaagaccattatccggggcaaggaggtgaaatgcccggtggtgccgctcgtttctccgatcaagggagaggacggcttgatgctggcgcttttcctggcgtcctatgaaaagatagatttcaaggcccagcaggaaggccgctttcagaagaaaagaaacccggacgacatcaagtttgtatatggagtgatttttgaagtttccgatcccgtgtccaagaagaagctggccgccccagtcaagtgggagcaggcggagacgatttccgcctggattgatgccgtgcgcaaggaggttaagcagtag

SEQ ID NO: 1288 - DNA, 741 bp, Unknown
  Artificiall/Consensus sequence
atgccccgttttttcccgtttttacgggagatgggcagatcgtcccgggtatggtattgtgttccagcgggatggaaaaaaacagacattccatttgacagccagaaaaccagggtgtatacgccgcgctcctttttatccgtcatcatgatgaatattgcttttattacctgtttcgtcggtgttctggggatgtgtgcgggagcgtccctggccgagggcaagccgtggtccggagaaaaagttccgctggcggaggacggcgcggtggttctggatgacaatgaatacctgctgaacctggcggattatgaaaaactggagcagggaggcggtttgctggtgcggtatgcagccggaaagaacgggctccgggaagactccggcgcgttctattttgaaaacagccatggaaaaatggtgagcgccgccgtggagccggtatccggaaatgccggaaaaacggaaccggagcgtctggccctggtcagtcccgctttcccgctgaatccggaaggtaagtggagcctcaagcggaagagcaggccagccgaactttaccggaagaaggtggccgtctcccacatggaccaggaatacacgttccagagccacgaagatgcgcaggtgaaactggtgcacggcgtgctggcaaatgccctggtatcgggaaataaccgctccaagagttataactctttcaaggtaagccgtcctacccccccccccccttctttctga

SEQ ID NO: 1289 - DNA, 1338 bp, Unknown
  Artificiall/Consensus sequence
atgaataatccctcctttatttcctatcaaaagatatggctcatgtcgtatcccctcatgatcagcctgatcattgagcacatgatcggcctgacggacgccattttcctgggccgcgtgggggatgtggcgctgggagcgtgcgccctgggcggcgtgtattacatggccatgttcatgctggctttcggcttcggcttcggggcgcagatcatcattgcgcgccgcaacggggaacgccgttacaaccgcattggacccaccatgatccagggctgttatttcatgctggccctggcggtggttctgttcaccgcctcccaatatttttcgcccatcatcctgcgggatatcatcgagtccccgcaggtttacgacgccacggcggattacctacactggcgcacctacggcatctttttctccttcctctgcgtgatgttccgcgcctattacgtggggattacccaaacgaagattctgacgatcaattccgtcgtgatgctcctgagcaacgtggtgctgaattactgcctcattttcgggaaaggcggctttcccgtcatgggcatcgccggggcggccattgcctccagcgtgtcggaggccgtttccctcctctttttcatcatttacacgggcacgacggcagacaagcggaagtacggcttccgccgggcgttcacgttccgtccccatctgctgaaaggcatgctgtccatttccggctggaccatggtgcagtccttcatttccgtctccatctggttcatctttttcctggcgattgaacatctgggggaacgccccctggccgtgaccaacatcgtgcgcaatatttccgcgctgctcatcatggtgatcagcgccttcgccaccacggcgggggccctcatcagcaaccagatcggcgcgggggaacagcgctacctgttcagaacctgcgggatgacgcttaacctgacgtatgccatcctggttccgctgcttgtcatcctgtgcctgttcccggaacccgttctcagagttttcacggataatccgtccctgattgccgccagcattaattccgtttatgtgatgtccacctccaccttgatcatggctccggcattcatcctgtttaatgccgtatccggcacgggcaacacgaaggcgggcttcatcatggagatgatttccctgactgtttacaccgccgccgtttattacatcgtcatcaggctcaagcctgacgtggctctctgctggttctccgaacacgtttacggcattgccctgatagcactggcgtggtggtacctgaagagcggaaaatggcgcggcaagaaggtataa

SEQ ID NO: 1290 - DNA, 486 bp, Unknown
  Artificiall/Consensus sequence
atgaaaccgcgtcttgaactttataatcatctggaagaagggcgtctcagtccgtccgttgcggatgccctggcccgtgccctggatgcctgcctccccgctgtgctggcattgcctgaaggccctgtacctgttctctccggattggacgaggtggaaataagcgtggtggacgatgacgtgatccgggacgtgcacgcccgttttctgaatgatcccacggtgacggacgtcatcaccttcccgcatggggacggaatgggagaaatcatcgtcagttatgataccgccatccggcaggcgtcggaattcaatgagccggttttcagggagctcttccggtacatggtgcatggtctcctgcacctgcacggctacatagacacggagccggaagaacgggaacgcatgttctcccgtcaggaaccgctggtgcgggaattcgggactgccctggcaggcatctctttcccggataactgctga

SEQ ID NO: 1291 - DNA, 411 bp, Unknown
  Artificiall/Consensus sequence
atgactgatactcattacacctccgagacggagaacgtcgggcaattccgctgtgaaaccacctacattccctccaacatcacttttgccacggacctgcccgcctcttttgaaggccgcgcggagtttccctcccccggcgtgatgctcggttccacgctcgcctcctgcatgatgagcctggtttccgtggtcgcggccagaaagggcgtggacctgaaaggcatgcgcgttctggcgcgcgcggtggaatcctccaaggggattgaaaagattgagctgaaggccgtaatgcccctggaaagcagccatcccctccgttccatgctggaaaaaacggccatgagctgcccggtccgccaggcgctgaggccggacatggaaacgcccgttgaatgggaatggaagtaa

SEQ ID NO: 1292 - DNA, 750 bp, Unknown
  Artificiall/Consensus sequence
gttactaaaatggcctaccgaaaactccaggatcttcccttccaatccctgccgcgggaaaagctgctccgccagggaaggcacagcctcagcaatgcggaactgctcgccatcttcctgcggatgggcatcaagggaaaaaacgtgctggacatgtcctcggacctgatccagtcggcaggctctctggacgccctggcccacatggaggccgcagaaatagcggacatctgcaagggaataggcatggcgaaagcggccacgctgagcgccgcctttgaactgggagcgcgggctctccgggaaacgctggcccggcaacctatccagacgccggaagacgtctatgactacctggtaacagccatgcgctggaaggacaaggagacggtactcgtcctgctgctggataccaaaagccgtctcatcaaacccgtggaaatttccagcggcaccctgaacgaatccatcgcccatccgcgcgacattctgcgtcccgccgtcatccacaatgcctacggcttcgtcctggcgcacaaccatcccagcgggaacccggcacccagccgtatggacgacctcctgaccgaacgcgtgcgggaatgcgccaagctattgggcgtccggttcctggaccacgtgatcatcggaaaacctaccgaaaccgttcacagaaactattacagctacaatcatcccaacggagaccggctccgggaagccgacaagggtctccctctctatcattaa

SEQ ID NO: 1293 - DNA, 822 bp, Unknown
  Artificiall/Consensus sequence
atgattcaggaacttgaccttgctccgggagaacgtgcccggttcatttcagacgtccacttcggccatgccaaggcgctggcccgggagccggaggagctggctttcctgctggaggggtgcactcatctggtggtgtgcggggacctcagtgaaacccgtgaaagcccctgccaggcggaagggctggaaaaacgcgcccgtttcctgcaaatgtgccgggatgccggagtgcagcccgtgctgctggccggcaaccatgacccggatgagaaggccggactgctgaaattgcaggggggacgcgtctgcgccctgcacggtcatgccctgttcaaggaggtggccccgtggggatgggaatatttgaaaaacaagcaggcctcccgtgagctgattgccgcgttcccggaggcggatacggatttgcggcggcggctggaactggcgcgcgccatgagcgtgctggttccccccatttacacgcgttccggggcgtgccggaacaagctggtgcgttttctggcgcattccgcctggccgccggagcggcccgtgcagattcttctggcatggctgacgatgatgcggcgcatgcggaaattcacggaacgctttttcccggaagcggaagtcgtcatcttcggccatctgcaccgccgtgcggtgaccgggaaaaggggagggcggctgtacatcaatctgggcgcctgcttccaccatgccgagtgctgggcggcggacgtgacggcggaggggggcgtctctatccgcagctatacgcctgaagggtatgacggtccggcggtggttctccgctga

SEQ ID NO: 1294 - DNA, 741 bp, Unknown
  Artificiall/Consensus sequence
atgcgcatgaaattttccccctggcgtattctgctggtgtccgcattcgtagcgggttcctccttctgttttgcggacgctcccggagcgtcggaggatccgtccctccgcatttggacgaataaaagcacgggcagtacggtggaggcacgtcctattgccttgaacatgaagaccgtcaagctggtaactacggccaaaaagcccatcaccatgccgttggaaaagctttccgaggaagaccgcgcgtggctggaggaacacaaggaagtgataggcaagcctgttgcggaatggtcctccgtgccgtccggccccgtggcggaggaaatgaaggggaaaacctacatgctggaaaacggcaagcttgaaaagaaggacgggaagctgaatcccgggcatttcatcctgtatttcagcgcaagctggtgcggcccgtgctgccggaatgcgccccacagcgtggaggcctacaacaaggcggtgaaggacaacccggatgtggaagtgatcatgtgcaatctggaccagaacctggaagccgcccagaaatgggccgccgccaacaacatgccctggcccatcctgctgaggcaggatttgacggagcttgccaagaaggtggctccgcgcggcatccctacgatgattctggtggataaggacggcaagcccatccagtcttcccaggacatggaacagttggtgaaagccgctggttcaagccgttcctcccgctaa

SEQ ID NO: 1295 - DNA, 498 bp, Unknown
  Artificiall/Consensus sequence
atgaagatgaaaatattattaaaaataaccattttgaccataggatgcagcgccatgctggccatcaacccatcatttggagcggacgaagcacaaaaacaggccgccggggccgtccagtttcctgccggttcctataaaaatcccgccgtgcttgatcttaaaggggtcaaggattacagcatgctggaatcggcgcgagatgaatacctcagaaaacattacgacggttaccgtgttctgggtgaaggattcaccatgattggaggccgctacatccttaccgtcagcttgacgaatgatgaagacgaaaacaaggtaaacaatcttaagctggtctatttcgacatgactgatgcgtataagaaattaggcaaatcaaaagacaggcagacgcgcgagaaaataaaggaattgaagaataatcaccaacccatgagtgaaaaggaactcatggaaaaactggaacgggggacgacggaaaaaaccggaaaataa

SEQ ID NO: 1296 - DNA, 732 bp, Unknown
  Artificiall/Consensus sequence
gtggtgcggcgcgccgctgaattctttcttttcccgctcccggcaggtgaaaaacaaatgcaaattcctgttccttcgttcagcttttttcccggccttctgaagccggcattacctgcctgttttcctcctcttcagaatacgctccggcgaataatcttgcttgaccgttatttttttattgataatgatgggtctatgaaaaaatccatcaaactgtgctctgttgctctcatgctcgccggatgcggtgtggccggaatgttttccgccagcgcggatactccggctcccaaggccggggaggctgccgtttccgccgtggggaaggctctggaaaaagccgattttttaaccaaggacaggccgaacccaaaagccaaatattatcttttcctgtattccgccagttggtgcggcccctgctgccgggaaatgccccacgtggtgcggacctaccggaagatccgccagaccgatgatgtggaactggtgctgttttcctgtgacaagacggaggaggccgccaaggcatgggccaaggaggaacggatgaaattccccatcgtcaagccgaagaaagggaacggcattcccggttacaagccgggaggctccattccacggctgggaattgtggatggcacgggcaagatcatcatcacagggcatcccgccacgcttctgaaagactggcgcaagttctgcaagccggaggaaggcaaaaaatag

SEQ ID NO: 1297 - DNA, 453 bp, Unknown
  Artificiall/Consensus sequence
atcattcccaacgctgaacaggccatgcaattttaccgcaagaaagcaagaaccatgggggttcccatcgtccccatgattgacatattgaccattctgctcatctttttcatcgttcacacccagtggaaaaagccgcagtccctgctgaaaatagacgtgccgggcgcggagttcatggaaggggctccttccacggagcaacgggccgtcctggccgtgacggggaaatcctccatttccctgaacgggaacctggtggagatgaatgagctggccgccgccctggagtccctgaaaagggagaagccggacgtcaaattgcagcttgacgtagataaaaaggcggagtttggcgtcattgtcggcatttgggacgcgctgacgtctgtgggtattgacgcgggggatgttcctgccagaatagaaatcaacaaatccggcgcacagtaa

SEQ ID NO: 1298 - DNA, 735 bp, Unknown
  Artificiall/Consensus sequence
ttggttggagagaggttggatggaggtattcagaatgatcttctgggaagggggggaggagggcagggaaaggtcgttatgaacgagggtctgccccagcttgctctggaacgcctcgttgcactgctggattccttcacggatgacgaccgtgcgggccgtctggaaaaggagggagagatccattctcagattgacgttctggacgtagatcaggtcatagcaaaggcggcggcagaaggggatgccattgcggccgtggatctgggccatgccggtgatgccgggacgcacggagcagcgcttccggcagtagttgggcgggaacgcggccatttgggacggaatccagggacgggggcccacaaaagccatgtcacccttcaggatgttgatgagctggggaagttcgtccagggaggagctgcggaggaagcgccccagcgggaacagcctctgctcatcgggcaggagctgcccgttttcatccttccggtcgttcatcgttttgaatttgatgatcttgaacagtcttcccctgtaccctacgcgcgtttgaagaaaaaacggggatttccctgtagaaagtacaagaagtaccgaaacggtcagcagcagcggaatgaggatgatgagagctattccggcaaggaggcttccaagaaacggtttgcagatatgtatgtacataagcggcgcggcagagttaccggattgcaaatccgatgtcaatag

SEQ ID NO: 1299 - DNA, 1347 bp, Unknown
  Artificiall/Consensus sequence
atgaccatgattcagcgtattgtcatgaaggtaagcacatgttttagtaccggagttcttttttgcctgttgatggctggcagtccttatggttttgcggagaagcccgttttaacagactggaattatttgccgtcctacgggcagtcgctttccgtagggtggacggcaaagccggtggtgacgacggagcagaaggacggcaatttgatgttcaagggcggcgtccgtccttttgagggcggcaatgaccggagcgctgtgattcccctggtagagggcgtttcacctgacggagccaggggagagacacccgtttccggagcggccggtaatttcatgcgcctgctgaagaagcgcagctcgggtaaagcatccaaggtccggtttctgtgctctgctgacggagtgggcggcgtcagcatcggtgttctttccaaaggcaacgccccctatcagcgtattctggatgatttgacagcggggcgtaagctggcctccaaggccggcaagtcattttccatgccgtgtttcctgtggacgcagggggaaaccgaccagcaggacaggaaaaccggggaatggtacaaggagaagatgcgcgcgctgattcaggatattgacgcggacgccaaggccgttaccggacagaagaacgatgtgctctgctttggataccaggttgcctcccatctcaattattttgcccagaatcccacggattatcccgcgattgccgtggcccagctggatttggctctggaaaaggacagccggtacatcatgactacgcccatgtaccatttttcctatagcgacggggtgcatttgaccgctcccatgtcccggctttacggggagtatgccggatacgtcatgtacaaggtgctggtggagggcgtgcattggaagcccatccatcctgtcgcccatgcagttggcaggaaggggaaggattggacggtagacgtgaagtttttcgtgcctgtgcctccgctggcgctggataccaagacgatccttgatccgggcaattacggcttttccctggtgaacgcgcagggcgaacccctggagatcaagtccgtcacgctgaacggcagagacgccgtccgcatcataatgtcgtccgacccttccggctgtcatctccggtacggaatgaccttgaaggagaaacttccttccggcccgcgcaccggagcgcgtggatgcctgcgggattcccagggggagaaggtaaagacccggattcaggacgtcgtttaccgcatggacaattggtgtccgtttttcgactatcccctggattcccggaatgggatgaacaagacgaattccaggtag

SEQ ID NO: 1300 - DNA, 417 bp, Unknown
  Artificiall/Consensus sequence
ctgtcaaggcaccggacgcttccggcgaatcatgaaaactgcgaattccccacggagcatttcatggcagccgcacaggggccggccaccagggaaaggaaggatatgagctattattttatcgtaacggtttctttaagctccgatgcagacactccatacgattcctacatccgggaagtgaagcccattgttgaaaaacacggcggcgaatacctggtcaggaccaatgaggtcgttccgctgagctccgggtggaagccggaccgcgtgatcgtcatccgttttccctccagggaaagcctggaacgctgcttttcttcggaagaataccggcagatcaagtcactgcgtgaagattccgttgacagccacgccatcatcgtgaaaggaacggatggtgatgaagctcggtga

SEQ ID NO: 1301 - DNA, 552 bp, Unknown
  Artificiall/Consensus sequence
atgccgggaggaaaactgctcttgccggaatcggaacggctggcattccgggcgtggggggaaaaggactggcccttttttgcggccatgaacgccaatccccgggtgatgcgtttcttccccgccgtcatgacggaggaggaatcccgcgccatgtggaaccgcctgcgggcggaactggatgaaaagggttacggggtgtacgccgtagagttgaaatcttccggctccctcatcggccttcttggttttcattgggcggattttaaagcggacttcacgccctgtgtggaaataggctggcggcttgtgccggaagcctgggggcatggctacgccacggaaggggccacggcttgtttggagcacggttttgccaggttgggccttgaccgggtgtattccttcaccgcctgcgtgaatcttccttcccaggccgtgatgcagcgtgccggaatgaggaagacggcagaattcaaccatcccaaagtagctccggattccgtcctgtatccgcatgtgctgtatgtaagggaagcttcccacgcatga

SEQ ID NO: 1302 - DNA, 1125 bp, Unknown
  Artificiall/Consensus sequence
atgaagcatcctgattttttggacaacagggattttacgggggaagacaagaagcgcccctccaccatgtccatggacaccagctaccaggctctggaaggagtcgtcaaaaaactttccgaaatagcctccaccaggcacgatccccgttacctccaggagtatatcaagacgggcatcaacatggcgcagtccgaagcctccgaccacgatttcaccgtcctgatccgttccgggcgggagatgtaccgggccaactgcgttttcgcgccgtaccgccacatccgcaagatttccgtgttcggctccgcgcgcatcaggaatgatgagccggcgtatgaaacggcgcgggagttcgccagggaagccagcgaacacggttacatggtcattacgggtggcggaccgggcatcatgcaggcggccaatgaaggagccggcgagcaacgctccttcggcctgaacatcaccctgccgtatgagcagacttccaaccacgtggtagcccacagcgacaagctgatcaatttctattatttctttgtcagaaagctgaatttcgtagcggaaagcgatgccatggtggcgttccccggcggcttcggcaccatggacgaggtgtttgaaaccctcaccctgatccagacggggaaggccaccatttacccgatcgtccttctggattcccccggcaagactttctggctgaactggctggccttcatccgcgtggaactggtggattccggcctgatttccgcggatgacctgcacctcatccacgtcaccaagaatccggcggaggccatggagcacatcgaccgcttctaccgcattttccactcctaccgttttgtcagggacgccatcgtcatccgcctgaacacgcacctgcccgcccagtgggtggagcatctggaacgggatttttcagacctgatcctgcccgggggaagaatggtccagagcggaccgctcccggatgaggcggacgaaccccacctggaccggctgccacgcctcattttccccatcaaacgcggcaattacggcaagctgaggctgctgattgaccgcatcaaccagacgcccagccggacttattccccaccctcccatgtctga

SEQ ID NO: 1303 - DNA, 513 bp, Unknown
  Artificiall/Consensus sequence
gtggtctatttccatggcggttcggtgaatgccgcttctttctgcggcagcgcgcaaaaagagaaggtgcgcaggccgtttttacgaaagggccttccgttgatgcgccgcgtgtcgggatggagcggcttacggggtgaggataccttcccggaggctgcatttccagtacaggcatgtttttctattccatggcatatttcccggcagggggcctgcccttcctccaagtccgggaatcccttcacggcgtctttttttctttctgcggacatcctttcccctcttttgcgtaaggaagggccggagacggtcctgcgcatgatggagtacggcacctgtccatcctttccccggaagaacggggaactggccttccatgccggcgtcttttcaccggaaaggttattgttcccggagtggaggggcaggccgttcccgacgttcttttcacttccggcaaagggcggcgggttttgtccttgtcaaaacgaatgccgccattatacatga

SEQ ID NO: 1304 - DNA, 519 bp, Unknown
  Artificiall/Consensus sequence
atgatggcccctgccttccatgtggcgcaggaaacagccgtgtggcctccgccccctcccctcagggaacttctgctggatgccgatccggacgaacggcaggtagcggaccatctggcccacggcgaactttacgtcgcacggagccgcggagctgccgccggagctatcgtcatccggcaaacgggggaagacacatgggaaatcatgaactgttccgtagcccctgaatacagaaggcacggttgcggaaccgctctggtgctgcacgccctgcacatcatcaggaacaagggggcaagatatgcggaactgggaacgtgcgatgcctccccgggcccaatggccctgtatgaaagctgtggcttccggatttcaggcgtcgtcaaaaaccactttacggacaactacccggaacccgtctgggacaacggcgtgcagtgcattgacatgatccgcatgcgtgcggacctcttcccgcaggagggggaaacacctccaactggtcagaagctataa

SEQ ID NO: 1305 - DNA, 1443 bp, Unknown
  Artificiall/Consensus sequence
atgaacagtacctttaaaacctgcatgtgcgccctggccctgggcctgtccggcgctgcccccctgtacgcggcttccgccacggcagcctgtgaacaaacgcactccatcctttatgcgggcgcggacagccaggccatcatgaagatcaaggtgaccgttacggaaaccagccagatcctgaagggaatgaccttctccatggccggaaccacctccgtctccgacatcgcgaaggcccggattttctactccggcgccactccctacttctccccgaacgcggagcaggccaaccggagggccatccccgtcctcaacaccatctccaagggggccaaaaccttccaattcgagggaagccacgcgctctccgcaggagacaactacttctggctgtgcgtggacctcaacccccgcgcgcgagggttgaacaaggtggacgcctcctgcacgggcgtggccctgctggaggactccaatgtagcggtcgccaatccttccccggaaggctgcgcggaggtgtatccctaccaattccgcgtggtgccctactaccgcaacaccaacctgatgcagtggaaccccaaccacctgaccgcccagcacttcaaatcattcacggacctcatttacttcaacgtgggatgtgacacggaaggaaacctgacggggcagaacaacgcccagttcctgaatggcctggacaagcttaaaaaccttcgcggaacggcgggcagcaagatcattctgggcgtggcccactgtgacggagggttgacggctttcacgggaaatgcggaaaaaaggcggcagttcgcgtaccagctcgtttccttcgccagggaaaagggatttgacggaatagacattgactgggaatacccggacaacggcacggagtggtacaacttctgcctgctgctgggagaagtgcgctccgccatgggagccagcggcatgtccctgagcgcggcgatcaatccgtactacctggcgcccaccagtgaaatgatggacctgctggacttcgtcaacgtcatgagctatgaccgcgccggacagcactccacctatccggacatgctcatcgacatccaaaccatccgcaggaaaaacattccggactgcaaaatcgtcgtcggcctgccgttctacaccaacgagacgcgctccaaccgcaactgggacgcccagaaaggctattccaacgtcgtccagctctaccccaacatcgcccccggcacggacctctgcgccatcgacggccagcagcactactttaacggcatcaccacgattaagaaaaaatgccagtacgtaaaaacccagaagctgggcggcgtgatgatctggtgttatgatggagatttgctgctgacgcacgcgaaatcattagcaaaagccatgtattccatcatcaagcaacaggctgtccgttaa

SEQ ID NO: 1306 - DNA, 600 bp, Unknown
  Artificiall/Consensus sequence
tccctgtccaaggcaaggaagccgctttttcatggaaagctcccggcttcttcttccatgagtgatctgccctccttctcccgtgacgatatccgctatgcggcggaaatgacccgggtggtttatgaaccggaccgccgcattgatacctttggcgataccaggttcaatttccttctcctcagcgagctgatggatgaagcgggcgtggtgcgcgtgcgcagcggctgggtggaggcggaaaagccgaagatcatacgcccttccgtttacaatgaagtcagtacggagggcttttccggagaggccaagcgcttctttgactggctttccaagaacggaccgggctttttgacgctgctggaatacggcttcaggttcaagaggtcggaagtgaatgaggaaattctgcatgaaccccttgatgccgtgcgcggccgtctgctggaccaggtgcgcaacggagaggatacgttcatggccctcattgaaggggtggatgacgcatgggaggtctccctcttgaaattcaccgtggaaatgatacaaaaatcccatgagatcaatatctttgacttcaagcgcaagggtcttctttag

SEQ ID NO: 1307 - DNA, 972 bp, Unknown
  Artificiall/Consensus sequence
atgctcttcccatgcagccttttccgcgcttccgcggcccttctggcattgggcgcgcttcctctctccgcagcggaacagccggaccccgcccaggccaggcccgtcgtttccatcacggacctgaaccccgtccggctgacgagagacgcccacagcaaacttcttgtggcgcaatgcaccattaacggcgttccatgcaatctcattgtggacacggcggcctcccacaccacgtttgacatcaaattcatcaagaagaatttccccggcctgccgcttgaaaacgcgcagatcgcccccggctccaacgtcaacaccgttccccagcttttcgccatgaagaccttctccatcggagggcttcacattaaaaacttcttcggcctcgccatggacctcaccccccttcaaaaagatatgcaggtcagggtggacggcattctgggaatcaactacctgggcttctccccgttcctgctgtccgtcagggatgcttccctccaatttctggaacgctcccgctttccctcccagaacatgaagccgctggaagtggaacgccacccatccggaattttctatgtccgctgctcccggggaggagacgccttcctgctggcccttgattccggttcttccctttccctggccccgctggaacagtggcccgcggacccaaatggaaaccagctcacggccaaggcctccgacatcaacggacacagcggggaccgcaacgtcatgaagctgggcataccctccaccctccgcatggggccggacttccagatggacggcctttccttcgccgtgacgggaacaggcggcagatgccagataggcgtggacaccctccagcactttgacatcatcattgacgcgccgcagggggaagtcttcgccctgccgctccattccaagccggaggcccgcggacaaaaggctcccgccgttaaacgggaatcttga

SEQ ID NO: 1308 - DNA, 1092 bp, Unknown
  Artificiall/Consensus sequence
atgtccctgcattccttcctccagtcacggctctgccgcacattttccttagaaaaacgggcggcgcaacggttccactctccggaaccgataccgcaccgcagccactggagcatcgtcaaatggatgctcacgcgccgtccgcgcccctatccgtccgtggcggaaaacgcccgtattccctcctttcatgttcccgtggaacgggggcaatgggaggccgtcatggtcaatcatgccaccatcctgattcggctgcacggcctgaacgtgctgacggaccccgtctggtccggccgcgtgagccccgtggcatggatgggccccaaacggaagcggcccgcgggtatcgcatgggaggatctgccgcaggtggacgccgtactggtttcacacgaccattacgaccattttgacgcgcccaccctgaaaaggctggaggaacgcttccaccccgtctttcttgttcctctggggctgcgccgcctgcttctgcgccattgcggcgcacaggcgcagatccgcgagctggactggtggcagtccgccgccctgccgtccggggatggggaaaccaccgtcaccttcacccccgcacggcattacagcggccgcagtccattccacggagacgccaaccggtccctgtggggaggctttttcctgcgcgcggcagacggcccgggaatttattttgccggagatacggcccggacacgctttttcgcggaaatacgggaccgcctcggctctccggacctggcccttctttctattgggtcctatcttccggaagaactcatggcaggcgtccatctgtcgccgcgcgacgcagtccgggcctttaaaacgctgcgcgccaggcagggcatggccttccacttcggcacctggcaactggcggacgacggctaccaggaaacgctggacgatttccgggaagcccttcgccgggaaggcgtggaggaagcatccttcattgccgcggacaacgggtttacgctcccatcaaatggagaacccagtccccagccgcttccatcagaaccagatatcccgccagaatcccaagaaggggatcctccagcttga

SEQ ID NO: 1309 - DNA, 423 bp, Unknown
  Artificiall/Consensus sequence
attgcggaagtgaatggcctgtggcgaaagggggatggcatgaacgctttatcagccgccgccgcctattatctggctgcgggcaggagggaagaagagatggatgaggatgggcgctgccaggatgtctatgtccgtaccccggagcttgtcctgatggcgcgccgggtggattcctccgctcctttcggcaggattatcgatgtccgctgccggtttgagccggaacggtgcgatgcctggcatctccattttctggcgggagaggtgcgggaactgttgacttatgaacgggaaattctttccctgccatggattctgacccagcatggcaagcgcggggacgggcggctgatgaagttgtcttcttcccggttctgccgcctgctggcggcgtctgcggttgccggaccgctctcctga

SEQ ID NO: 1310 - DNA, 1035 bp, Unknown
  Artificiall/Consensus sequence
atgtgcccaaagctgtgcaatcaggcgaattttattgactgccaacggtcggcagcctattaccggggaatgactacccgattgtttacggtcctcgcggccgtgttgctgccgcttgccccggcgcaggaggccgatgtgccgcaccagccgcgcgtgtggaccaataccgccggcaaaaccatcacggcggcttttgtccgcttcaacgccgccggcaggaaagtttcccttaaattggagaaaggccgacaggtggaactgcctctggcaagcttgtccgggaacgacgtggactggatcaaggagcatgttccggaagccatgagcaaccaggagcgcatgcagcggcatacggaaggaaggctggggaagatcactaaaatccccgctacggattcctatccggaagcctttgtctattatccatccacgctgaaggcggaaactccgcctcccgtcatcattctgtttaattccgtaggcaatggacagcacatggtccagaaattccggaaggcctgcgaggccaacggatgggtggccctgggattgacgacgtttaaaaattcggagtccaaggaacatgaagccggactgggcaagctgtggacttccacgaacgggagtttggagagaatggccttttttgatgcggaccgcatgtacatgggcggcatttcaggcggagcgtcccgtgcctttacatatagtgagcgcaggattccgcccgtccgcccgtggaaggggattgtatccatgggcggctggctgggagggaaggaccgcctcacgtgccccacgcgcatggcggtggctattatcaatggagacaaggacggaggagccaacagtgccgtcagccatgacgtcaaggttctcaaaagaaggcagtgcgccatcaaggaatttccctttccgggaaagcatgaaatgccgccggacgagaatttggtggaagtcctcaaatggatggaggaggtgtcaccccagacctccgcgcagcgtcttccctccccggcggaaaaggattaa

SEQ ID NO: 1311 - DNA, 1260 bp, Unknown
  Artificiall/Consensus sequence
atgggccccgtcagcacgcgggagcgttccgtggttctggacgccttgaggggactggcgcttttcggcatctgcctggcgaattttccggagttttccctgtacacgttccagagtccggaggttgtttccgccatgcccaccgccggaatcgaccgggtggtccgcttcctccagtacgtgtttattgacggcaagttttacagcctgttttccctgttgttcggcatcggcttttccatcatgatgtcccattccatggagaaggggcgcgacggcatcgccgttttttaccgcaggatgggccttctggccctgatcgggctgctgcacctgatgctcctgtggagcggggacatcctgcttctgtatgcgctggccggcctgctgctgccgctgttccggaatgtgccggacagaaagctgctggcgattgccgccgcgcttgttttctgccccgttctcatggatgccctgaaggttttttcaggctaccggtttgacctcgccgccccggtggggggcgcagtacggtatttcaacggcctcagcgggattacggacgcgaatttcggcagatggctggtggacggggaacattattccgatgttctgaagttcaccctgtccggggcgttcatccgcgtccaggagctgctggagagcaaccgcgtcttcaaggtgctgggcttgttcctgctggggctgtatgtgggaaggaacggaatttatgcgaatctggagaggcggcggacgctgttgaagagggtatgccgctgcggttttctggcggggctgcccctttccttcctgtacgccgcccatgcgcttcatctgctgggcggcggacccgtggccggggccttcctgtatgccgtcagcgttattcccctcagcctggcgtatgtgtccgttttctgcctgtggttccttcgccggaaggacgctcccttgttccgggcgctggcggctcccgggcggatggcgctgaccaattacatcgggcagtccgtgctgggcatcgtcctgttttacggaataggcttccgcctgggggcccggctggggctggcgcaggtggaactggtagctgcctccgtcttcctgttccaggcgctgttcagctgcgtctggctgaagttctgcctgttcggccccctggaatggggctggcgcatgctgacgtacgggaaaaggctccggttgttccggaagactccggttttccccggaaggaaggcggctccttttaacaagtaa

SEQ ID NO: 1312 - DNA, 906 bp, Unknown
  Artificiall/Consensus sequence
atgagggttgccagattgatttacattccggaaagggaccatacctttcccgcaacgagccctgagaggcccttccgcggcttttccgtggccggggtgagcatagccgcctattgtgcctcccggctccgggaagcgggctttgaggcggtttttaatccggaagccgccgttacggaaagtgcggcggaagtggtagaggtgtccatgcatgatttttccccggaaactgccgcatggcttgcttcctgcgggacaggggaagtacggaatgaagaagggcggctgctggcccggaaagggccggggaacggactgtcacgtgttttttccgggcaggaggcggctgtggagcgcctcgtctatccctgggacctgctggactggcaggagagagtgatggagggaatggagggagacgatttttccgggcggccgggcgtttacgtcctgggcagtctccgtgtgggaaagggcaccgtggtgatgcctggcgtggtggttgagggctccgcatgggtgggggacggctgccgtcttgggcccaactgccatttgagaggatatgtgtccatgggaaacggctgtgtagcggggcagggggtggaactgaagaactgcatcatcggagacgggacgtttattccccatctgagctatgcgggtgattccatcattggcagcgacgtcaatttcggggcaggaacggtgtgttccaatttccgccatgacggcggggagcacaggatgatggcggccgggaggctggaaattaccggaaggagcaagctgggagccgtcattggggatcatgtgcgcctgggcgccaataccgttgttttgccgggcagggtggttccgcccggcgcctggaccatgccgggggaaacattcacgggaacatga

SEQ ID NO: 1313 - DNA, 2652 bp, Unknown
  Artificiall/Consensus sequence
atggactggaaacgcacggatgcggtgtggatgaaatatgggcgcagcctctggaaattcgccggaagctacgggctgggcatcgctctgatgctgatcctgctggtgctgacgtttgccggaacgctgcatcaggtgcggctgtcttcctccatggggccggaggcggccatagaatccttcttcggcgcgccgtatgtgctgataccgctgggcggggaaaactccctggtttccctgccgctgcccggcatgggcattacctgcgccctgctgtttgccaacctgttcataggcgggatgttccgcgtccggtggacctggaggcacgcgggcgtgctggtggcccacggcggcattctgctgctgctggccggcatcatgctgggcaataaaatgacggtggccgtggaccaggtggaactgccccagggcgaccgggtgcacgagcagtccctgccgtttgacctgcgcctgaaccgcttcgtgccggaattttatcccggcacctccaagcccaaatcctatgaatcccaggtaaccgtctttccggaatccggcggccagtatgatgccgtcatccgcatgaacgagcctctccgcctttccggctggacgctgtaccagatgagctgggggcaggactccctgcatccgggcaggctcatctccatcctccgcgcttcccataatcccctggagcagatgcccaaatggtcttcctacatcattgccgcgggactgctgtggcactttgcctgcgtcttcggaaggtacctgcgccgcaaacccggccagcctcccgccggagcggaggcggcggacgaccatctggagccgcccgctcccggcggcaagcgccgcctgcgcctgataggcatttgcgtgctggtggcggcaatcttcggcgtcggcatgctggcggcccggcctgcctctcatccggtccgggtggagcattacgtgccctggtcctccttcctggtggaacgggccggggcaatggccgtccaggacggcggccgcctgaagcccgtctccacgtacgcgggcttccatctgctccggacgctgggcaaaagaagctttggcatggagacgccggaggggaaaaggaaactctctccggtggaatggatgctggactgcatgttccgcccggaattcgcggaacaataccccgtcttcctggttaaccgggaggaagtagtcaggcgtctgcacctgccggaccaggcggacaagcggaaaaaatactcctatgcccagattgcggaacactgggaggaaatgacccgcgccgtccgggaaatccggctgctgggagaaacggatttgacggaagcccagaaggaaatcctggccctttcccgcaactttgacgtggtgcgcggctggatgctcggctcccggatcatgctggaaaacccctccgccatggaacggatggaattcccccgctggttcccctctgcgggccagcacggggagcgtctctggacggcagccccggacaaagccaccggagcctttctggcaatggcctccctgctggaacgcaaggccatcggcatggaaggcgcggaagcctccggactgcggatgaaggcggaaggactgctgctggaaaaactggcgcagcccaatgaagccgcctccgccggggaacggcacagcctggaaagggaaatcttctactaccgcctggacccgctctatgcctccctggccgtctttgtggcggcgttcgtgtgcctgctgctctgcgccctcttccgtcctgccgccaacgctcccctctggcgccgttttctgcggcccggcgggttcagccctgcgtggctgctgggtgcggcggggaccggcgtgctggcggcggccctggtcatccgcgtgctaatcaccatgaggtccccggtgggcaacacgtatgaaaccatcgccttcatcgcgtgcatgggcgtgctctgcgcgctggtggcggagctgttcagcaaaaagggcatcgtgctggcggcggggcttctgctgggggccttctcctgccagatgggcattctgtacgaatcctcccaggccgtggaccacatggaccccctggtagccatcctgcgctccaacttcctgctctccacccatgtcatcaccattgtgctggggtacgcggccgggttgctggcggcggtgctctcccatgtgtacctgctggcctcccccctgcgcctgatcggcaggaaaacggaacaatccctggaccgcatggcttacggtatcctgtgcttctccctggtattcacgctggtgggaacggtcttcggcggcatctggggcaatgaatcctgggggcgcttctggggctgggatcccaaggaaaacggggccctgatgattgtgctgtggcaattgaccgtgctgcacgcgcggaaagccgggtggctgtccccctggctgctccacttcagcaatgtggtgggcggcgtcatcatcgcctttgcctggtggggcgtcaacatgctgggcgtgggcctgcactcctacggcttcacctccggccgtgacgccctggacattttctactggtctgaagccgtcctgtgcgtcctcttcatcatcctgcattaccgcgcgctccggcgcgtggacatcaggtag

SEQ ID NO: 1314 - DNA, 1014 bp, Unknown
  Artificiall/Consensus sequence
atggacataagcacgctgacttccggagccctgatcagacacccttcccgcggccttcttctcgggaccgggcccttccgggaatcggccgcccccccggattccggccccgccttctatgtcaacacgttccgcctggatgacccgcagccgtggaaaataccgtccgccctgcatcccattccggaaccggaaagccccacgccgcccgctccggaaatcctgtggacggaaccgtccccggacgcgtatgcccaggtattcgcggaaatgattgaacaaatcgcctccggacatctggtgaaaagcgttccggcaacgccccagtttggagagatgcagcctccccacgttccccgtgaactcatcctgcgggccgtcaacggttccccgcttcattacccctatgcctggtggacggagcaggaaggcttctgcggagccaccccggaaaccctgttccaccagcagggacgccgcctgacgaccatggccctggccggaacggcgcggccggaagacgagggcgtcttcatcaatgacgacaaggaaatccgcgagcatgaaatcgtggccggcagcatcctttcccgcctgtccccctacggcagcgtcaccagaacggcccgcagcgtgctgaacctggataccctgatccactttgccacctacctcaccctggaagcggacgaactgctgccgccggaccactggatacggctgctccaccccactccggccctgggatcccagccccggacggagaagacgctctcccagttggacgactggcgttcgcgactccgctgtccgtcccatttcggcgctccgttcggatttctggaagacggagacttcttctgcctggtgggcatccggtccatgtactggcaggggcggcggctcgcgctctgcacgggaggcggggtggtggcctcctccaccctgacgcatgaatggcgggagctgaaattaaagcgggatacggtcaggcgcagtttcctgcttccctga

SEQ ID NO: 1315 - DNA, 948 bp, Unknown
  Artificiall/Consensus sequence
atggccggcatgactctggtcgcccaggcgaacgcccagccttatccggattccgattcctcagacggttatgataccggctattatgcggaagcttattccggaggctacaatagctctccggctcccacgggggagaacgcctccaagcccgtttttcccacgcagtcctattttgagctgcttggccccatggattccagaaacggacatgggagcgtgaacatacagaattggatgacggacctgaatttgtgccggatgtccagcggttcctggggcttttcctccacggccgcccttcgtttgagctggttcaatggagaaggcgcgcgcgagatggatgtggatgagctgtacacgatttggctgaatgtgaccgcgtcttacaagctcagggggaagacgagcctggttttcggcgtaacgccgcagatttccacggatttcgatacctggacgacccataatttgtttttcggcggccatgcccttctcgcaggtcccttgaatgaccggttcagctatggtatcggcgtcggctgttatccgcagctgggagattttcccctccttccccttatccagtttgagtggaaggcaacgaacaattggacccttcaactggaaggagcccggctttcctataccagcaaggtgagcgaggggctgacgtgggggcctttcgtttccgtggtgtccggcacctggacgattcaccatgaccgccgcgtccgccagttcgagtggatttccggcgtcgccggcgtgggagccgacgtaggcctgggacactggggcagcgttcgtcccagactggtggcggacgtcggtttttcctttgggaactccggcaccatcaagaccagcaacgggagccatgagctggagaagtaccattacgatcccggtttctacctgcgcgcgggattgcagtttgagttttga

SEQ ID NO: 1316 - DNA, 900 bp, Unknown
  Artificiall/Consensus sequence
atgattgccgccctggccgtgtgcgccatcctgctggcggtgccctacctggcgtttcccgaattcggctctaccgggaatgaaagcagcatccagtggctcgtttcctcctggaacaagcagacggattacgaacacggctggctggtggtccccatcatcgccttcatgctgtaccacgccagaaagaagattgcccaggcgcccaggcgcatggactggcgcgggctgatccttttcatcccggcggccctgcttctggcgctctccttccgcgtgggacagccccgcgtggccgtgggcgcgcttcccctgatcctgctgggcggagcctggtacctggccggaccgcagatcgccaggctgtgcgccttccccctgctcttcttctggctgtgcattccccttccctctttccagcaggccacggtggagctgcaaatcgtcgccacggagctggggcacctgggtgcggcccttttcggcgtggatacctacctgcaaggcaccaacatccgctccaccggcggccactgggacgccttcaacatctcaggggggtgcagcggcatgcgttccctgatggccctgctcatgctgtccgccgcctgggcctacctgtccgacctgaagttctggaaaaaatgcgtgctcttcctcagcgccattcccctggccgtcatcggcaacggcgtccgcatcaccagcattgtggtgctggcggaatacggggaccccgagtttgccgcgaaaacctggcacgactggtccggcctgctgttcttcttccccatctgccttctcggcctggcggccgtccactccctgctggccggggagctgatctggaagccgtcccggcgcaaaaagctggtcgttaaaatgaacaagtcccactaa

SEQ ID NO: 1317 - DNA, 1446 bp, Unknown
  Artificiall/Consensus sequence
atgagaaatacctacaccatggaatatccgttttgcggaggatggatggaacccgcccagtggcaggccgttctggacgccgtggacggcggatgccgccttgtttccttttccaccctgtccattcctctggacggggtggatgagcgggaatgcgtggagaagggcattgccctggcggaaaagctttcccgcctggttccctatacggaacaggccgtggatgtaggttcctccctctgctggggggaaaaccgggacgcatggctggagttcgccggaaagttgaacaggttttccgctcccgtttccttccccgcgtatgaaatacgcaaaaaccgcgaacgtcttttttcctcggacccgcagcctgaagaacgtttttccgccctgcacaagcgcgcccgtatttgtctggaagaggctccgcaccatgaattcgggctgttttcctgtgacctgggctttgtggttcccaagggaggccatccggagggcggcgtgcatttgtttgccggaggcgggggcggcattcaggggggcagtgcggccctggcgccgcgggcggcatcctggctggggcggtattccctgccggaggccgtgaaggcggcgggggtgctgacggccctgaatgaacagttcggggaaccggacaatccgcgcaagaggagattgaagtcgctgttcgcctcccgcagcctggactgggttctgaatgaattgaaaaacgccggcttgtacccgggagagggggggcaacctgagttttcctcttccggggagtggagccgcaatgatttctataacgggctgctggtggcgctcccttccggcagtctggaggatacgccggaatatgccgtggcgtcggcatggcggcgcgtggtcccttttttgacttctccggtgcgcatcacgccgcggggcaatttgaggcttcatccggcggacaggtgcgtggcggaacgcatcaaggtactgctgcgcgggtccaggcatttttccccgctctccattgaatcctgctcctgccgcggcttgccgggctgccgccgcgcccgcgccgcttcttccctggtccaccgggagctcaacggatggctggaagaaattctgcatgaattcgggctggatgacgaacccgtggtgttccggatttccggctgtcccaacggctgttcccgccccctgtttgcagagctggccatggtgggccgcagcgagggcgtttacgatgtttttgccggagggcgcgcccagggcgacaggacggcgttcctgctgcgccgcgccgttccccttggcgaagtgagggagctgttccgggaactcttccggcagttcgcccttgccaaaggggagaatgaggaatggacgttcggggagtgggtctttgaggaaattatgtccggagaaacaggcggaattttgaatcaattatga

SEQ ID NO: 1318 - DNA, 360 bp, Unknown
  Artificiall/Consensus sequence
atgcgccgggacaagccgcttttacaccggacggttgaatttgtgcgtcttatcccggccttttttacaatggcccgcaaggacggttgtccattccttatggaccgcgaccatgaacccaaaatgaaaaaagtggacggggaggaacatcccgcttccgacttcgcctatgttcctgacccggaaaagccctccacctggaaactgccgattttcaacatgcatcatgtagggggcgccctggccgccatgaccagtgactaccgcggcaatcccgtggaaatcccggaaggagaccgccacgccgtcatgaaaaaaatcctggcccggaaagcggagctggaacaggaagaaagctga

SEQ ID NO: 1319 - DNA, 489 bp, Unknown
  Artificiall/Consensus sequence
tccattccgttacgcttgtttcttgacggaattcctttcatgccttatgtaaggagaatggcttcccaacgtaccccattatatcactaccgcgtcaaagacaagattgtgggccctatctgcctgacagacctccacgccctgcttgtctccaagaagattcttccggataccatgatccgggaggaacattcccagtgctggatgccgctcgcaacggagttgcgccgtcaggagcgcctggcgcgcctcagggcatccgccttcatgctttcctgccgccctcctaaaagctgcctcctgttttacatcattgcccttctccttctggcctgcggcgtggcgcattccatcatgctccacaccatcctttacatggaagtgctgttcgtgcctgccatagcgtttttcatgggaaagatgctgatgtacatgcaccttcttaccggaggcatgaggaaaatgcccgcccaggaaccggaacgctga

SEQ ID NO: 1320 - DNA, 774 bp, Unknown
  Artificiall/Consensus sequence
atggacgaccttcctgcggatgggctgcgccgggccggaagcggccgcggcggcctcctttccggtatggccgctgtgaggctcttttcccgggatgcttccgtcaaacgtattacttcatctgccagattccgcaaaggcaacggtagcggggaggagaggagtacacgcgctcctgtaattttccttgcccgcctctgcaagaactggaaaaatggccggatggagaagctgatgcaggcattgcttattattgacgttcaaaatgattattttcctggcggccggtttgaactggcgggcgccgttgaagcgcttgaacggaccagggccgtactggaccggttccgggaaaaggggcttcccgttatctttgtccagcacatcaacacccgtccggacgcttcgtttttcctcccggataccgtcggcgcggaaatccatccggacattgctcccgcgggggatgagccgattgtcgtgaaacatgctccaaacagctttttccggacgaatcttctggagctcttgcaagccagggaagtgaatgaactggttgtctgcggaatgatgacccatatgtgcattgataccaccgtgcgcgcggcgaaggattacggcattcccgtcacgctcctgtatgacgcctgcgctgccagggatttgaagatcatggagcattccatcccggcccagacagtacaggatgcgtatatggcaggcttgaatggaatgtttgcggaaatcaagctggcggagcaactggaactttag

SEQ ID NO: 1321 - DNA, 1491 bp, Unknown
  Artificiall/Consensus sequence
atgaaagtttgctccacggaaaatatgcagatcgcggaacgcgagctcatcatcaacggaactccgaccagaaccctcatgaagctggcttccgccggcattgcggaagccgtcatgcagttctttcccgtccccgggttatgcatagcctacgtggggaaaggcaacaacggcggagacgccctcaccgtcctcaatatcctgaaacagcatggctgggaaacaggtttccgcgccgcctacccgcgcgcggaatggggggaactgcccgtgcggcagctcgcggaaatatctcctccgccccaggaataccaggaagcgccgctgccccgtacgggcaagcccatgattctgctggacggcctgctgggcattggagcaaaagggctgctccgcaaggaaatctccgccctctgcgcggaaatgaactacctgcgggaccgctgcggagccgtgcgcacggtggcgatcgaccttcccaccggagttgacccggatacggggatgccccaggaaaatgccgtagaggcggatttcacgatgtgcataggagcggtcaagcaggggctgctggatgacgacgctaccctgcatgcggggcgcatggcctgcatcgaccttcccggcctccatgtgcaggcgcttcccgccacggaactcatcacctcctcccggctcactaaattcctctctgcaagaccctatacggactataagaacaaacgcgggcacatcggcgtcattgccggatcggaaggaatgctgggcgctgccaggttctgctgtgaagccgccctccgggccggagccggactggtgacgctccacgtccaccggaacgtctatcccctcatagcgccgtccatgccgccggaaatcatggtcaaacccgtggacagttatgcggacgtctccatccggacgttcagcgcctttctcattggccccggcatcggctccgtatcggaggaagacgcggaagccatccgcctcattctggaaaccggcactcccaccgtcctggatgcggacggccttaatctggccgccgccatgcaatggagcctgggagaacatattctggcgacaccccaccatggggaaatccgccgtctgctgccggacgcggacaactgcgccatccgggcggacatcgcagactgcttcctggcggagcatgaagcggccctgatttacaaaggggcccgcaccatcgtcacccagcggggaaaacctctcttctacaacatcaccggaggccccggcatggctaccgccggccagggagacgtgctggcaggcgtctgcggcggattcatggcccagggggaatccctgctggtctccgccgttctgggaacctatctctgcgggcgagcttctgaaatagccatctccgccggagattccacccagcagacactgacggcgggagacacgctgcgccatctgcccgccgccattctttccaccgcacgtctctgttactaa

SEQ ID NO: 1322 - DNA, 687 bp, Unknown
  Artificiall/Consensus sequence
tcttttgaaacgatggcttccatccgcaaatcccagtcggaccgctctgcggaaaccagcggtaaaattctccgtgccgcgcagaaactttttgccctcaggggatttgacggagtgaccatgagggcgattgcctctgaagcaggggtgaacctggcctccattgtttactactttgaaaacaaggaaggactgtacctggccgttttcaggcaatatgcggaacccctgatggaggagcgcatgaaaatgctgaaagaagcggaccttcatccgtccctcagggcgtatgcccgtgccttcattgagcccgctttccgtttgctgctggataaaaacctgggcggtccggatcacgcgcgcctgctgtggcggctgccccaggaaccggaatacctgggaaggaagatttacgatgaattctatgctccgctcatccgggagatgacgttgagggttcgccgattctgcccatgggacgatgagctttccatatcctggcacatacatatcatgagttccattttccatgccacgctggggaaatacgtcacacggctggaacttcatgacaaggagccgtggatgaaggatcaggaccgcatcctgcaaatgattgtagatacggcggtcctgctgatttcccgtccggctctttctccggaggtagaggaaagacaggggtaa

SEQ ID NO: 1323 - DNA, 426 bp, Unknown
  Artificiall/Consensus sequence
tatcaattttcattgacaatttatcatttcaatttcataggtgataatatgatgatggttccaaaaatattgtgctgtttttcgcttgttttgggcatcctcgttggagcggcacatgccaaacaagcaaaatgcggctatgagctcataaatatttcagagccgacagcagagctggttgaaccggttaagggaaaatcaatgaaattcaaggttcatgcgactgccatggcaacttacactcacaaggacggctccactgtttcagagatcgtgaatctggatcagggtgccactgttgtcgtggatgtctcggaagacctgccctggaatgagagagcaaaagaaaaggcgattcttcttttacaccaaaaagccctttccagaagaatggaattatgcagagacaacggatgcagcaaataa

SEQ ID NO: 1324 - DNA, 1275 bp, Unknown
  Artificiall/Consensus sequence
atgccagacgctcgctttcaaccacttcccggattccgtgattttgcaccggcggactgcgccgtgcgcaactatctctttaacgcatggaagagggtggcgcaccgctatggattcctggaatgggaaggcccgaccgtggaagccacggagctttaccttaaaaagagcgggggcgaactgcccacccagctcttccgctttacggaccagggagacagggacatcaccatccgtccggaactcaccgcctccctgggccgcatcgccgccgcctaccagcgggaatacaccaagccgctcaagtggtttgaaatcggctcctgcttccgttacgaaaagccgcagaaaggacgcctgcgcgaattctaccaattcaatgcggacattcttggggaaggctccgcgtgggcggactccgaactgattgccctggccatcgactgcatgagggagctgggctttacgcagaacgacttcatcgtacgcgtctccgaccgcgaagcctggatcaggtttgccgcggaacacggcgtgcaggaacaggacattcccgcctttctgggcattgtggacaaatttgaacgagaccgcccggaagaatgccagcgcaagctggacgccttccacatcagccgcagcgacctggtggccttcattgagaaccctcccgccggagcctccgaacgctatgacatcctgctgaaagacctggaagcccgcggactggacggctacgtcaggctggacctctccgtggtgcgcggcctggcctactacaccgggctggtctttgaaatctttgacacgcagcgcagcctgcgcgccgtggccggcggtggccgctacgatacgctggtaggcgccctctccaacaatgcggtggacatgccggccaccgggtttgccatgggggatgccgtcatcacccacctcattgaccagaccccccatgccaaggcgctgaaggatgcggcgctggccgccgcgggatgcgacgtcttcatggtgcaggcctccgaaaaccgccgcgcggaaatgctctccatcgcctccgccctccgggaccaggggtacagcgtggaccttcccctcacactcaccaaaatcaacggccagctccagaaagccgtcaaatccggcgcgcgcgcggccctgattgtgggagacgaattccctgccctggaactgcgcgacctgcatgcgcgctcctcctctactgtcgccatggagaacctgtttgacgccctggcctccctgaccggccgtgattga

SEQ ID NO: 1325 - DNA, 846 bp, Unknown
  Artificiall/Consensus sequence
ttccggattgtaaatccgatactggctccattcagtaatttttttaataatttcatgaaatcctctctgtatcttacgatgttcctgctttgctcagggttgggagcccaggccgccacattgaaatatttttatgatttcaacaagcttgacggaaacctgtcatctttaaatgacaataatctggccggcccaaatgcgggcaacgccacgttcagcggatcaggctggatgaattataccgatggctatgaaggccggggctatgatagccgcacgaacggcggacaattgacgctgggctcctccagtacgggactggggctgaatgctacggaaggtttcagcctttccattgccgtcaaggactactcccccggcaatacatcgtcctcggctatatggaaaagcatcctgaccttcacatccggcaacagccagaacatgtacctccagaaggattccggcgacgcctccaccgccggggcatgggcggcctattgcggcggaaacgtgggcaactgggccaacctgacgatttccagggattccttttccaacatcatcatcaccttccagaacggggaattgaacatttatctggacgggcagaagaaaatcacggcctccggagtcaatttcaccggagacgtgcagtcactcaagctggcgtccaccgccaatacgaccatggatgacctccaattatatgccggtgtcctgaatgacggggaaatagccgcgctggcggccaaccccgcccttcccgttccggaacccgccacggccacactgagcctgctggggctggtttccctatcgtgcatgcgccgccgccggggttaa

SEQ ID NO: 1326 - DNA, 1176 bp, Unknown
  Artificiall/Consensus sequence
atgattgcggggggaaaaagtcacggaagaccggagccgcgggtatgcggcctggggctggcttccggctttggcatgggggcggcagcccatctcaccggagtgagggaagggcgcagcgtgttgaagccgttgagggaactgtggggggcggggcatccgtggggcgatgttttgagcgggtggattccggacaggaagcttttatgcagccgcaggaacggccctgcctcccagttggcgctgctgctggcgcggcaggccgtggaggaagccggttggggagaggaagaattgaaggatgcggccctgattgtgggcagttcccgcgggaacgcctccggctggctgagcccgtggcccggacggcggtccatgaagattctggccgttcccaattccctgcacagtgagcttgcctcctgcgtcagcattgaactggggattcgtgggccttaccatgtgctggcgagcggctgcgccgcaggtctggatgccgtgggcatggcggccatgctgatgcgtcagggaattgtcaggagggcgctggctatcgggctggatttgcccttgtgccgggagctgctggggacgtactgggcttccgggatgctttcccgcaacggaatgaatgatccctacggtccccatgccgacggcatgtgcatttccgagggaggggcggccatggcgctggagttgtcttccggtcccggcatttacgtgaaggattatctggtgaattccgatgcctacagcccgctgggaatgccggaggatggaaagagcattgccgccctgctggatgccgccctgcggaattgggatggaagggttcctttgaccgtctgcccccatgccagtggaacggcggggaatgccgcttccgagcgggccgctttaaaacgggtttttggaaccggccttccggatttaaggatgatgaagccctggacgggtcatgccattggcggcagcggcattctggaactggccctgatgctggcttttatcagggagggggctttgccgcctaatcctttctgggtaagttccccggcaggtgcggcttgtgttgcggaagaattgcctttggatgggaggcggatgctggttaagtccgccgcttccatgggcggccataatgtagtgctgagccttgacgtgggcggctaa

SEQ ID NO: 1327 - DNA, 3846 bp, Unknown
  Artificiall/Consensus sequence
gaagaacccgccgcgccggcggagacggcctccgcggagccgtccgacggctccacggccgtgccggaagcgtcgcccgcagcggcggaggatgcgacgaccgcgtccgccgatgcggcggcgcagagcgcgaagacgtccctcttcgccgcgcaggcggaggagcgcacgcccgaggagctgcgcgaggagcttgcgcaggccgaggcgacgctcgccgagaagcaatcggccatggagcaggcgcagaaggcgctggatgaaaagaacgccgagctgaaatcgctgaacgaccagctcgcccagaagcagaaggcgctggacgagattcagggcgaaaatctgcagagccgcagggacgaggcccagcgggagatcgaccggctgaacgcgcgcatcgccgcggtggatctggaaatcgcgggcatcgatcaggcgatcagcggcggcgacgaggccatcgaggagatgaaaaagtccctcgcccagctggacgaagccatcgcgaagatcgagaattccgacgagtacaaggcgctcaagctggcactggacaaggacgagctgaaccggcagtatgccgccgccgtggagggcaaggcccagctggacgcgggcatcgcccagatcgacgcgatgctggaaaagctgaacgcgggaatcatccccggcggcatgatcgagggcgtcgacgaggacaccagcattgccgacgcgcgggcgcagctggaaagcggtcggaagcaggccgaggacggctttgcgcaggccgaggcccagctcagcgacgcggaggcgcagctttccgaggcgcgcgccgaatttgaggaaaagcgggacgaggcgctgaagaacgcggggctggacggcgtgattaccctccagactgtgggcggaatcctcggcgcgcagaacatgtccatgcccgcgggctatgtctacgacgtgtccgagaaccagtatctcgtgcgcgtgggcgacaagtttgcgtcgctggacgagctgaagaccatgaagctgttccatgtgggcagcgattcggtggaggacgtgcgcctcatggacgtggccacggtggagatcaccgacaacagcgccgacaccttcaccaagttcaacggtaaggacggcattctgctgtccattgaaaagcagtccaccttctccaccaccgacgtttccaagagcgtggcggccaagaacgccgagctgacgggcgcggacagcgcgctgagcatcatcgacctgttcaatcagggcgactacatcaccatcatcgtcgactcggtgctgaacaatctggtctccggcggcctgctggcggtgctgattctgctgatcttcctgatggactatcgtccgacgatcatcatcgccttctccattcccctcagcgtggtcatcgccttcgtgtgcatgtacttcacgggcatcacgctcaacgtgctgtccctgtcgggtctggcgctgggcgtgggcatgctggtggataactccatcgtcgccatcgagaacatctatcgcctgcgcgacgagcagcatctgcccattctgacggcgtgcatcgagggcgtgcgccagatctccggcgcgctgttctcctccacgctgaccaccgtctgcgtgtttctgcccgtgctgttcgtcacgggtctggcgcgggatctgttctccgacatcggtctggtcatcacctattcgcttctggcaagcctgctggtggccatgacgctggtgcccaccatggcggccagcctgctgaagaagcagaagaaggcgcgcaggcagcccgtcttctcggccatccagcgcggctatgtgcgcctgcttcgcggtgcgctgcgcttcaagccgctggtgctgctggcggcggtggcgctgctggcggtcacggtgctgcaggtgccgagcatgggcatgtccttcatgccgtcggtcaattccacccagatgaccggttcgctgccctgggattccaagggcgacgagacgcagcagcgcgagcaggctgtggagctgatgaaccgcatcatggccgtggacggaatttccgccgtgggtctgaacagtggaggaacctcggcggtgatgagcagcggcagcgagctgagctactacatgatcgtcgattccgacgcgggccgcagcaacgcagccatcgcccgggacatccgcgccatcgccgacgacatgggtctcgacttctccgtgcagaccagcaccatggacatctccatgctcaccggctcgggcatttcggtgaacatcaccggcccggaggtcgagcagctgcgcgccatcgccgcggatgtggccgaaatcgtccgcagcgtggacggcgcggcggaggtcgacgacgggctggagaattccgtgcccgagctgagcgtcaccgtggacaaggaaaaggccatcgacaaaaatctgaccgtcggccaggtgctgcagttcgtggcaacgaaaatcgccggcaagaccgagatctctcaggcgacgctggacggccggacgctgtccatctatctgatcgacggccgcaattcggacatcacgccggagaatctggaggatctggaaatcgaagtcacctccggcgacaagagcgaaatggtgcgcatcggcgacgtcgccgagatcgcccagactcagagcatgggcaccatccgccgccagcagcagcagcgcgtggtcaccgtttccttcgccgtggccgagggctacagcgccaaccacgtcagcgacgcgctggaggcgaagctcgccgattacgccgtgcctgacggctacaccgtggcgctggccggcgaaaacgagaccgtcatgtccatcgcgggcgatctggtgttcatggtcatcatcgccgtggtgctcatcttcctgattatggtggcgcagttccagtcgttcaagtcgcccgtcatcgtcatgttcaccattccgctggccttcaccggcggtctggcggcgctgctgattacggggttggatctgtccatcgtggccatggtcggcttcctggtgctgtccggcgtggtcgtcaacaacggcatcgtgtttgtggactgcgtcaatcagctgcgcatcggcggcatgaccaagcgcgaggcgctgctggagacgggccgtatccgcctgcgcccgattctgatgacggcgctgaccaccatcctcggcatgtccaccatggcgctggccacgggcatgggcgctgagatgatgcagcccatggccatcgtcaccatcggcggtctgagctacgccacgctgatgaccctgttcgtcgtcccggcgatgtacgatctgttcaacggcgaaaagatgtccgcccgcgaaatcgaaatggcgaaggagtccatggaattgagcgacggagaggatgcggcttcgacggaaagcggagcgaaggatgctgcgcccgcggacaatgcggcgaaggacgattctcctgcgaaagcggcggctgatgcgcccgaagaatttggcgaagcgaatgcagacttgccgaacgcggcggcggaagagccgcgtcgatgtgctgtggcggacgcgagcgctgccagcgccaaggcgcagccggagaacctgtccgaagcggggcggatgaatccggtaaatccgtcggtcaacgcggcgaaggcggtgcagacgaattgccccagcgcggcgattcgcccgggcgctctgcccattgcgaggcgcgcggacggcgcggcgagcctctcgaacgtgccggtcgttcagccagcggctcgtccgatgccgcgcggcggaatgcccgcccgcagagcgtcggcttcccgccgggatgaaaagcgcaggcgcgtgcagcgcaagctggatcgataa

SEQ ID NO: 1328 - DNA, 4335 bp, Unknown
  Artificiall/Consensus sequence
atgagtcaggcttgggaaaagctgatcgagaccgacgacggcgcgcttttgaagtgcctgacgctgtcgcgggtgtcgatttcgaaacagacgggcgacatgcgcgtgacctttcagtcgtcgcggattctgcgccgggacgagtacaagttcgtcgcgtcgcgcatggcctcggcctttccgatggtgcgcgtgcagacgcgggtgtgctatttcgcgctgagcgacgcggtgcgcgcggacttgtccgtggcctcggggctgatgaaggagcagattcgccacgagagccccggctccatgccgttcatcgactgggaaggccgcggatggagtctggacggcgagaagctgaccgtctgcgtgtcctccgccgagggcatgaactatctgaaggcccgcggcgtggaccgcatgctggaaaagctgatggccgagctgttcgacatccgctgctccgtgggcattcagctcaccggcgacgacgagcggcgcatccgcgagatcgccgccgcccgcgcccgggaggccgaggcgctggccatggacacggccaaggccgcgcaggccgccggcggcggaaagaaggccgcgccggtggacacggtttacggcaagcccatccacgacccggtgctgcccatgaacgagctgaccgaggacgtggggcgctgcaccgtgcgcggcgaggtctccgggctggacatgcgcgacaccaagaacggcaagacgaagatcgtgtcgttcctgatgagcgattccctcggttcggtcaactgcaagctgtttctgggcggccggcgcggcggcgaggacgcgaagagcattcaggcgcaggccgacgcgctgtcggcggcgctgaaggacggcaagtggatcaccgcccgcggcagctatcgctacgacgacttcaagcgcgagatggtgctgatggtcaacgacatcatggaggccgaaaagcccgtgcgccgggataccgcggcggaaaagcgcgtggagctgcatctgcacaccaccttctccaccatggacgcctgcgccacggctaccgacctcatcaagcaggcggcggcgtggggccacagggccgtggccgtcaccgaccacggcgtggtgcagtccttccccgaggccttcggcgcggccaagaaggcgggaatcaagctgattcccggctgcgagggctatctcatcgaggacgcggcggacatcgtcaagggcgcgtcggacgagaccctcgacggcacgcccttcgtggtgctggacgtggagaccacggggctgaacacccacaccgacgagatcatcgaaatcggcgcggtgcgctttgaaaacggcgtggaggtggccgagttctccgagctcatcaatcccggccggccgctgccggagaagatcgtggagatcacgggcatcacgcccggcatgctgcgcggccagcggacgctgaaggaggccatgcccgacttcgcgaagttctgtcagggcgcggtgctggtggcgcacaacgccgagttcgacatgtccttcttccggcgcgcgttcccgctgatcgggcggaagttcgactttaccaccttggacacgctggccctttcgcgcaatctgtatccggggttcaagaaccacaagctgggcacgctgtgcaagctgatgggcgtttcgctgaccaacgcccaccgcgccgtgcacgacgcgcgggccacggccatggtgctgatgaagatgctcgcggagctgaagagcctgaaaaacatctccatgctccgggagatcaacacctgcttcgccatcgacgcgggcaagaaggcctaccacatcatcctgctggccacctctcagacgggcatcaccaacctctaccgcatcgtcagcgagggccatctgaattactttcaccgcacgccgcgcctgccgcgcagcgtcatccagcgctatcgcgagggactgatcgtgggcagcgcctgcgaatccggcgagctgttccgcgccgtgctggcgggagagagcgacgagacgctggagaaaatcgcgaaattctacgactatctcgaggtgcagcccatcggcaacaaccagttcctcgtgcgcgagggcgcggtggccgacgacgagggactgcgcgagctgaaccgcaagatcgtccatctgggcgagaagctgaacatcccggtgtgcgccaccggagacgtgcacttcctgaaccccacggacagcatttaccgcgccatactgatggccaccaagggcttcgaggacgcggacttccagccgccgctgtacttcaagaccacggacgagatgctggaggagttttcctatctggggcgcggcaaggcgaaggagatcgtcgtgaccaaccccaacgccatcgccgaccgcatcggcgacgtgaaggtgttcctgccccatcccgagggaaaggagaccttccagcccttctggcccgaggccgagggcgagctgcgggatctggtgatgaacaaggccgtttccatctacggaacgccgctgcccgaaattgtgcagaagcgcatcgacaaggagctgggcgccatcatcggctacggcttctccacgctgtacatgatcgccgtgaagctggtggccaagtccctctcggacggctacatcgtcggctcccgaggctccgtcggctcgtcgctggtggccaatttctcgggcatcaccgaggtcaactcgctgccgccccactacgtctgccccaagtgcaagcacaacgaattcgacgtgccgaaggagtatgccacgggcctcgaccttccgccgaagagctgccccgtctgcggcgcgcccatggacaaggacggcttcaacatccccttcgaggtctttctgggcttcaagggcaacaaggtgcccgacatcgacctgaacttctccggcgtatatcagccggtggcccacaattacatcaaggagctgttcggcacggagaactgcttccgcgccggcaccatcggcacaatcgccgaaaagacggccttcggctacgtgcgcaagtacgccgaggagcgcaatctgagcctgcccgccgccgagatggagcgtctggcccggggcatcaccggcgtcaagcgcaccaccggccagcatcccgccggcatggtcgtgctgcccaaggactacgagatctatcagttcacgcccatccagcaccccgccgacgaccagaccaccgacaccatcaccacccacttcgacttcaactccatgcacgacgtgctggtgaagctggacgtgctgggccacgacgaccccaccatgctgcgcaagctgcaggatctgacgggcatcgcgccccaggccgtgccgctgcacgacccggaggtgttcggcaagatcatctcgctgttctccgggcccgaggcgctgggactgaccgccgaggagctgggcgtggccgagagcggcacgctgggcgtgcccgagttcggcaccaagttcgtccgcggcatgctcaaggagacccagcccaagtccatggaggagctgatccgcatctccggcctgtcccacggcaccgacgtgtgggtgggcaacgctcaggatctggtgcatcagggcgttccgctgaaggagtgcatctgcacccgcgacgacatcatgaaccagatgatcgcctacggcatcgactcggagatctcgttcaagaccatggagtccgtccgaaagggcaagggcctcaagcccgagatggaggaggcgctggtgaataacgatcaggtgccgccgtggttcatcgacagctgcaagaagatcaagtacatgttccccaaggcccacgccgtggcctacgtcaccatggcgctgcgcatcgcctacttcaagatcttctatccctcggcctactactgctgctatctttcgcgcaacgccgagagctttgacgccacgcgcatgaccacccgcagcgtggacgagctgcgcggcatgatcgacgccatcaaggcgctggacaaatccgagctgaccgccgccaaggaggacgagaacaccattctcgaaatgctggtggagatgaacctgcgcggcgtgcacgtccgcccggtggacatctaccattcctcggccacggaatatcaggtgatggacaacggcgagattctgccgcccatcacgtcgctgcccggcgtgggccagtcggcggcggagggactggtggccgcccgggaggccgggccgttcatctctcaggacgacatgctcaggcgcaaggtgtccaagtcggtcatcgagacgctcaaaaacgccggctgcatcgacgatctgcccgagagcagccaggtgacgctgttcgaattcggcgtgtaa

SEQ ID NO: 1329 - DNA, 3141 bp, Unknown
  Artificiall/Consensus sequence
gtgatccagaccaacgaaatgtttctgacgctggataagctcaaccgccgcatgcgcgagctggagaacttccgcttcgtgaacatgcagaccatcgcgcccatgaccgccatggagggcggactgggcgtggacgatgtgtaccacggcatgcccgggaagatcgagggcggtcagatcaatatcggcgacgaattcgtcggccgcgatcgctatctctgggcgcagaagaccgtgacgctgcccgagcacgccgacggctgcgaggtttacggcctgttcaacttcggcaagaccggcggcggccacaacagcggctttgaatcgctgctgtatgtggacggccatccctatcagggcgtggacaccaaccacaacgacgtgaacttcgagtccctcgccggaaagaccgtggttttgacgttcatgctctggacgggcatggagggcggcggcccgaagcgcgagctgcgccatcgcatccagcaggccgaggtgggctatcttcattcggacaccgacgagctgtactatctgtccaaggccatcgtcaagacgatcaggctgctggacgacggcgacactgtgaagtattccctgacgaaggcgctggatcgcacgttcaacgagatcgactgggacgcggactgcttctacgataccgtcggcacggcgcttgggaagctcagggccgaactggccatactcaggaaggagaccgaggtcacggtcaacgtcgtgggccacacccacatcgacgtggcgtggctgtggcggctgaagcacacccgggaaaaggcccagcgctccttcgccaccgtgctgcgcctgatgcaggaattcgacgagtacatcttcctgcagagccagccccagctctatcagtacatccagaaggactgcccggagatctacgagcagatgaagcagcgcgcggccgagggtcgctgggaggccgacggcggcatgtggctggaggcggactgcaacatctcctccggagaatccctgacccgccagttcctctacggcatgcgccttctgcagaaggaattcggccacaggtgcgaatacctctggctgcccgacgtgttcggctacagctgggcgctgccgcagattttgaagggtgtgggcatcgacaccttcatgaccacaaagatcagctggaatcagtacaactccatgcctcacgatctgttcaagtggcgcggcatcgacggcagcgaggtcatgacctatttcatcaccacgcccgaggtgggcgactttgatcagagccgcttcgccacctacaacggcatgatcagcccgcgctccgtgctgggcagctggcgcaagttccacgacaagaacctgtccagcgagacgctgctgtcctacggctacggcgacggcggcggcggcgtgaatcgcaacatgctcaagatgcgccgcgccatggatcagctgccgggtctgcccaacgtccggaccgaccgcgccggaaacttcttccgccgcatgcacgagaacattgagcacaccgatcagtacgtgcccgtctgggacggcgagctgtatctggagtaccatcgcggcacctacacctctcaggcgtggaacaagatgatgaaccgccgcatggagttcatgctggccgagagcgagtggctcagccgcatggccatgcttgccggcggcgcctacgatcaggacgcgctggtctccggctggcagaccatcctgcgcaaccagttccacgacatcattcccggctcgtccatcaacgaggtctatgaggactgccacagggagtacggcgaggtggagaccagtctgaccgcgctgcgctccaacgcgctggccgcgctggctcatcccgagcaggacgcgtggatgctctggcacttcggcagctttgcgcgcaaagatcaggtgttcatcgccgagacccgcgcgggcgaattccgcaatgccgacgacgagaagctgcccgcccagcgcgtggacggcggctgctgggtggaggtggagctgctgcccctgtccgccgagacgattcatttcgttccgggcgaggagagggccgccgcgagcgccttcgaaatcgacatggccgcccgcacgctgcgcacgccctgttacgacgtcgcgtggaacgggcagggccgcctgattcgcctgttcgaccgcgagaacggccgcgaggtgctgcccgagggcgcgcaggccaacgcgctggaggtctacgaggacaagcccgtggcccacgacaactgggacatcgacatcttccatctgttcaagcacgaggatgtgacactggtcagggaacccgtgctggtggagaacggcgcgctgcgcgcggtgatccgcttcgagtatgcctatcgcaggtccaccttcgtgcaggacatgatcgtctatgccgacagccgccgcatcgacttcaggaccgaggccgagtggcacgagtgccatcgcgtgctgaaggcgggcttcccggtggacgtccgctccaccaaggcgacctacgacatccagtacggccacgtggagcgcccgacccacttcaacaccagctgggactacgcccgcttcgaggtcgtcgcccacaaatgggccgatctgtccgagcagggctacggcgtggcgctgctgaacaactgcaagtacggccattccgtcaaggacaacgtgatgcacatcacgctgctcaagtcgggcaagaacccgggcaccgagtgcgacatgggccatcacgagttcacctacgcgctgctgccccacgccggctccgtggcggagagcgacgtcatcgaggagagcgtcaagctgaatctcccggtgcgcgcggcggcgaacatggccggcgacgcgttctccaccttcctgagttcttccgatcacgtctatttcgacgcgatcaagaaggccgaggacggcgacgagctggttctgcgcgtgcacgagtgccgcggtggccaggccgacgtggagctgactcccggctttgccatggcctcctaccagcgctgcaacctcctcgaagagccacagggcgagcctgtggaagcctccaccatccgtctccacctccgccccttcgagatcgccacctgcaaactgagtttgcatccaactgctgccgctcaataa

SEQ ID NO: 1330 - DNA, 5085 bp, Unknown
  Artificiall/Consensus sequence
gttacggtgcatgcgtacaacggcgtatccgcgcgcgtgaaggtcgtggtgtgggagaagcccacgaaggttatcatggatcttcgcagcgttaccatcggcgaggattcctccgcgcaggtgcgcgcccgcatctactataagaagaagagcttcgtctattccaacggcgacgcgaacggaatcggccagttcagcacaggcgatgcaagcatcgcgacggtggacagcacgggcaagatcacgggcgtgaagaagggccagacctacgtccgcttcacgacctacaacggaaaatctgtgcagattcccgtctacgtcaagtccgcgccgacggagctgcatctggacaagagcgagcttgcactgggcgcggcgatgacctccaagctgacggtgagcttcggcaaggacgagatcggcacggcgaagtttgagagcagtgacagcgccatcgcgtcggtggatcagaacggcgtggtcacggcgaagtctgcgggagcggccatcatcacggcggtcgtgacctccaagagcggcgagctgctgagcaaggcctgctccgtgcgcgtctatcccgcgccggacaagctcacgctgaacatgacctccacgaacgtcgccctgaagaagacagtggcgctgcgcgctgccggaacctatcagggcagcgcggactgcatggctacgctgacctttgcctccagcaacaagaagattgcgacggtggatggcaacggcaacatccgcggcgtgaaggcgggcaccgcgaccatccgcgtcaccgcgcagaacggcgtgtacgccgactgccgcgtgacggttcgcaaggcgccgacgaaggtcgcgctgagcacgtccaagcgcacgctgggcgtgggccagaccttcctgcttcagggacgcatctattacaggggcggaaacttcatctattcgggcagcgacacgtccatggcgacgtttgagagcagcgatccctcggtggtgaagatcgacgcctacggcaacgtgaccgcgctgaaggagggcgtcgccaatctgcggctgcgcacctacaacggcaagggttcgagcacctattgcaaggtcaccgtgacggcgggtcccgactggctcgcgtttacgcagaccgaggtgggcatcagcgtcgggcagacgctcacgctgacctgcaataccactcccggcagcgtgaccagctacagctacaagagctcgaacacggctgtggccactgtcaccggaagcgacaacagctgcacggtcgcagccatcggcgagggcgacgtgaccatcacggtcacggcatccaacggaaagtccgcgacctgcaacgtgcacgtttacgccgcgccgacgggcgtcgcgtttgaacgggacgaaatcagcatcgccatcaatgaaaacggcaagctccccgacgtgaaggtctccgccggcggcagggaatgcagccagaacgtgacctacgcctcctccgattccgcggtggtttccgtgtcgggcgagggctacatcaagggcgaaaaggcgggtcaggccacgattacggccatgacctacaacggactgaaggcctattgcacggtcaaggttctgcccgagccgaccaagctgacggtgcaggccgacgaaagccgcctggcagtgggcgataccactacgctgcgcgtgacgatggattccgtgggcgcgtacaccttcgcctcgtcggatccctcggtgctgaccgtggacggcaatggcacggcgacggcgctcaaggccggcacggcgattgtgacggcaacggcctataacggcgtgaagaaccagtgcgaaatcactgtgctgaacgcgccgacggatgtgcgcttcggcgaggacgcgctgacgctgggcgcgggcatgtccgcgcagctgactgtgagcgtgccggaaaacacgctgggccgctatgccttcacatcctcggacgaagccgttgcgacggtggacgcgcagggcagggtgacggcgaaggccgcgggcagggcgcagatcgccgtgggcgttcagggccacgacgaggtgttcgatacctgcgaagtgaccgtgctctccatgcccaagagcgtggagctgagcgcaaccgcgctggagctcaagaccggcgcgacgaagcggctgactgcgacgctcgtcaacggcgaggatcgcagctgctatggtgaaatcagatttggctccagcgactccagcgtggtcagcgtctccgaggacggcacgctgacggcgatgaaggccggaacggcgacggtcaccgtctccgcctctgcggacgcgtctgtgaatgcaacctgcacggttacggtggccgacgcgaaggttcgcctgagcgagagtcaggtgacgctgggcgcgggcgaaagcagaagtatttccatcatttgctccggcagcgacgccgtgaccatttccggcactaacgacgcggcggcgacgatggacgcttcgggcaagatcgccgcgaaggccgtgggcaagacgactatcaccgtatcctgcggcggcgaaagcgccgtctgcgaggtggaggttctgggcaagcccggctcggtgaccatcgccgcggcaagcaaaaagctggctgtgggcaagagctttgcgctgaacgccacgctcccggagggaacggcctccgcgctgatctatacatccagcgacgaaaaggttgcaagggtggacggcagcggccgcgtgacggctgtgggcaacggcacggcgaccatcaccgcatcgaccttcgatcccggcgtcagcgcgagctgcgcgattaccgccgtgtatgagcccgacatgattcgctttgcgaatctggacggcgtgattctggcggtgggagatacgtatactctggaagcgccggtgatgtacagcgccaagggcgaatgcgacgcggcgtacacgctgtctgtttccaattccaagtgcgcgggcgtgaccgtgcagaatggccgctatgtgattaccgcgaaggccgagggcgaggcgacactgcgcctgaagacctccaacggcaagacggcgacctgctcgctgaccgtgacggccaggccgacgagcatctcctttgagacggcttcgatgcggctgggcgtgggcgagacttatcgcccggcggtgatcggcaacaacggcgcgagcctgagctgcgagctggcctctggaaattcggaaatcgttcgcgtggaagacggtgcgctgatcgccgcctccaagggcaagaccacgattaccgcgacctatggttcactgaaggcgaccatggagatcgaggtttccgatccggtcaagagcattcagctgagcgcttccagcctgcgcatgggcgtgggcgagacgctgcgcctgacggcgaccgccgacaatgcagccgccgtgaatgtgacctttgcctcctccgacgagaacgtcgttcaggtggatcgcagcggcaagctccgcgcggcgggcaagggcaaggcgaccattaccgcgcaggcgggcagcgcgcaggcgacctgcatcgtcgaggtttcggcgatggcgaccgcgctgaagctccatccgaccagcgtcattgccagcgtaggcgagagcattgcgctcagacccatcttcggcagctccgacgaatacgccagcgtgctctacgagagcagcgacggcagcgtggcgacggtgcgcgcggacggtctggtgacgttcaacaaggtgggcacggcgaagatctccgccgagacctacaacggcatcaatgacgaaattaccgtgacggtatgcgaaaagcccggctcggttgcctttgcatccaagacggcttccatcctcaagggcgacgcggcgctgctgcctgtcgtgttcgacaagggcggatgctatacgcagctgaccagcagcagcacggacgtgctgtcggtggacgaggacggccgcgtcgtggcccacaaggccggcacggcggaggttacgctgaccgcgccctccaaccccgcgctgaccgcgaagtgcaccgtgacggtcatcgagaagctcagcggcatcgccgtggcggcgcagaaggaaaccttgcagctgaaggagaccacggagctgacctacacgctgctgcccgccgatctggtgggaacggccaatgttcgcttcgaatccacggatgagagcgttgcgacggtggatcccgatacgggtctcgtcacgggcgcagcctacggcacggcgcagattcgcgtggtggccagcgacggcgccttcggaagctgcacggtcaacgtattgggcggaaagcgccgcgcactcactgctttctactatggcgagaccggcgatcccggctatctgccctttgcgatgaacaacggctacagcatggttgaagccctgcgcgccgcgaaggtcgagggccagagctattccgtggccaatccgctgagcaatcccagcaaggcagacctgttcgcgcgcatcgactccacgttcgccgacgcgacggacgacgatgtttccgtcatctatctgtgcgcccacggcagcgcgggatgggacagcgagtattacttcaccatgcccaagagcgtgggcaactcgtccagcctctaccgcatccatgccaacgagctgatggatcacatcctgaagatcaagggcagagtcgtcgtgttcatggactcctgccacagcggcggtctgatcgactgcacctacagccgcctggcggcggagggcggccgcgtggcggtgctgacctccagccatcgcagcacgcccagctccttctacagcgtgaccaacaagcgtcagtcggtggacttcttcacctttgcgctgctggagggctttggctacaatgagagtgagggcctgaacgggcgcagccacggcttcttcacggtcagtgcgccggcggacggcaaccgcgacggtgcggtgacgatgcaggagctggcggactacaccattcccaagacggtctctctggtgaagggcatggctagcagcaagtatttcctcggcaacaagaaccagaccccgcagagcttcattggcgagcagtgcagggatctgatcctcttcggccggtaa

SEQ ID NO: 1331 - DNA, 2034 bp, Unknown
  Artificiall/Consensus sequence
atgggcaaggccgaggcttctccggagttccgcaaggagtttgagctggcgcgcgcgccgaagagcgcgacgctgcagatctgcggtctgggctttttcgacgcgaagatcaacggtcagagcgtgaccgagcggctgctgaccccgccgtttaccgcctatgacaagcgcgtctattttgaggaatacgacgtgtccgcgctgctgaaggccggaaagaacgagattcgcgtgcagctgggcggcggctggtactgcaccgccatccgcgacgcgtggcagttcgaggccgcgccgtggaagggcccgatgcagatgatcgccagcctcatcgccgacggcgagaccgtgaccagtaccggcagcgactggcaggcccgggagagcaaaatgatcgagagcgagctgcgcggcggcgagatctgcgacgcgaccttcgagcagggcgaatggatgcaggccgtggtgcatcgcggcgcgggcggacggctgatgaagtacgacggcccgggcatcgtcattgagaaggtgctcgagcccgcgtccgtgacggtcgtcgaggacggcgcgatctacgacttcggcgagaatctggccggcaactgcgaattcaccgtgaccggcgcgcgcggcgaccatatggtggccgagtacggcgagcgcttggacggcaggggcggtctggacacggagaacatcgccacgttctgctgggagcatcgcttccagaccgacgagtacatctgcgccggcgagggcgaggagacctggcacggcctgttcacctatcacggcttccgctatgtgaagatcaccggagcggcaaaggtcgtgtccgtgcgcgcccgggtcttccacacggagcttccccagaagggcggcttcgagtgcgacagcgaggtgctcaacgccattcaggacgcggtgctgcgctccaccaggaccaactatcaccacatgcccaccgactgcccccaccgcgagaagaacggctggacgggcgacgcgcatctgagctgcgagcaggcgctgttcaatctggacatggcgccggcctatcgcaagtggctgaatgactttgaggacgcgcagcggcccaccggcgagctgcccggcattctgcccaccggcggctggggctacgtctggggcaatggcgtgtcctgggactgcgcctgcatcgtcattccgtggcagacctacatggccacgggcgacgtgcgcttcctgaccgagcactacggcctgatggatcgctacatcgactacatggcttccgtggcggaaaacggcatctccaccatcggtctgggcgactggtgcccgccgaaggaggccaagcccttccccaccgaggcgctgctcaccggcatctccatccacctgtacgagatgatggtgaaaatcgccgagatcaccggccacagcggcacgaagttcgcccgtctggccgaggagacccgcgcggcgttccaccgcgagttcgacggcagggttccggacagccaggcctatctgtccatgctgctgttcttcaacctgaccgacgaccgcgagggcgttgcgaagcgtctggtgcatgaggtgcgtcaggccaacggccacatcctcaccggcatcttcggtgcgaagttcctcctgcaggcgctcaccgacgcgggcgaggtggagacggcctacgaaattgccgcgcagaaggagtatcccggctggtatcacatgctcagcaacggctccggcacgctctgggaggactggaccggcgagaattcgctgaaccatcacatgttctcgcccatcagcgcgtggttctatcgcggcatcgccggcatcaccattctcgagccgggctatcgccgcgtgcgcatcgcgccgagcattccgtccgagatcaggttcttccgcgcctggcacgacgcgcccatgggccgcctgaccgtggaatggaaggacggcaagctcaccgtcaccgcccccgcgggcatggaggtcgagctggacgcggccgttcccgccgagctgaagcgcatctga

SEQ ID NO: 1332 - DNA, 2025 bp, Unknown
  Artificiall/Consensus sequence
atggcttcctacaatttaaacgaggccctcaaaaagaaggccgcgcccaagaaggccgcgcagcaggagatcaagctggacgacgtttcccgcgtcaaggtgctttcccccggccgtcaggtgttcaagcgcttcatccgcaaccgtctggccgtgttcggcacggtactgctgctgaccatgttcgtgttctcgttcatcggcccgctgttctacgcctacggccagaagcagatcttctataagtatgacgcgcagaacgtcaactacgcgctggccaaggagaacaccgcctacaccggctacgtcagcgatcccgccgcggaggtggatcgcggcgtcgccagcatgatgaacaccaacatcaagaagatggaggccgagggtctcgatcggctgatgtatctgggcggcgacgagaagttctacgccttggatcgtctgggcgagagcatctacaccctaagcctctgcgagaccgagaaggtcgcctccttcggcggcggagaggtgcgcgttggcctgctggactccatcggcaagaagatggagttcgacggcgagacgctgggcgacgcgttcatcgccgccgcgtccaaggcctgcaagggcaaggacggctccttcgagtacgacggcgcgacctacaccttcaaaaaggccgccggcaagaagtttgaaatcttcggcaagtccgagggcttcgtctacgagggcgaggcgctcgctcccgagttcgaggccgccgcggagacgacgcccgacggcgcgaccttcgacttcggcgacagcgagtacgccgtgtcgggtcagacggtctaccgcctgggcgagtccgctccggcgatggtctacacccgcttcgtgctggacaccgtcaatcccggaacgaccatctccaacgagttccgctgcgccgcgctgctgaatgcctataccaccggaaagttcaccgccgacggcgcggactacaccatccatgctgacggcgacgagctgttcatccgcgacgctcagggcaatgactacgccgagttcagctccttcgtggtgcgccgctacaacggcgacgacacgatggaatatgcgctcaagaatcaggtgcgcgaggccatcgagaccatgaaggccgcgggcagtctgaacgcctccgtcacctgcgcgctgccccagcagaacgaggtgggcgaatacgcctatggcgacgacggcagcctgctctacaacgacaccgagctgaagatcacccagaaggacacgggcgaatacgtcatcaactgcgaccagatcatctacaagatcgacatgtacgcctccccgtcccttcagcatctgctgggcaccgacggcgacggtttcgacgtgctggcccgcatcatgtacggcggccgcatctcgctgatggtcggcttcgtggtcgtgttcctggagtgcttcctgggcatcatcatgggcggcctggccggctattacggcggctgggtggacaacctcatcatgcgtctggtggacgtgttctactgtctgccgagcatgcccatcatgattattctgggcgcgatgatggacgccatgcgcatggacacctacgtccgcctgatcgtgatgatggcggcgctgggcctcatgggctgggcgggcgtggcgcgcctggtgcgcggccagatcctgtccctgcgcgagcaggagttcatggtggccaccgaggccacgggcatccgcgtcaacgcgcgcatcttccgccatctggttcccaacgtcatgccccagctgatcgtcatcgcgacgatgggcgtgggcggcacgattctgaccgagtccacgctgtcgttcctgggcctgggcgtgaagcatccgctggccacctggggaacgatcatcaactccgtctcgtccgcgtcggccatggcgcactatgcgttcatctggattcccgtcggactgctgatctgcctgaccgtcatcgccttcaacttcgtcggcgacggcctgcgcgacgcatacgacccgaaagccaagcgataa

SEQ ID NO: 1333 - DNA, 2448 bp, Unknown
  Artificiall/Consensus sequence
ttgaaaccctatcgcacgcgcgttctgaccatggcgctggtggtgctcgtcgccttcggcgcgatcttcgcccgaatgaactacatggtgcgcgccaacggcgagagctattccgccaccgcgtctgacaaatccaccaagaccatcgcgctgtacggcatgcgcggcaccgtctacgattccaacatggtgcctctggcctacagccgcatcagctatgacgtaaccttctaccgcaacccgtcgcgctcctccgccgccgaccgtcaggcctacacccaggtgctctatgaggtcatccggctgatcgagtccaacggcaagaccaccgtcaacgacttctggatgaagaaggacgacagcggcaagtgggttttcaattcgggcgcaacgtccgaaacggtggaggccacccgaaagaagcagtggaagagcaatttctccctctccagtacgccggagaatcagtggttcaaggcgctgtgcgagaagtactacatcgactcgaactgggacgaggacatgcagatcaaggtgctggctctgtggcaggaatcgcgcatgaacgccttcaactccacgccctgcaccatcgcctacgacgtgggcttcgagaccgtctcggagatcgaggtgcgctccatggagctggacggcgtggacatctccgaaagctcctcccgcgtctatccccagggaaccaccgcctgccacgtcatcggctacaccagcaagctctcctccgccaagctggaggattacaaaaatcagggctatcccaacgacgcgtatgtgggcgcggacggcgtcgaggcctctctggaggatcagctgtcgccctacattcagtatcgtcagggacagcgcgtggtggaggtcaacacccgcggcaaggtggtgcgcgagctgagctacgacgctcccgaggacggcaacagcgtggtgctgaccatcaatgtggagctgcagaaggtcatggccgaggcgctccagagcaccatcgaaagcatccgctcccagcaggagaccaccatcgcctccagcacctggcggcggcgcaagaaggaaattctcgaggattacgccgccaacgaccgcgagatttcgctggccaattccggcgcgctggtggccatggatcccaacaccggccgcgtgctgggcatggtgagctatcccgacttcgacctgtcctatttcgacggcggctccatctccaacagcgactgggacaagattcgcgagggcaacgatccgctgtacaaccgcgccatctccaccaaggactcccccggctccatcttcaagctgtgcacgtcgctggcgggcctggccgagggcgcgatcacgctggacgagcgcatcgacgacgagggcgcgttcacctacacggacaaggttcatccctccaagtgctggacgagcacgccggaggaccatcagaaccagaccatcgtcgacgccatcaagaactcctgcaactactacttctacaccgtgggctaccgcctcggctcggagaagctgtacaagtgggccgcggcgctgggccttacgtccaagaccaacatcgagctgcccggcgaggccaccagcttcgtgggcaaccagaacatgctctacgacccggacgtgcccatcgaccagcagtacacctacaagcccctgatcgccgccaacgccatccgggcgaagattcagcagatcgccgacgagcgcaacatcgagtacgactccgagcgcgtggacgtggtggtcaagaagctgctggacgtggccgtgtcctactccaccagcgacgagtgggcgtatcccatccgtcagattctgctgtacgacctgaacctgccggagaactacatcgtccagaactacctcggcaacaccatgcagtcctacatcaaggagctgcagtggacggccaacgaaaccatcatgctggccatcggccagtccatcactcaggtctcccccatcgccgtcgcccgctacgtcagcgccatcgccaacggcggcacggtgtacgacgcgcagatcgtggacaagatcatcgcccccgacggcacggtggtgctggagaagcagccggtggtcgccaaccggatcgacgcggatccgtcctacttcgccgccattcaggagggcatgggcgacgtgacctcccgcgaggagggcggtacggcttccaagtactacgagggcatcgactacatcgccgccaagaccggtacgtctcagcgcaccaagctggacgtggaaaacaacgcctggcaggtggcctacgccccgaaggacgatcctaagatcgtcgtcgtcgcctatgtgcagaacggctactccggcgcgtacacttccccggccatcatcgccaccatccagtactatctccagagcctcggctactccgaaagcaccgagatcggcgtggagtattccgtcgccgactga

SEQ ID NO: 1334 - DNA, 3024 bp, Unknown
  Artificiall/Consensus sequence
gtgggaaaaagaatacaaaaaagaagagaggcgcggacgaacggcggctttgcgctgtggttcgtcctgatcctcctgttgctgtgtgcgctggggctgacggcccttgcgtcgggaggctcggattcgtccgacgcggcgcagaccttcgcgcctcagggcggcgtgcgcatcagcgaggtcatgacgtccaacgcctcgaccctttcgctgagcgacggcagctggccggactggattgagctgcacaacgcgggcgagaaggccgtctccctgtccggctggtcgctgatgccagagagcgagccgaagaagctctattgcttttccagcgacgcggtgattcccgccggcggttatctggtggtttactgcgacggcggtcggagcgtgggcggcgagctgcacgcgcggttttcgctggcggcctcgggcgcggcggtgacgctgctggacgcctccggtcagcgcgtggatcgcgtggtcacgccggagctgggccgcgacgaggcctattgccgcgacgcgatggacgaatggcagatgactcggacgcccacgccgggcgaggcgaaccgcatcgccgagcgggaggcggtcacggcgctggcggcgcaggacgaggcggccgcgggcgaggtggagatcaccgaggtcatgacgcgcaacgtcacctactgtcccgacgcgcagggccgagcccacgactgggtggagctgcacaacgcgtcgaatgcgcccgtcagcctgagcggctggtcactgtccgacgacgcgcagaagcgcggcaaatggactttccccgacgcgaccattcccgcgggcggctatctgatcgtctattgctccggcacgtccggcgacgcgtcggagctgcacgcgtccttccgcctctccggcgagggcacgcaggtgattctgacctgcgccgacggccagacggccagcatggccgatgtgcccgcgctggagaaggatcagtcctggtcgaagcagggcggcggctggacgaaggccctttcgcccacgccgggacagagcaacgatttcagcggcgccgtggccatcgacgcggcgctgcgcgcgaaaagcgcggccaacgtcattctcagcgagatcgccgcgtcctcgtccactgtgggcacggactggatcgagctgtacaacgccggaaccgaggccgtcgatctgagcggctggggcctttccgacagcgccggccggccgcgcaagtggcagttcccgtcgggaaccaccatcgctccgggtcagtatctgggcgtgcttctgacggacaagcaggtttccggccagctctgcgccgacttccggctgagcctggagggcggctacacggtgacgctcagtcgcgccgacggtacgctggtggatcgcgcgtggctgcctgagcagtatgctgatctgacctatggccgcgtggaagggcgctcgggcttctattatttcgacgtgcccacgcctcaggcggcgaacacctccacggcctatacaggccgcgcttccgcgcccgagtattccaccgagggcggcatgttccggacgggcgacgcgctgacggtgacgctgagcgctcccgcgggcgcgcgggtctattacaccaccgactgctccgatcccgacgagagcgcgacgctctacaccgggccgatctccattttccagacgacggtgctgcgcacgagggtctacggcgacgggctgctgccctcgttcatcgacagccagagctatctctacgacgtgaataatggaaacggcgtgtacgtcgtctcggtggtctccgacccggacaacctcgtcagcgacgagaagggcatcatggtcaagggccccaacgcactggcccagtatccctacggctccatgaacgtgggcgcgaacttctggatggactgggagcgcgagggtcacgtggagatcttcggcggcgacggcgaaaacctgctgtctcagggctgcggcatcaagctgcacggacagtacagccgtgcggagaagcagcaggcgttcaagatcatcgcccggtcgaagtacggcggcaaccgattccccatcaaactgttctccaaccgggactacaccgagtatcagtccttcctgctgcgctcctcgggtcaggacacggacaagacgcgcatgcgcgattccgtgctgacggcgctggcgaaggacacgtcggtgatgtatcaggagtccgaggtctgcgtgatgtacctgaacggccagtactggggccagtacaacctccgcgagcgcatcaacgccgcgtccatctgccagttcgagggctgggagggacaggaggacgacatcgacatcgtcaaggccaattccaacgtcatgcagggctccaacgacaccttcgcggcgctgctgagctgggtcaagagcaccgatcccacggcgagcgacttctacgagaagctcagctccgccatcgacgtgcgcaattacatcgaatacatggccgtggagatcttctccggcaatacagacacgctgaacgtcaagcgctatcgcaacgccaatgccgacggccgctggcgctgggtgctgttcgatctcgactgggcgtttaccacggacaccaactccatcaaccgctgggtcacgcccggcggcatgggcaacggctcgcgcacggacaacacgctgttcgtggcctgcatgaagaacgaccagttccgggacgagttcctgacctatttcggtcagcagctggccacgaccttctccaccgagaacgtgctggcgcggatgcaggagcgctatcagattctcgatccgctgctggacgatcagttcgccaagtggggccagtcgcgcagcaattacgagtccgccatgaaggtgatgatccagtacgcgcagcagcgcccgaccaagatcatccagtacttcagcggcaggggcgtttccggctcgaagatcagcatgaccgacgagcagcttcagcactatttcggcgacgccatcgccaaaatccagagcgcaggctcgtga

SEQ ID NO: 1335 - DNA, 2949 bp, Unknown
  Artificiall/Consensus sequence
atgaagaagcttctttccgcgatcgtcgcgctgaccctactgctgagctgcgcgctgcccggcgcgctggccgaggtggataaaaaggaaatggtctacgtgctggcggacgccgacggctccgtcaacgacgtcatcgtcagcgagcgcctctacaaccgcgacggcgaggcgcagctgaccgacgtgagccgcctgaccgacatcgaaaatgtgggcggcgatcagacctggaccgaggaaaacggcaatctcgtctggaacgccgacggcgcggacatccgctacgagggcaattccaccgagccgctgccggtgaccgtctccctgcgctacacgctggacggtcaggaaatgaccgccgaggagctcaagggcaagagcggccatctggtcatcgacgtgacctatcgcgccgagcagatggaggaggtcgccgtgggcgatcagctcgtgaccatgcccatgcccttcttcgcggccaccgtgctgctagccgacgaatcggtcttccagaacgtcaccgtggacaacggccgagtgctggacatcggcgaccgctcgctggtggtggccatgggcctgccgggcgttgaggagggcctgaacctcgccgcctatgaggagctggaggacgtgaacattccctccgccgcccgcatcgaggccgacgtgaccgacttcgcgctggacggcacctacaccctcgccaccaactccgtcttcagcgacgtggacgtggacgaagagggtctggacgtcgatctggaccagattcaggacgacctgaccgacgcgatgaaccagctgctggacggcgcgtcccagctgcgcgacggcgcgcaggagctgaaggacggcgtggacgagctgtccgacggcctgaccgagatcgactccaactccgccaagctcgtggacgcggcgcagcagctgctgcagaccgtgatggacaccgccaatgaaaccctctctggcaaggccgccgatctggcgaagctgaacatcgaggtgcgcacgctgaccatcgacaactacgccgacgaggtggcgcgccttcagaaggaatatctcgccaacgtggaggactacgtcctcgagcaggccgacgcgcagctttctgacaaggtcaacgccgccgtcagggaggaggtcgtccgtcaggtgaacgaggccgcccgccagcaggtcgaagaaaaggttcgcgaggctgtggaggccgaggttcgctctcaggtcgaggccggcgcagccgagctggttcgctccaaggtcagcgaggccgtccagcagaaggtgcgcgccgccgtggaggccgaggttcgcaggcaggtggagagcggcgtgaacgccgccgtgcgccagcaggtggaagccgccgtgcgcaatcccgacgaagcgaccctgaacgcccagatcgagcagcagatgcagaccgaatccgttcagaaggaaattgaagccaacgtcgagatcatgatgaagtccgacgaggtgcgtgcgctcatcgatgctcagctggagcccgccgtccgcgccaaggtggaggccgcctatgagcagaacgtccgcgctcaggtggagcaggccgtccgcgccgaggtggaaaaggccgtcgccgccgccgtggagcagcagatccgccagcaggtggaggacgcgctgaaggcccagacgcctgcggaacccactcccatccccgaacccaccgccgttcccgaacccaccgccgcccccgcgcccagcgcgagcgccagcgtggaggagacctccgagcccagcaccctcgcccgcatgatgggctggctgctgccctccgctaacgccgaggagcccagcttcgaggataaggtcaacgccatcgtcgccgagaagatggcctccgacgaggtcaaggcccagattcaggctcagaccgacgcgcagatgaagtcctccgacgtgcaggccagaatcgacgcaaacgtcgaggcacagatgaagtccgattccatccaggccgccatggacgcggaagtgaaaaagcagatggccgaccccgacgtgcgcgctcaggccgaggccgccgcgaagcctcaggttcgggaaaaggtcgaggccgccgcgcgtgaaaagatcaaaaacgccattctgaacctcagcgacgatcaggtcaaggccatcgtggatcagaagatggcttccgacgagattcaggccgtgatcgcccagaacatcgagtcgaagatggcctccgacgaaatcaaggccgccatcgacgaaaacgtggaaaagcagatggccaccgacgagatcaaggccgccatcgagtccgaaatccagaagcagatgagcgccgacagcgtgaagaagaccgtggacgacgaggtcgcggcgcagatgaagtccgacaaggtgcaggcgatctacaaccagaacgtggaagagcagatggccagcgccgatgtgaagaagctcatcgaccagaacgtcgacgagcagatgaagtccgaaaaggtcaaaaagatcatcgccgagaagatcgtcgaaaaccgctccagccgcgagtatctggacgcggtggccgaggccatggaggagaacggcgagaacggcgcggcctatcaggcgctggtggagctgcgcgacacgctggacgacatctgcgagttctacgagggcgtcgtggattacaccgacgcggtgggtcaggccgccgagggcgcgctgaagctcaaggacggcgcggccgagctgctggacggcatgaacgacctctacgacggcctgaacacgctggacgaagaggccgtgcagaagattctcgacgccctcaacggcgactacgccgagctgaaggatcgcgccgaggccatgctgaacatgacccgcggctacgcctcctacgccggcatcgccgaaggcaagaccggctccgtgcagttcctcatccgcacggcgggcatctga

SEQ ID NO: 1336 - DNA, 2928 bp, Unknown
  Artificiall/Consensus sequence
atggagctgaaaaagaggctttcgcaggatctgaaggactatcagtccattccgttctggagctggaacgacgagctggaggcggacgagctgcgccgccagattcgcgagatgaaaaaggccggcatcggcggcttcttcatgcacgcccgcggcggtctgaccaccgagtatctgggcgagaagtggttcgacgtgaccggcgcgtgcattgacgaagcccgcaagcagggcatggacgcgtggtgctacgacgaaaacggctggcccagcggcttcgccggcatgaagctgctggaggacgagaataactgggagcattacatcgtctgcgagacgaagaaggaattcgacgagagcgcgctggcggtctatgcgctcaatggccagaggatcgagcgcgtgcgcgcggcgctggatggcgagcacgactacatcaccatctacgagaggaagaattcctccgtcgtggacattctgaatcccgaaatcgtgcgcaaattcataaacgagacccatgagaagtactacgcccgcttcggcagggacttcggcaatcccatgatgggcttcttcaccgacgagccccagttcttccgctgggacaccgcctatacgccggtgatgctggaggaatatcgcaggcgctacggcgaggatctgctggacgagctgggcgcgctgttcgtggactgcgagcagtccgatcgtctgcgcttccgctactggacggtgatgaatttcctctacaccgagaatttcgcaaagcagatttacgactggtgcaccgagcacaactgccagctgacgggtcacaccatcgaggagagcagtctgttcggccagatgatgtgctgcgcgggcgtcatgccgttctacaagtacgagcacaagcccggcatggactggctgggccgcgacatctccaccgaggcatcgccgcgccaggtttcctctgtggcgcagcagtacggcaagaagcacgtgctgaccgagaccttcgcctgcgcgggctgggacgttacgccccgggagctcaagcgcatcgccgagtggcagtatgtcaacggcgtgaaccagatgtgccagcatctgtatccctattccatccgcggccagcgcaagcgcgactatcccgcgttctattccgagcacaacacctggacgcagcccgaggagttcaggcacttcaacgactacttcacggcgctgggctacatgctcgccgagagcacggaggtcgccgatgtggcggtcattcatcccatccattcggcctatctgaccttcaagcgcaacgagcgcgactgtgtgaccgagctgaacaggcgctttttcgagctgatcgagacgctgggccgcgccaacatcggccaccattacatcgacgagacgctgctgaaggaggacggccgcgtggacggcgaccggctggtcatgggcaggtgtgcctacagcatcgttgtcgtgcccgagatggacaatctggacgcgaacaccgccgcgctgctgaagcagttcgtggccaatggcggcaagctctacctgcagggcgaagcgcccacgctggtggacggcgagaaggccgatctgtccttcctgcgcgccaatatcgcctttgacgacatggtcagcgacgagtattccatcaacgcgccgtccacggagattcgctccaccatgcgccacgcggacttcggccgcttcctctacgcggtcaatctctccagcgaggcgaccttcgccgtggaatatcgctttgccgccaagggcgcgaagcgcttcgatctggagacccgcgaggaagcgccgctgagcttccgccgcgagggcgacgaaatcgtcgtgccgctgaccttcgcgcccggccagtcctacgtcatcctgctggacgacgaggcgcagtctgtcgcgccggcggagacgggcgctgtccgctccgtgaccgacggcgaggcggagatcgtcgccgccgccgagaacacgctgaccctcgactatgcgtccatgtccttcgacggcgtggagtacacccgcccgctgcccatcatggccgtgtccgaccgcttgctgcgcggcaagaccaaccgcaccgtgttcgtcaagtacgccttcgagatggccgagcgcccggcgtcgctgcgcgtggagttcgaggacatgaacgcccggagcgtgcgcctgaacggcgaggagctgggcaaaaccgagatcggcagcttcgacctgtccttccgcacggcggacgtcctcgacaaggcggtcgtcggacataacgagctggtgttcgagatcgactatacccagccgcaggaggtctacgacgtgttcaacggcgtgtactacgagcattccgacggcaccgagagcctcatcaactgcctgagctatcgcacgaacatcgagtgcgtctatctccgcggcgacttcggcgtaaaggccggcgcgttccgcgagggcgagaagcatacgctcattacctccgacggcttcgccatcgttccgtcgaagaagaaggtgcatatcggcgcgctggcgcaggagggctatcccttcttcggcggcaggatgaccttccgcttccatgtgatcgccgacggaaccgagaccatgctgcgcctgcccggccgctacgccatcgccaaggtgcgcgtcaacggcggcgcggagaagatggtcatgtttgacacggcctgcgacgtgtccggccttctgaagaagggcgacaacaccgtggacgtgacgctctattccagttatcgcaacgtgttcggccccttccacttcgcgaaggatcccgagcccttcggcgtctcgcccgacctgttctccggctacggctggtggaaggaagacgaaacctgcgagcactacaccgacgactatgccttcgtccgctttgggctgaccggcctcgagctggcgtaa

SEQ ID NO: 1337 - DNA, 2988 bp, Unknown
  Artificiall/Consensus sequence
atgaagaaactgcattttcacgaggatccccatcagctgcacgtgaacaccctgccgccgcgggcggatttcgtgcccttttccagccgcagggcggctatgacggagccgcgcgagcgctccgagcgcttcacgtccctgaacggcaagtgggcgtttcactatttcgacagctacgaggatctgcctgcggagttcgatcctgcaaactatctgacggacgagatcgaggttccctcggtctggcagactcagggctacgaccgccatcagtacaccaacgtggcgtttccgttcccctacgatccgccctatgtgcccgtggacaatccctgcgcgctctatcagcgcaccattgcgctggaaaagcacgtcgggtctcgccgcacgctggtgttcgagggcgtggattcctgcttctatctgtggatcaacggccagttcatcggctacagccaggtctcccattccacgtccgaattcgacgtgaccgacgcgctgatcgacggcgcgaacaccttcaccgtgctggtgctcaagtggtgcgacggcagctacttcgaggatcaggacaagctgcgcatgtcgggcatcttccgcgatgtgttcctgctggagcgcagcgcccgcggcctgaaggacttcttcattcacaccgccctgaaggacgattatgcccgcgcggacgtgtccgtggagctggagcggaacggcgacgcgccggtggaatatcgcctgtacgacgccatgggctatgagctggtcaacggccgcgccgaggatggaaagatcgacttcacgctggacagcgtgaccctctggagctctgagaatccctatctgtacaccctgctgctgttctgcgacggcgagtatatcgccgagaagatcggcctgcgcgaaatctgcgtccgcggcggcgtgctgtacgtcaacggccagaacatcaaattccgcggcgtgaatcgccacgacagcgatcccttcgtcggctatgccgtgcgccatgagcagatgctgaaggatctgcaggtgatgaagctgcacaacgtcaacgccatccgcaccagccattatcccaacgcgccggaattcctgcgcatgtgcgacgagtacggcttctacgtcatcgacgaatccgacgtggagtgccacggcgtgatcttctgcggcgacctgggccacgatgagaactacaatatcctcgcccgggatcccgaatacgccgagaccattctcgaccgcgtgcagcgcaatgtcatccgcgacaagaaccgcaccagcgtgctgctgtggtccatgggcaatgagtccggccacggcgagaacttcgacgcggcgctgaagtggacgaagcagtacgatccctcgcgcctgacccactacgagcgcgcgtccttcccgcccaagggcatggagatcaacagggacgatctggacacctacagccgcatgtatcccagcatcgccgagatggacgaattcctcgagaaaaacgagctcggcaagccctacatcctctgcgagtattctcacgccatgggcaacggccccggagatctggaggattactatcgctgcttcgagcgccacgacggcgcgtgcggcggctttatctgggagtggtgcgaccacgcggtctatatgggacgcaccgtgggcggccgcgcgaagtacttctacggcggcgacttcggcgaattcccacacgacggcaacttctgcatggacggtctggtctatcccgaccgccgcccgcacacgggtctgaaggaatacaagaacgtcatccgtcccgcccgcgtgggcgaggtcgacctgaaggcgggtgtgttccagctgaagaacgcgctggatttcacgaacctgcgcgaatttgtggagatttcctacgtcgtgcgccagaacgggcgggacgtgttcgagggttcgctcaccgaggagcagctggacgtcgcgccccatagcgtcagggagatccgcatcgcctatccggagaacctgaagggcgatttcgccgtgtgcttcaccacgattcagaggttcgacacggcgctggttcccgcgggccacaagctgggcgtggagcagctgggccgccagcgcttcgaggtcgccgcgcgcgaggaaggcgtgctggccgtggagacgaaggagcacggccgctacctccacatcgacggcgaaaacttccactatgtttacgacaagacccgcgtggccttcgatctgctcaattacgacaacctgagcctgatcgagaagcccatggagctgaacgtctggcgcgcccccacggacaacgaccgcaacattcgcagcgagtgggaggccgccggctacaaccgcgccgttccgcgcggctatgagacggtggtcgaccacgaggacggcgactgcatcctgcgcacccgcttctccatcggcgcggtggtcgtgcgcaatttcgtcgagggcgaggcctgctggcgcatcgccaagaacggcgaaatcagcgtggaaatcaccgccagacggctggcgagcgcccccgcgctgccgcgcttcggtctgcggctgttcgtgcccagacgcatgaatcaggcggagtacttcggctacggcccctacgagagctatatcgacaagcatcgcgcgtcggtgaagcatctctatgccgccaatgtcgagagcatgcacgaggactacatccgcccgcaggagaacggcagccacttcaactgcgactatctgaagctgtcctcctacaacggcggcatcgaggtcaccggcgagggcttctgcttcaatgcctcccgctacactcaggaggaactgacgaagaaggcgcacaactttgagctggagaagtcagacagcgtggtgctgtgcatcgatgcgttccagaacggcatcggctccaacagctgcggcccgaggctcatggcgcgctacgaatccccggcggacattcacttcgcctgcaggatttcgccctatcgcgactga

SEQ ID NO: 1338 - DNA, 2448 bp, Unknown
  Artificiall/Consensus sequence
atggaactgaaaaagaagagcgtggagcagatcaaggaagagctgctcgaaaagctgagcacgactttcggctgcggcatcgaagaggcgacggacgagcaggtctatcaggcgctggccatgatggttcgcgacgaggtgatgcagcgccgcagcgtctcaaggggcgtgcgcaagcagacgggatcgaaaaaggtgtattacctcagcgccgagtttttggtgggccgcgcgctgtacaataatatggtcaatctggtcaacgagggcaactatctcaaggcgctggacgagctgggtatcgacaagagcgtgatcttcgaggaggagccggagccgggcctgggcaacggcggcctcggccgtctggccgcgtgcttcctggattcgctgacgacgctgaagctgccggccatgggatgcagcatccgctacgagttcggcctgttccgccagaagctggtggacggctatcaggtggaggtgccggacaattggctggactggggcaatgtgtgggagatcccgcgcccggagcagacggtggaggtgcacttcggcggaagggtcgtgccctacgacgaccacggccgcatgcgctttgcccatgaaaactacaccaccgtgctggccgtaccctacgacattcccacgctgggctacgacacgacgatggtcaacttcctgcgcgtgtggtcggcgcgctcacccaagcagatcgacatgcagtcgttcaactcgggccagtacgtcaaggccatggccgagcgagagctggcggaggtcatttccaagattctctatcccaacgacgacagctatcagggaaaggagctgcgcctgaagcagcagtacttcttctcgtccgcgtcggtgcagtacgccgtgagcgacttcctgaaggtctacggccccaactggagtatcttcccggacaaggtggccattcacatcaacgatacccatcccgcggtggccatccccgagctgatgcgcgtgctgatggacgagcacgatctgggctgggacgaggcggaggacatctgccgccgcaccttcgcctacacgaaccacacggtgctgcaggaggcgctggagcgctggcccgaatcgctgttcgccgagacgctgccgcgcatctacatgattctgcaggagatgaaccgccggctgtgcgaaaagctctggaagtcctatcccggccagtgggagcgcatcggccacatggcgattctgggctataatcaggcccacatggccaacctctgcgtggcctacgcccattcggtcaacggcgtttcggccattcacacggacatcctgaagaagcagaccttccacgacttctacatcctcgagccgcagaagttcgtgtccatcaccaacggcatcacccatcgccgctggctgattcagtgcaatcccgggctttcgtccctcatcgacgaggccatcggcgacggctggcgcaaggacatggatcagctgatccggctgaagccctttgccgacgacgcggccttccgggagaaattcgcgaagatcaaggcggagaacaagctgcggctggccgagcatgtgcgccgccagcagggaattgagatgaatcccgacagcctgttcgacgcgcaggccaagcgcctgcacgaatacaagcgccagctgatgaacgcgctgggcattctgatgcgctacaacgagatcgccgccaacccggacaggacgtacctgccgcgcacctacatcttcggcgcgaaggccgccccgggctatcagcgcgcgaagctgaccatcaagctcatcaactccatcgccgacatggtgcgcaggcatcccgttgcgtcgaagtacatcgacgtggtgttcctggagaactactccgtgtcgcaggccgaggtgctgatgcctgcggcggagctgtccgagcagatttccaccgccggcaaggaggccagcggcaccggcaacatgaagttcatgatgaacggcgcggtgaccatcggcaccatggacggcgcgaactgcgaaatccacgacgcggtgggcgcggagaacatctacatcttcggcctgaccgccgagcaggtggagcgcggctattccagctatcgctcctatgagatctacgagacgaatcccgccatccgaaaggcgctggagcagctcatcgacggcacgctctgcccggagcatccccgcatgttccaggagatctaccacgcgctgctgttcggcgacggcggcggaatggccgacccctacttcgtgctgaaggacctgcctcagtacatggcggcgcagaagaagatcgacggcgactacaccgacaaggatctgtggctgcgcaaggccgtgctgaacacggcgtgctccggcggattctcctccgaccgcaccattcgcgagtacaacgacaagatctggcacctgaagccgctgaacctgtaa

SEQ ID NO: 1339 - DNA, 2511 bp, Unknown
  Artificiall/Consensus sequence
ttgattgatgacaagaacgtcggccatctgatgccgctgaacatcgaggatgagctgaaaaaatcgtttatttcctacgcgatggcggtcatcgtcagccgcgcgctgcccgacgtgcgcgacggcctgaagcccgtacaccgcagaatcctctattccatgaccgagctgggcgtcacgccggacaaacccttccgcaagtccgcgcgtatcgtcggcgatgtgctcggtaaatatcatccccacggcgactcctccgtctacgacgcgatggtgcgtctggctcaggattttgccacccactatccgctggtggagggtcagggcaactttggctccgtggacggcgacggcgcggcggccatgcgttataccgaagcgcgcctgtccaagctgtccatggagatggtgcgcgatctggaaaaggagaccgtcgacttctaccccaactttgacgaaacgctgatgcagccggccgtcatgccctcccgcttcccgaacctgctggtcaacggctcgtcgggcatcgccgtgggcatggccaccaacatccctccccacaatctgggcgaggtcatcgacggcgtggtctgcatgatcgacaacccggaatgcaccgtggacgacctgatgcagtgcgtcaagggcccggacttccccaccggcggcgtgattctcggccgccgcggcatctacgacacctatcacaccggccgcggacgcatcgtcgtgcgcgctaagagcgagatcgaggagatgcccaacaaccgtcagcgcatcgtcgtgacggaaatcccctacatggtcaacaaggccaagctcatcgagaagatcgccgagatggtgcacgacaagaccgtcgagggcatctccgacatccgcgacgagtccgaccgcaggggcatgcgcatcgtcatcgagctcaagcgcgacaccaatgccagcgtcgtgctgaacacgctgtacaagcacacccagctgcaggacaccttcggcgccatcatgctggcgctggtggacggcgagccgaaggtgctctccctcaagcagatcatcttccactacctccagcatcaggaggacgtcatccgccgcagaacgaagtacgatctggacaaggccgaggcgcgcagccacattctggaaggcctgatgatcgcgctggacaacatcgacgaggtcatcgcgctgattcgcgcaagccgcacggcgcaggacgcgcgcgacggcctgatgagccgcttcggcctgaccgagcgtcaggcgcaggccattctggacatgcgtctgcagcgcctgaccggcctggaacgcgacaagatcgaggccgagtacgccgagcttcagaagctgatcgcctattacaaagaggttctggccgacgagcgcaagctgctgggcatcatcaaggacgaaattctggagatcaagcgcaagtacgccgacgagcgcaagaccgagatctcggccatggacggcgaaatcgacatgctcgacctcatcgacgaggaggacatggtggtcaccatgacccacttcggctacgtcaagcgcctgcccaagaccacctatcgcgcacagcgccgcggcggcaagggcgtggtgggcgcaaccacccgcgaggaggacttcgtggagcagatgtacgtcacgtccacccacgacccgctgatgttcttcaccaaccgcggccgcgtctatcagctcaactgctacgagatccccgaggcgggccgcaccgcccgcggcacggccatcgtcaacctgctgcagctggatccgggcgagaaggtcacggccatgctgcccatcccgcaggagaagaccgagggccactatctggtcatggccaccaagcagggcgtcatcaagcgcaccgagctgagcgagttcgccaacctgcgcaaggcgggcctgatcgccatcgtgctgcgcgaagacgacgcgctcatcggcgtggcactcaccgacggcagctacgagatgctgctgggcacccgcagcggcatggccatccgcttccccgagagcgacatgcgccccatcggccgcaacgccatgggcgtgaaggccattgagctggacggcggcgacgaggtcgtggacatgtgcccggtgttcccggacatgaaggtgctgtccatcaccgaaaacggctacggcaagcgcacggagatcgacgaataccgcgtgcagagccgcggcggcaagggcatcaaggccatgaacctcaccgccaagaccggcgcgctgacctgtcagctgctggttcacgaggatgaggacatcctgctcatcaccgacgacggcacgctcatccgcatgcccgtggccgacatctccaccttgggccgcaacacccagggcgtgcgcctgatgcgcgtggaggacggctgcaaggtcgtctgcgtcgcccgggccgaggccgaggaggacgacgagcccgacgatccgctggacgttcccgaggagaacgacgcttccgcggagagcgcgggcgaagaggaataa

SEQ ID NO: 1340 - DNA, 3651 bp, Unknown
  Artificiall/Consensus sequence
atggagcaattcgtcgggcgctacggctgcctgttcagcccgctggaggagctggacgcgtttcgagatctgacggacgcgctgcgcaggccgggcgtctattcggcctacggcccggacgacgcccagcgggcgcatctcatcgccgcggcggtgcggaagctgaaccgcccggcgctggtgatcgtgcccaacgagatggccgcgctgcgcatgacggaggatctgaacctgcttctggacggtcgggtgcgcagcctgccggcccgggagctgacctttctgaaggcggcggcctccagccacggcatgacccttcgccgcatggaggcgctgggcgactgcgccacgggcaaagcggcggcgctggtgctgtccgcggacgcgatgatgaaccggctgatgcccgccgaacggctgcgcgggcacgtcgttgagatcgacgacaccatgcgcatggagccggcggagctgatggagaagctgaccgacgcgggctacgagcgcgtccagctggtggaggcgcggggccagtgcgccctgcgcggcggcattctggacgtgtatcccgtgggcgagcccaacgcgctgcgcatcgagttcttcgacgacgagatcaactccatccgcagcttcgatgtgatgacccagcgctccgtgtcgccgcgcccgtccgcgcggctctatcccgccacggagacgctcctgaaggaagaggagcggctgctggccgcgggccggctgagctttcagctcaggaacagcgcctcgggccggggacggagccgtcagaagcagctggagagccagttcgacctcacgccctttgaggatttcctcaggcagacggcggcggacgaggaggccggcgcgtcggggcgctcggcccgcagcgccatggagcgcaactttgccttcgccgtggacgcgctgcagacgggccgcagcttcgacggcgaggattcgctggcgccggtgctgctggactatgaggcgacggccgccgactatctggacgaccccatcgtggtgctggatcagcccgagcggctgcgcgagcgctgcgaaaacgcctatctggagttcaaggagcagtttcaggcggcgctggagcgcgaggaggcgcttccggtgcaggccgagctgctctggcactgggacacggtgctgtccaagctggacgggagaagcctgctgatcgccaatcccttcctgcgcaccgagcgggacttcgcgcccaaggcgctgttcaaattcgagtgccgcaacgccacgggctatcagacgaacctcagggagctggcggccgatctgaaccggtggaaggccgacggctggcgcgtggcgctgctggcgggcggcaacgcccgcggcgagcggctggagaaggcgcttgccgatctggaagcgccggcaaagttcatggaggaagcgcccgacgcgcttgagcccggtcagccggtgatcctgccggtgacgctgaaccggggcttcctgtatccggatatcaggttcgccgtcctgtccgagtcggacgtgtacggcgtgaaccgccagaagagccgcgcccgggcgcgctccggcgagaagatttcggccttcaccgacctgcgcgtgggcgattacgtcgtccacgagaaccacggcatcggccagtacatgggcacggtgcgtctggccagcgacggaacctaccgcgactttctgcacatccgctatcagggctcggacaagctctacgtgcccacggatcagctggatcgcgtgcagaagtacatcggctccgagggcgaagcgcccaagctgaaccgcctctccggcggcgaatggcagcggcagaagtccaaggtcaagcagtccatccgggacatggcgggcgatctgctcaagctctacgctcagcgcgagtccgtgcccggccacgccttcgacccggacacgccctggcagcgggagttcgaggacagcttcccctacgaggaaacgccggatcagctggcggccatcgaggacatcaagcgcgacatggaatcgccgaaggtcatggatcgcctgctgtgcggcgacgtgggctacggcaagaccgaggtggcgctgcgggccatcttcaaggcggtcatgggcggcaagcaggccgccatgctcgcgccgacgaccattctggctcagcagcactacgccaccatgctcaaccgcttcaacggcttccccatccacgtggagaccatcagccgcttcaagaccgccgcggagcagaaggacattctgcgcaggctccgggagggcgacgtggacgtgatcgtgggaacccaccggctgctggccaaagacgtggagttcaagaacctcggcctgctggtggtggacgaggagcagcgcttcggcgtggcccacaaggaggccatcaagaagatgaagcagtccgtggacgtgctgacgctcacggccacgcccattccccgcacgctgcacatgtccatggtgggcatccgcgacatgagcctgctccagtcgccgccggaggagcgctatcccgtgcagacctacgtggtggaatactccgacgggctggtgcgcgacgcgattctgcgcgagctggcccggggcggacaggtctatgtgctccacaaccgcgtgcagaccatcgacgtgatgtacgcgcggctgaagaagctcgtccccgaggcgcgcatcgccgtgggccacggccagatgcgcgagcacgcgctggaggacgtgatgatggacttctacgagggcaaattcgacgtgctgctgtgcaccaccatcatcgaggccggactggacgtgccccgggccaacacgctcatcgtctgcgacgcggatcgctttggtctggcgcagctgtatcagctgcgcggccgcgtgggccgcagcaaccggctggcctacgcctatctgacggtcaatcccaacaaggtgctcactgagacggccgaccgccgtctggccgccatccgggagttcaccgagttcggctcgggcttccgcgtggccatgcgcgatctggagatccgcggcgcgggcaacctgctgggcatggagcagagcggattcatggcctcggtgggctacgacctctacgtcaagatgatcgaggaaaccattcacgaaatgcgcggcgacgcgtctcagggcgacgtggacacccgcgtggacgtgaaggtggacgcgtatctgccccaggaatacgtctccaacgacctgctgcgcatggagatgtacaagcgcatcgcgtccatccgctccgaggagagccgcgacgatctggtggacgagctgatcgaccgcttcggcgatccgaagaagcccgtcatgaatctgatcgacattgcccagctcaaggcgctgtgctcgcggctggccatcgactacgtcacctgcaagggcgcttcgctggtgatgcgcttctccatttccgcggagatcgacttcgtgagcgtgctcaccgcggtcaagcgccatccggagctgcaggtcaacggcaccaatccgccgtcgctggtgttcacggagcttggaaaggcgcccgacgagctgctggccgacgcggtgggcgtgatgctgaaggtcacgaaggactttgaggcgctgacggcgaaggagccggagacgaaggaggaagcatga

SEQ ID NO: 1341 - DNA, 2487 bp, Unknown
  Artificiall/Consensus sequence
atgactgaaaaatcacatcggcggctgaaaatccccgcatggcttctgccggtgattctcgccctgctgatcgtctatctgctgtcctatgccattgtctcgccctccgaggacgttcggctctggttctccgatcccttcgtcatcagcggcgaatggacggatctgtccaccggcgagcctctgggaactcagcggcgaatgctgcgctccggcgacacgctgcggatcggctgtcagatgcccgattcgctgcccgcggactcctggctgtatctggccagcaactacatgcacatcaccgcccgcgtggacggtgaaaccgtctttgagaacggcacgctgcctccgcagcagatcggcgcggaaaacggccgcatctgggcgggctttcccctcctgcaggaatacgaatcgaaaaccatgacgctgaccatcgagtgcaccgacatcgactacttcttcgacccggacacgctgatcatcggctgtcacaacgacctgaaccgcaggatcatcggcgaaagcggcgagctgctggtgcagagcgcgttgatgctgctgttcggcgtggcgatgtgcgtgtattccctctccattcgcccctatgccatccgcttcggcttcaagtgcttcctgctgctgggactgttctttctggactgcgccatgtggctgctgacggattcctttgcgtttcagtttgtgacgggcaacggctcgctgcgctacatgctggcgtttttttccttcctgatcatgccgctgctggcgacggagggctactgcgtcatcgcgccccactccggcagaatgctccgtggctatcgcacggcctacggcctgatgcttgccgcggcgctgatcgcctatgcggcgggctgggtgcatatctcccgtatgctgacgccgttctttgtcgcgatgatggcgggcgtggcgctgattcttggcgcgtgcgtctgggagcgctggtgccatcgcgagacgtacatgaagggctcgctgctgccgttcatcgtgctgggcagcgcgataattctgaacattctggactactacgtccgccgtccccgggattcctcccacatcttccgctggggaatgctggtctatctgttaatcctgagcgtgacggtgctgcgccgcagcatggagcagtgccgggaacagcgcatcatcgagcactacaaccgcatgccctgcggcatgttctatctgatgctcgaccgcgacagccatggccatctgcagctgaacgaggcgaccatctattccttcaacccccagtgcctgcacttgctgcgctatcccgacgcgaaatcgctgatgagcgccatgctgacgacgctgtttccgccggacgagatgaagcgcttccgcgagaacgtgctccgcgcgtccgtgggcgcgccggtcagcgcccgcatgcagatgagccgcggcgacggcaccacaggctatttcgacgcggcgttcgagctcaagcgctttggcagcgacggcacggccgtggaatgcgtctttctggacgtgacggagacggtgcgcgccgaatcccgtctgaacgtcagcgaggccatctgccgaatggtcatccagaacagcaaccgcatcatccagagatattccatcgccgaccgcaccgcgtggacgcccagggaattctccgaccggatgggcctgccggaaaagatcgaaaacattcccgagagcgtcatcgccgcccacaccgtggctgagagcagcgaggaggaattccgggcgatctatcgcgacatcgacgtggggaagccctgcgggcgggattacgaggtggagcgcatcgccgccgacggcgcgtccgtgtggatgctgacgcgctacgtgctggttcgggacgaagagggtcagcctcgctcggccattctctacatggacgacatcaccgccatcaagcgccgggagcaggcgctgctccatcgcgcggagcgcgacggcctgaccgggctgtacaaccgtgcggccatggaggcgcacattcgcgaagtgctggagcgtcccgcggaagaccgccgcgcgctgctcattctggatctggactcgatgaagaccatcaacgacacattcggccacgccgtgggcgacgaagcgctcaccgacatgtccaacgcgctgtgcagccatttccgccatatcgaccgaatcggccgcatcggcggcgacgagttcatggtattcctcgacggctgcggcagtcctgcctggctctgcggctcactggagcgccttctgggcaagatggaggggcagtacgtgggcgacggtcagcgtctccccgtgcgatgcagcgtcggcggcgcgtaccagcgtcccggcgacgacttcgaagccctctaccgccgcgcggacgcgtgcctctatcgcgccaagcacgcgggcaagaacaccttcgagctggagacggaatccggcaatctcatcgccgacgccagccgcggaagctga

SEQ ID NO: 1342 - DNA, 3099 bp, Unknown
  Artificiall/Consensus sequence
ttggaaagcgaggaatacggcatgattatgcatcagctcgacgcccgcatgggcaagatgctggaggatctgaagggcatgctggttcgccgccgcatggatgtggacggcattctgaccggcccgcgcggcgcggccgaaacgccctttgccaacggcggcgtgtggggccgcggcgagtgggaggacttcagactctcgctggacgtgcccgccgagggcaactggtatctctatgccaccaccggccgcgagggcgcgtgggacgccatcaatccccagttcgtggtgcgcgtgaacggtcaggtgaagcaggccttcgacgtcaaccacatccgcctgccgctggagaacggcgcgcacgaggacattctgcttcaaggctactgccagccctcggccacggggctggactatccctatctgaagctggaaatgtgcgacgtggatgcggagctggagcagctgatctacgatctgaaggtgccctatgaggccgtgatgctgatgccctcggacaatcgcgagcgcgaggtcacgctggagacgctgtcccgggcgctggatctgctggatctgcgcaatccgcacgacgcgaatttcaaccagaccgtccgcgaggcgcgggaatatctgaggaagagctattacgagccgaggaaggccatcccgcccatggccgtggccgagtgcgtgggacacacgcacatcgacgtggcgtggctgtgggatctccatcagacccgctccaaggccgtgcgcagcttctccaccgtgctgagcctgatggatcgctaccccgagtatcgcttcatgtccagccagccggcgctgtacgatttcgtcaaacaggacgagccggagctctacgagcgcatccgtcagcgcgtggccgagggccgctgggaggtcgagggcggcatgtgggtcgaggccgactgcaacctgtccggcggcgagtcgctggcgcgccagttcctctatggacagcgcttctttgagaaggaattcggcaagcgctgccgcgtgctgtggctgcccgacgtgttcggctattccgccgcgctgccccagctgatgaagctctccggcatcgactacttcatgaccaccaagctcagctggagcgaatacaacctcacgccctacgacaccttcatgtggaagggcatcgacggcaccaaggtgctgacccacttctcgcccagccgcgaatacttcgaggccggccatggcgagggccacgagggactgtcccattacaccacctacaacgcgctgattcagcccagccagatcgccggcggctggaagcgcttccagcagaagggcatcgacgaccacttcctcgtctcctacggctatggcgacggcggcggcgggcccaccgactggatgctggagcagggccggcgcatggaaacgcccatgcccaacacgcccgtggtgcggcagacgcaggcgcgccccttcttcgaggcgctggagcagcgcgtggcggccgacccgcggctgcccgtgtggagcggcgaactgtacctcgagtaccatcgcggcacctacaccgctcaggctcacaacaagcgcaacaaccgcaagatcgagctggctctgcgcagcgcggagcttcgcttcctcgaggcggcgaagtacggcatggcgtatcccgccgaggcgctggccgccatctggaaggacgtgctgaccctccagttccacgacattctgcccggctcgtccatccgcaaggtctacgaggattcggacaggatgtacgccgcgtgcttcgaaaagctcggcaagctgtgccgcgaggcgcttgaaaagatgctggagaaggatgaccgcgccgtgaccgtgctcaacgatctggacttcgtccgcagcgacgtggtgcgcattcccgcgcagggccgctccgtctccgcgctggccgcggcggacggcagcctcgtgccggtgcagctggtgggcgacgagtacgtggcctatgtcaggaacctcacgcccatgggcgcgaccaccttcaccgtctccgacgaggagctggcggcggacaccgtgcgcgtgacccgcgagtacttcgaaacgcccttcttctccggccgcttcgacgagtccatgcgcatcgtcagcctgatcgacaagcgcgtgaaccgcgagctctgccgcccgggcgaaaagctcaaccgcatcgtctgctacgagaaccgcccgcacaactacgacgcgtgggacgtgaacatctactacaaccgccgcaggtgggaagtggatcaggtcgccggcgtggaaatcgtttctgagggcccggtctgcgccgtgctgcgcgtgaagtacgcctacagcgcgtccgccatcgagcaggagctgcgcttctatcgcgatctgccgcgcatcgacttcaacactcgcgtgaactggaacgaggagcactatctgctcaaggcccacttcccgctggacgtgttctacaacgacgcgaccttcgacgtgcagtacggcaacgtccgccgtgcgacccacaaaaacaccagctgggacgcggcccgcttcgaggtctgcgcccacaagtggatggacgtgtccgagccggactacggcgtggcgctgctgaacgactgcaagtacggccattccgtggatgaaaacggtctggcgctgacgctgctgaagagctccacctacccggatcccaaggcggatcagggcgagcacgagttcagctacgcgctgctgccccatgtgggcgactggcgcgagggcggcgtggtggacgcggcctacgccttcaactgccccgccgaggccattcccggcatgcgcgcgaaggacgcgaacgcgttcgtccgcctcgagggcgagggcgcggtcgtcgagtccgtcaagaaggccgaggacggcggcgacgtgatcgtccgcctgtacgagtgctacggccgccgcgcgaacgtgaggctgattcccggcttcccctttgctcaggcgcacgtgtgcaatatcctcgaggagaacggcgaggccgcggccgtcgaaaacggcgcgatcgccctgtcgctcaagccctatcagatcgtcaccctgcgtttcggcaggtaa

SEQ ID NO: 1343 - DNA, 2196 bp, Unknown
  Artificiall/Consensus sequence
atgtccgacgacgggaaagcctatatcagcgtcgacgagctgatcgccaaaattcgcaaataccatccggacgacgacatggagctggtgcgcagggcctatgcctttgcggagcacgcccacgccaaccagaagcgcaagtcgggcgatccctatttctgccatccctgcgccgtggcggtcatcctctccgacctgatgctggacgcgaccaccatcgccgccggacttctgcacgactgcgtggaggacgtggacggcgtgaccactcaggtcatcggcgagcagttcgggcaggagatcgagctgctggtggacggcgtgaccaagctgagccagctcaacttctcctcgcgggaggaggcgcaggccgagacgctgcgcaagatgttcctggccatggccaaggacatccgcgtggtgctcatcaagctggccgaccggctgcacaacatgcgcacgctgaagttccagaagcccgaacggcagattcccatcgcccgggagacgctggacatctacgcaccgctggcccatcggctgggcgtgtacaccatcaagtgggagctggaggatctctcgctgcgctatctcgaccccgagggattctacgagctggtgcgcctggtgggtatgaagcgcgccgagcgcgagcagctggtggctcaggtgacgcaggagctgaaggccaagctgtacgaggccggcatccatcgctgcgaaatcgacggccggccgaagcacttctattccatctacaaaaaaatgaagtcccagaacaagaccttcgatcagatcaacgacctgatcgccgtgcgcgtgctggtgaacaccaccaccgagtgctatcacgccctcggcgtggtgcacaccatctggccgcaggttccggggcgcttcaaggactatatctccgtgcccaaggcgaacatgtaccagtcgctgcacaccacggtggtcaatcagggccggcccttcgaggtgcagattcgcaccttcgagatgcaccgcatcgccgaatacggcatcgccgcccactggcgctacaaagagggcaaggccgccgacgagctggacaagaagctcagctggctgaggcgcattctggactggcagagcgacgcgcgggaccccagcgacttcggcgagatgctcaagttcgacctcttcgccgacgaggttctggtgttcacgcccaagggcgacgtggtttcgctgccccggggcgccacgccgctggacttcgcctatcgcatccattccgccatcggcaaccgctgtatcggcgcaaaggtcaaccatcgcatcgtgccgttgacggctcagctggagacgggcgacttcgtggaggtcatgacctccgcctcgtcccacggcccgtcccgggactggctgaacatcgtcaagaccagcgaggccaaggcgaagatccgcgcatggctgaagaaggaggagcgcgaccagaacatcgtccacggccgggacatgctggagcatgaggccaagcggctgggctattccctgcccgcgctgaccaagcccgacctgatcgagacgctctacaagcgctattccgtccagtcggcggacgacatctacgccatggtgggcttcggcgggctgagcacccagcaggtgctgaaccgcctgatcgaggaatacaaaaagactcacaaggccgaggaaccggcgctcattcccgaagcgaagcccgaggaggccgcgccgaagcgcgcgccctcgtcctcgtccaacggcgtgaccgtcaagggcgaatcgggcatgctggtgcgcttcgccaagtgctgcaacccgctgcccggcgacaagatcatcggctacatcacccgcggccgcggcgtatccgtccatcgcgccgactgcgtcagcctgaaggacgagggcgtggagccggatcgcctgatcgaggtggaatgggagggccagtccgccgactccacctacgaggccgagatcaggattctcgcctacgaccgcaccggcctgctggccgagctgtcggtgatgttcgcctctcaggagattccggtcagcgccatctcggcccacgccgccaagaaccagacctacatcttcaacgtgtccatcgtcatcaagagcacccagcagctcagtaagctgctgcgcgacatcgcccgcattcccgacgtcatcgacgtcagccgcgcgggctga

SEQ ID NO: 1344 - DNA, 1671 bp, Unknown
  Artificiall/Consensus sequence
atgaagaaaatgctgatcgccctgctgcttgcgctgacgctgctcgtgtcggcggttccctccttcgcggaggaagcgcccaaggagctgaagttcgtctacatcgacggctggtcgtcggtggacgacggagataccaccagcgccatcacccagaagatcgccgaggaaaccggcgtgctcatcagccccgtcaccgccggcggcgaccgcggaacgatcctcctttcctccggcgagattggcgactgcctgatggtctacaacgccacgatgctcaagacctgcgtggagaacggcatgatgctcgacctgagcacgctggtcagcgaggaaaagacccccgccatcctgtccaacccggaccgcattcagatggcgcaggtgctctccgaaaccgacgacggcagctactacttcctgcccgtgcagtgcggcagcgagggcgcgccgatgacgccctatcactccctgttcaacgtccgctgggatctgtataagcagatgggctatcctgaggtgacggataccgacagcatgctggcgctgctcagcgagatgcagaagctcaatcccaccaccgaggacggcaagaccgtctacggctacagcctggagctgggcaacttccgccatgcctactggccgtggcactacaccttcggctattacacctccaacgacttcatcagcaccaacatcaacaccggcgaaatggtctacgagccgctggatgagaacagccccatgtggagcttcctggagtatctgaacaaggcctacaaggccggcctgttcgatcccgacagcttcacccagaccggcgacgacatgaaggccaagatcgcggccggacaggtgctctctcccatctgggcctccgacggcgtgcagtatgaggcggccaaccccaacaccgccgaggagttccgcggcttccagaccctgcccgtggagggcacgacctactggtgcaattcctactataacggcggctgggacgcctgcttcgtgggcattcccgccaacagctccgatcccgaggccgcgctgcgcgtgctggaatacctctctaccgacgacggcgcgcgcctggtggacagcggcattcagggcgtgcactgggactacgatgagaacggcgtgcccacgctcaccgatgagatcatcgaggcctacaacaactggagcgacgaattcgtcgattcttgcattcaggacgccatattcggcacgctgaccgccatgggcaacggcgagctgcactccgacggctacccggtcaatctgttcatgaccgagcaggtctacacccgcgagctcagcgcctgcgacaaggactactgcgactactacggcgtgagctatccgatgaagctcttcctgaacaagatggaggagggcaccatccacgaccacatcaacgacatcttcgacatgcgcgtcgtgaccggcatgggttccgcgcccgaggacatcgcccgcatcgacgagaccatcgtcaacaaggccaaggatatgctgcccaccatcatcatggccgaggacttcgaggccacgaaggcggaatgcctcaagaccctctggtcctacaatgcgcaggaggcgcgcgattggtggcaggcccgtcacgattctctgaccgagctgttcaccggccgcacgaagtaa

SEQ ID NO: 1345 - DNA, 1944 bp, Unknown
  Artificiall/Consensus sequence
atgagctactggatctggttccccggcgatttcgaaattcgccacggcctgaaggtcaactgccgccgcgaggagcgcatgcggcgctatcccgccatctggcgcgtggacgactgcggacgcagcgtccgtctgcgccgcaaatgcacgctgaccgaggcggagacggtgctcgtccgcgcccgcggcgagggccagcttcgcgtggacggagcctttcgcccgctgaacgagcccgtctgcttcgagccgggcgcgcacgagctgatcgtcgagctgacgcgcatggacggcctgccctgcgcctatgtggagggcaagtccttcgccagcggcgcgggctgggaggcgcagaatttcgccggcccgtggcagccctgcggcttcagcgagatgtataccgacccggacgacgaccccgagcagttcaagttcgcttattcccccattgagccgactgccgtcactcccgacgagacgggcgttctgtacgacttcggccgcgagaccttcgcccggctgcacctgtccgacctctccggcggcctgaccgtctgctatggcgagagcgagaccgaggcccgggacgtggagaactgctacattctcgaccggattcccgccggccaggccgaggccgaccttcccgcccgggcgttccgctatctgttcttccccggcgcgaagagcatctccctgcgcgcggaatatgaatatctcccgctggaggagcgcggctccttcacgagcggcgacccgctgctcaacgaaatctggcgcgtggcggcctacaccttccatctcaacagccgcgaatgcttcctcgacggaatcaagcgcgaccgctgggtctggtcgggcgacgcgtatcagagctatttcgtcaaccgcgtgctctacatggacaaggagctctgccgccgcaccatctgggcgctgcgcggcaaggatcccatcgagcagcacatcaacaccattctggactactcgctctactgggtcatgagcgtgggcgactactacgagaccttcggcgacgcggacttcgtgcgccagatctggccgcgggtcagaaccatgatggactactgccgcgccagcgtcaacgccgacggcttcctcgagggccgcgaaaacgactgggtgttcatcgactgggccgaaatggacaaggagggcgcgctgttcgccgagcaggtgctgttcatcaaggcgctggaagccgccgcgcgctgcgccgagctttccggcgaggacggcggcctctacatccgtcaggcgaacgagcttcgcgccaggctggacgagttcttctacgacgaagaaaagggctgctacatcgacggctacgcctccggcaaacgcaatgtcacccgccacggcaacatcttcgccatcctgttcgacattgccgacgcgcagcggcaggcgagcctcgtccagaacgtgctggacaaccccgacgttccgcccatcaccacaccctatttcaagttcttcgagctctgggcgctgtgcaagctggggcgcacggacaaggccctcgaacgcgtgcgcgactattggggcggcatgctggctctgggcgcgacgaccatgtgggagcagttcgatccccgggaggatttcccggcccactacggcatgtacggcatgaagtacgaccgcagcttctgccacgcatggggcgcaggcccgatctacctcctcggtgcgtaccacatgggtcttcgccccaccgcgccgggctacgcgaccttcgtcgtcgccccggacgcgtccgcggcggattccttcgaaggcacgctgcccctgcccgatggacaggtggaaatctccctgaaggacggcagactgaccgtccgcgccagccgtgacggcggcgaagccgtctggaacaaccagcgcgtcgcccttcccgcgggcgaaaccgtcacgctgtaa

SEQ ID NO: 1346 - DNA, 1686 bp, Unknown
  Artificiall/Consensus sequence
atgaagaagctgcttgcctcgctgctggccctgatgctcatcatcgcctgcgcggtccccgctctggcggccgaaggcgccgagcccgactggactggatatgacgaactgatcgcgaagatcaaggcgtccaccgacttcgtcgagcgcgaagccctgatgcaccaggccgaggacatgctgatggacaccggctgcatcgtcccgatctactactacaacgacgtttacatgcagaagcccggtgtggaaggcgtttattccaacgcctatggcaccaagtacttcatgtatgccaccaacggcgactccgccaagctgcgcctgcagctcgcgtccgagcccgacaagctggatcccgcgctgaacagctccgtggacggcgcgtgcctggcggccaactccttcggcggcctgtacacctatgacgcggaaggccagctggcccccaacttcgccaccgagtacaccgtctccgacgacggcctgacctacgtgttcaccatgcgcgacggcctgaagtggtccgacggctccgatctgaccgccaaggacttcgagtacagctggaagcgcgctgccaaccccgagaccgccgcggactactcctacatgttcaacggcatcgcgggctatccggacaatctggacgtcaccgcgtctgaggacggcaagaccctgaccgtggttctgtccgcgccctgcgcgtacttcctcgatctggcggccttccccaccttctacgccgtgaagcaggagaccgtcgagtccgccgagggctatctgggcgacgacggctccgtgcagaaccccggcgcgtgggcgctggaagccggcttcgtctcctccggcgcgtacacgctgaccgagtggaagcacaacgagtccatggtctacaccaagaacccctattactgggacgccgagaacgtgaagctcgagaccctcgagttcatgctctccgccgatgacaccgccatctacgccgcctacaactccggcgatctggacttcatcgacaccgttcccaacgacgagattcagtccctgctggagaaccccgagttccacatcgtggaccagctgggcacctactacatctgcttcaacgtcaagtccgacctcttcgccggcaagaccgtggagcaggcggccgacatgcgcaaggccttctccaagctgattgatcgtcagtacatcatcgacactgtcggccagaccggccagaagatcgccaccaccttcatccccgagggcatggcggacggcaacggcggcgtcttcaaggccaacgacgacgcgtacaccttcccggatgcggaagcgctgggctactacggcgaggaagtggacaccgagggcgccattgagctgctcaagtccgcgggctacgagttcgacgacagcggcatgctgtccgccgacacgcccatctccttcgagtatctgaccaacgagtcctccggccacatcgccatcgccgagtgcgtccagcaggatctggccatgatcggcatcgacatgaccatccgcacctgcgactggaacgttttcctgaacgaccgcaaggccggcaactacgacatcgcccgcaacggctgggtcgcggacttcaacgacccgatcaacatgctcgaaatgtggacgaccgactccggcaacaacgacgtccagttcggccgctaa

SEQ ID NO: 1347 - DNA, 4776 bp, Unknown
  Artificiall/Consensus sequence
atgaaaaaatgcttatccttgctccttgcggcggtcatgacgctgctgtgctgctctgcgttcgcggagggcaccaccggccgcggcgacctcgtcgtgcggagcgaatctctctccgcctatgtggacggcgacggcaatctctggattcccggaaacagccagcccgtcaacaagaccaaggccgacgccatcgtgtccatcgacgcctaccggctgatcttcttcagcgtggacgacggcggcaagcgcgccctgctgagcctcgacctgtccacgtttgccgagcagacgctggcgcaggacgtctgggccgcctgcatgggcgacgacgaccatctgttttacattcccgccaatgaccgcacccagctgtgcgacgtgaatctggagaataaccagacgaccacggcctacaccgccgtcgagcagctcgaccgcctgtacctctccgccgagggcctggtggcaacctatgtggaaagcgcgggagccatcctccgctccaatgtcaccggtgcgttccagacgttctccggcagcattcccacggacagcaccctcgccgacggcgaccagctctatctggccaacggcagtgacctgtacctcttccgctccacctccttcgccgcggacatcatcgacaccaacgtctatgattacgcgacgctgggcggcaggatctactacatcgccaacaccggcagcgccgtgcgcctgaagagctacgaccccgagacgatggagtggaaggtgctcggcacgcccgacatctccctcgccggccagctgaccgccagcgaaagccgcctgttcacgctgggcagcgattccgtggtctacaccgtggacgtggccaccggcgagctgaccccctttgcgaccattcaggccaacaacattcccgacggctggcaggtggattcctatttcatcgaggccatgagcggccagctgaacgtctacgccaagatctccgaaaagacggactccccctccttctcctttatggagtttacctcggacgtgtccgacggcgaccgcttcgtgctggtgagcaccacggcgctggagggcgaaacgaaggcatgggatctgcttcagcccgcgccgacgacccagacgctgaccacgctgcgccgcggacagcgcggtgaggcggtgcgcaccatgcagcagccgctgtacgatctgggctattatgactaccgcgtggacggcatcttcggctcccgcaccgagcgcgccatccgcctgcttcaggacgatctgggccgcgcggtgaacggcgtggccgaccctgagcttcagcagattatcctcagcggcacgctgtccaagtacgatccctatcgcgcggtctatcgcggcgaccgcagcctgcgcgttcagatgatgcagtcccgactgcgcgagctgggctatctgtccgactccgccgacggcatcttcggctcccgcactcaggcggccgttcagctgttccagcgcgaaaacggcttctccgtggaggaatatgccacccgcgacaccctcgccgctctctattccgacagcgccagcccctgctccagctacatcgacctgcgcaagggcgacagcggcgctcgcgtccgcgagctgaaccagcggctgaaggatctgtactatctggacgtgcgcgtgggagacacctacaccgacgacactgtgcgcgccgtcaagaagttccagtctcaggccggtctgtccatcaccgggcaggcgaccgtgaccgttctgcagcgcctgttctctgacagcgcgcccgaatatcgcggctacaccgtgctgcgccgcggcgacgagaacagccgcgtagagcgcctgcagcgccgtctgaaggagctggactacttcaccgccaacgtcaccggctactttggccgcagcactcaggccgccgtgaagctcttccagcagcgcgcgggtctgcgccccaccggcgtggccgacgtgaacacccagaagctgctctactcccccgacgcgccgaagtacgtcaagcccactatcatcggcacgcccgcgctgaccatcgactgctatgagaagaaggacggcgacgtctactgcctgaccgaccgctgctccgagaccggctatgtcaccttcggctggatggcggaaggcgacgtgaagaagtacaacgtcaccatcaccgacgacaccggcgcgaagcgtctggacgaggatacgcagttgaccctgacgggcgtttccatcgacgcgctgacgctgaaccgcacctacacgctcaccgtcacggcctatcccgaggacggcgacgaagcccacatcaccagcgcctccattcagttccggcgcatcgaaacccccgtggatcccgatcccatcggcacgatcaccgaggtctcggccagcgtcgagcccgtgacccgcacggaaaacaatgttctctatgtccgtgccggcgaaatcaccttccgctggtatgccatcggcgacgtggccagctacgccgtggagattcgcgactccaacaacaatctctgcctgagcgccaacaccaccgacgagcaggccgtcgttcagtccaacgtgatgaagcagggcgaggtctacacgctctacgtccacgccattcccaccaacggaacactggacaacgccgtgaccgccagctgtgccttcgcgctggaggatcagccgcagccgctgcccaccgtcgtcgctccgaccctcaccaccgatctgaccgcggaagccgacggcagctacgtcgtcgacgccaccgccgccttccagtggtcggccgtggagaatgccgagcagtactacatcgagatccgcgacgcgtccaacgccctgtgcggcagcgagacgaccaccgcgacgggctatgtcgtgaacgccgcttctctgagccgcggcgcgagctacacgctgtacgtcaccgcgattcccaccggcggcagcgtcgccgacggtgccaccgccaccgtggccttccgtgtccgcgaggatcagaccatcacccagctcgacgcgccggtgctgtccattcagggcttgcagcccgccgccgacggcatcgtttacgccgatgactccagcctcgtcgttcagtggacggcggtggatggcgcagccgcctacaacttcgtcgtccgcgacgcgaaccagatggtcgtcgccgaggcgaccgtcaccgatctgagtctcacctacaacgcttccgcgctggttcgcggcgcggtgtacaccctgtccgtgatcgccgtcccccaggacgaggcccatgctcagggcacgcccgccacgctcccgctgattctgaaggttcccgccaccgcggaggacgccatcgtcaccgagcccagtgagccgaccgtcgaagaacccgtggaagctcccaccgaagaacccatggagcagccgacggaggcacccgcaaaacccaccgaggcccctgcggagcagcccaccgaagcgcctgtggaacagccgacggaagctcccgtcgagcagcccacggaagcgcccgtcgtttccgctccgacgctgggcattgagaccatcgtcgagaccgtcgacgatgtggcgtatgtgaacggcggcgtgatccatctgacgtggagcactgacaccgcagactgcgcctatcagctcagcatctacgacgcggacggcaatctctgcgcccagaccagcacgaccgatacctcggtcaacctcgacggcagcaagctcgccgacggcatgatctacaccttcgaggtcgtcgcctacgccaacggcagcgacgtctccaccggcacggctgcggccctccgcttcgcgaagtacacggttgcgcccaccgaagcgcctgtggagcagcccactgaagctcccgcggaagagcccgttgttgaggaaccgaccgaagcccctgcggagcagcccgtcgaagatcccgcagagcagcccaccgaagcgcctgtcgaacagccgacggaggctcccgcggagcagcccaccgaagcgcccatcgtatccgctccgacgctgagcattgaaaccatcgtcgagaccgtcgacgatgtggcctacgtggacggcggcgcgatctgcctgagctggagcaccgacactccgggctgtgcctatcaggtcagcatctacgacgcggacggcaatctctgcgcccagaccaacacgaccgacacatcgatcaacctcgacggcagcaagctcgccgacggcatgatctacaccttcgaagtcgtcgcctacgccaacggcagcgacgtctctaccggcacggctgcggccctccgcttcgcgaagtacgcggttgcgcccaccgaagcgcctgtggaagagccgacggaagctcccgcggaagagcccgttgttgaggaaccgaccgaagcccctgcggagcagcccgtagagcagcctaccgaggctccggcggaagaacccgttgaagagccgacggaagctcccgtcgccccgaccgagattctgcccatcgacggcacgatgcccgaccgcatcgccgaaatgcagcagcgactggtcgatctcggctggctcctgcccgacgcttacacgcagggcatgctggacgaggtgacggtacaggccgtgacggacttccagaactactgcatctccgtgcttgcgcagccgctgattcccatggatcaggccaacgtcgaccatcccgacaacccgatcgtggatgcggacacgctgaagctgctgatggacgttcagaacgacatcatcaagcccgcggaataa

SEQ ID NO: 1348 - DNA, 3177 bp, Unknown
  Artificiall/Consensus sequence
atgtccaagagaacggatctgaagaaaatcatgattatcggctccggccccatcgtcatcggtcaggcggccgagttcgactacgccggcactcaggcctgcctcgcgctgaaggaggagggctacgaggtcgttctggtgaactccaatcccgcgaccatcatgaccgacaccaccatcgccgacaaggtgtacatggagccgctgacgctggaatacgtggcgcgcatcctgcgctatgagcgtcccgacgccatcatcccgggcatcggcggtcagacgggcctgaatctggccatgcagctggagaagaagggcgtgctgaaggagtgccaggtcgagctgctgggcaccaacagccgctccatcgagcgcgccgaggaccgcgagctgttcaaggagctgtgccaggaaatcggcgagccggtcattccctcccgcatcacctattccatcgacgaagcccgtcaggcggccggggaaatcggctatcccgtggtgctgcggcccgcgttcacgctgggcggcaccggcggcggcttcgcttacaacgaggaagagctcgtcgagaccgcgaccaacgccttccgtctctctccggtgcatcaggtgctcattgagaagagcgtcaaaggctacaaggagatcgagttcgaggtcatgcgcgacggcgacgaccacgccatcaccatctgcggcatggaaaacgtggatcccgtgggcgtgcacaccggcgactccatcgtcgtcgcgcccatcatgaccctcagcgaccacgacctgaagatgctcaacgacagcgccatcaagatcatccgcgcgctgaagatcgagggcggctgcaatgtgcagttcgcgctgaatccccattcctccgagtacttcctcatcgaggtcaacccccgcgtgtcccgctcctccgccctcgccagcaaggccagcggctatcccatcgcccgcgtgacggcgaagatcgccgtgggcatgaatctggaggacatccagatcgccaacaccaccgccgccttcgagccgagcctcgactacgtggtggccaagctgccccgcttccccttcgacaagttcacgtcggccagcaaccgtctgggcacccagatgaaggccaccggcgaggtcatgggcatcggcagcaatcttgaggagtgcctgctgaaggccgtgcgctcgctggagatcggcgttaaccacatttacatgcccaagttcgacggcaaatccgccgaggagctgctgagctacgtctccgaattccgcgacgataacctctacgccatcgcgcagctgctgcgtctgggcgtttccgtggatcgcatctacgaggccaccgagatcacgcccttcttcctcgagtccttcaagaagatcgtggactttgagcgcgtcgtgtccgagcatcccatggacgcgcagaccctgcgccaggcgaaggagctgggcttctccgatccctgcatcgcccggctgtggaacgtggacgagcgcgcagtctggaatctgcgcatggagcgcggcgtgatgcccgtctaccgcatggtggacacctgccacaccggcgcgtacatcccctatttctactccagctactttggagagaaccagtccgtcgtcaccgaccacaagaagatggtggtgctgggcgcgggcccgatccgcatcggtcagggcgtggaattcgactactccaccgtgcatgccgtgtccaccatccgtcaggccggctacgaggccatcatcatcaacaacaaccccgagacggtctccaccgactacaccacctcggacaagctgtacttcgagccgctgacccccgaggacgtgaacaacatcctcgtctacgagggcgcgaacgaggtcatcgcctccctcggcggccagacggcggtcaacctcgccgctccgctggaggatcgcggcgtgaagatcgtcggcgcggacgtgcaggccatcgaaaacgccgaaaaccgcgacgcgttcgagcacattctccataagctgaacattccccagtccgccggccgcgccgtcaccagcatcgaggagggcgttcgcgccgccgaagaggtgggctatcccgtgctggtgcgccccagcttcgtgctgggcggccgcgccatgcagatcgtcgccgccgaggcgcagctgcgccagtatctgaaggccgccttcgacgtggacgcggagaagcccgtgctggtcgaccactacatcctcggcaaggaggtagaggtggacgccatctgcgacggccgcaacgtgttcgtgcccggcattatggagctggtggagcgcaccggcgtgcacagcggcgactccatcagcgtctatccgcccttcagcatctccgaccgcgtgaagggaatcatcctgggctacaccaagaagctggggctggggctgggcatcgtgggtctgtacaacatccagttcatcgtggacaaggccgataacgtgtacgtcatcgaggtcaatccccgctcgtcgcgcaccgtgccgttcctgtccaaggccacgggctacagtctcgcggacatcgccacccgcgccatcctcggcatctcgctgaaggagcagggcatcttcgacctctatcccgacgagaagcagcgctggtacgtcaaggttccggtgttctcgctggccaagatccgcggtctggacgcgtatctgtcccctgagatgaagtccaccggcgaggccatcggctacgacgcgcgcctgaaccgcgcgctgtacaaggcgcttcaggcctcgggcatgcagcttcagaattacggcactgtgctggccaccgtggccgacaaggacaaggaggaagcgctgccgctgatccgccggttctacaacctgggcttcaacatcgaggccacgccgggcacggcccagttcctgcgcgagaacggcattcgcacccgcgtgcgccgcaagctcagcgtggacgcggacgacatcccctccgcgctgcgtcagggccacatcgcctacgtcatcaacacccacgacgtgggctccatggggcaggcgcgggacggcttcatgatccgccgcctgtcggtggagaacaacgtcaccatgttcaccgcgctggacaccgtgcgagtgctgctggacgtgctggaagagatgaccctgccggtttccaccatcgacggagagtga

SEQ ID NO: 1349 - DNA, 3486 bp, Unknown
  Artificiall/Consensus sequence
atgttttcgcatctgcatctgcacaccgaatacagtctgctggacggcgcgtgccgcatcaagccgctgatgcagcggctcaaggcgctgggcatgcgctcctgcgcgatcaccgaccacggcgtgatgtacggcgtggtggacttttatcgcgccgcaaaggaggcgggcattcacccggtgatcggctgcgaggtgtacgtctgccccgacatggacaacaagaccagcgtcacccgggattacagccatctgattctgctgtgcgagaatcagacgggctataaaaacctgtcccggctggtcagcgagggcttcattcggggctattactatcgcccgcgggtggactacgcgctgctggagaagtaccacgaggggctcatcgccctgtcggcgtgcctgtcgggcgatctgcccaagctgctgctggacggccgcgaggacgaggcgcggaagatggctcagcgctatctggacatcttcggccggggcaatttcttcgtggagatgcaggatcacggcatcccggagcagaagcaggtgctgccgcggctggtgcggctggcgcgctccatggacatcccgctggtggtcaccaacgactgccactatctggagcgggaggacgcgcaggcgcaggagatcctgatgtgcatccagacgggcaagacgctcaccgacgaaaaccgcatgcgcatgagcaccgatcagctctacgtcaagtccgaggacgagatgcgcgcggcgtttcccaattttgccgacgccatcgagcgcaccgaggagatcgcgcagcgttgtcaggtggagttcgacttttccaagacctatctgcccgcgtttccgctgcccgagggcgagacgaacgtgggctatctgcgcaggctcgccgaggaggggctggcccggcgctacgcccccgaccggacggacgcgaaggagcgcatggagtacgagctgggcgtgattatctccatgggctacacggattacttcctgatcgtctgggacttcatccactacgccaagacccacggcgtgggcgtgggcccgggccgcggcagcggcgcgggctccatcgtggcctacgcgctgggcatcaccgagatcgacccgctgaaatacgcgctggtgttcgagcgattcctgaaccccgagcgcatctccatgccggatatcgactgcgacttcgactacgagcgccgcggtcaggtgatcgactacgtgcgctcccgctacggcgaggatcacgtggcgcagatcatcaccttcggcaccatggccgcgagggcggtcatccgcgatgtgggccgcgtcatgggcctgagctatcctcagaccgacgccatcgccaagatgattcccttcgagctgaacgtcactctggagcgggccctgtccgtcagcgccgagctgcgaaacgcctatgagggcgacgagcaggtgcggcggctcatcgacatggcgcgcaagctggagggcatgccgcgcaacgcgtccacccacgcggcgggcgtgctgatcaccgccgacccggtggtggaatactgcccgctgcagaccaacgacgacgtgatcaccacgcagttccccatgaccactgtggaggcgctgggccttctgaagatggactttctggggctgcgcacgctgaacgtcatcatggacaccatcgagatggtgcgcgccggcggcggcacggtctgcgacagcgacgacatccccatggacgacgacggcgtgtataagatgatctccgacggcgagaccgacggcgtgttccagctggaatccacgggcatgcgcaatttcctgatgcagatgaagcccggcagcttcgaggacgtggtcgccgccatttcgctgtatcgccccggcccgatggagtccattccgcgctacatcgcgggcaagcaggatccctcgtcggtgaagtacctcacgcccaagctcaagcccattctggacgtgacctacggctgcatggtctatcaggagcaggtcatgcagatcgtgcgcgatctggcgggctattccatgggccgaagcgatctggtgcgccgcgccatggccaagaagaagcacgacgtgatggcgcgagagaaggaaatcttcatccatggacaggtggagaacggcgaggtgatcgtgcccggctgcgtgcgcaacggcgtttccgaggagatcgccgagcgtatcttcgacgagatgaccgccttcgccagctacgccttcaacaaatcccacgccgcggcctacgccgtggtggccgtgcagacgggctatctgaagctgcactatcccgtggagttcatggcggcgctgatgaattccatcatgggcaacgcgggcaagatcgcctattacattcagtactgccgcaagaacggcatttccgtgctgccgccggacgtgaaccgctcggaggagaagttcgccgtggacgtgcaggacgggaagaagggcctgcgcttcggcatgggcgccatcaagagcctgggccgcgcgccggtggcggcgctggtgagcgagcgccgggcgggtgggccgttcagggatctctacgacctgatcgaccgcatgtcggggtcattgctcaacaagaagtgcgtcgaggcgctgattcgctccggcgcgatggattcgctgcccggcgggcgggcgcagaagctgcacgtgttcgagcgcgccatggacggcgcggcgcggcaggccaagggcgcggtggagggtcagatctcgctgctgggcatgctgggcgacgacgttccgccgtcgccgatgcccgcgatgaaggaattctccatggccgaccggctgcagatggagaaggagaccacaggcgtgtacatctcgggtcacccgctggacgaatataccgaggagctgtcccggctggcggtcagctcgcggctgctggaggagctgtccgagagcgaccccgaggcgctgatgcgctacgatcagcgcagcgtggccatgggcggcctcatcgccgaaaagcgcatgaaggccaccaagaatggaagcatgatggccttcgtgcagctggaggatctctacggcgtgaccgaggtgctggtgttccccaagacctacgagcgggtgagcgccatgctcgtgcccgagacggcggtgctgatgcagggccggctgagcgtgcgcgaggacgaagcgcccaagctgcttctggagagcgtgcagccgctgaagggggcaaagcccgcgccggagcgcgcgccgcgccgggagcgcggaagcgcgcccccgggcccgcgcaggctgtatctgaagctcaccgccgctcagcgcgacaatgtgcttcagattctccggcagacccccggcggcatctgcgtgatgctgtatatggccgacgagaagaagacctatcaggctccgcgggaatactgggtggacgagggctacgacttcggcgcgctggccaatctgatcggcgcggattccatcgtactaaaataa

SEQ ID NO: 1350 - DNA, 3855 bp, Unknown
  Artificiall/Consensus sequence
atgccgctgaatccgaagatcaaaaaggtgctgatgatcggctccggccccatcgtcatcggccaggccgccgagttcgactacgccggcgcgcaggcctgccgcgtgctgaaggaagcgggcgtgaacgtggtgctggtcaattccaaccccgcgaccatcatgaccgacagcgcgctggcagacgaaatctacctggagccgctgaccgtgcccacgctcaggcgaatcatcgaccacgaaaagcccgacagcatgctggcgggtctgggcgggcaaacgggcctgacgctggccatgcagctttccaaggagggcttcctcgaaagccgcggcgtagagctgatcggcgtgaacgtggacgccatcgacaaggcggaggatcgccagctgttcaaggacgcgatggccgaaatcggtgagccgaccattccctcgggcatcgccaacgacgtctctcaggcgctggccgtggcggagaagatcggctatcccgtcatcgtgcgcccggccttcactctgggcggcgcgggcggcggcgcggcggccagcgccgaggagctgagccagatcgcccgcacgggtctggacatgtcgcccatcacccaggtgctcatcgagcgttccgtggcgggctggaaggaaatcgagttcgaggtcatgcgcgattccgcgggcaacgccatcgccgtgtgctccatggagaacttcgacccagtgggcgtgcacaccggcgactccatcgtcgtcgccccggcgctgaccctctcggacaaggaatatcagatgctgcgcagcgcggcgctgaacatcatctcggcgctgggcatcgtgggcggctgcaactgccagttcgcgctgaatcccgacagcttcgaatacgccgtcatcgaggtcaacccccgcgtgtcccgctcgtcggcgctggccagcaaggccaccggctatcccatcgccaaggtcaccaccaagatcgcgctgggctacacgctggacgagatcaaaaacgaggtcacgggcaagacctacgcctgctttgagccgacgctggactacgtggtggtcaaattccccaagtggcccttcgacaagtttgcgggcgcgagccgcacgctgggcactcagatgaaggccaccggcgaggtcatgtccatcgccaacagcttcgaaatggcgctgatgaaggccgtgcgcggcgcggagatcaagctggacacgctcaaccgcacggacgacagcggcgtagacatcgaagagcggctccaccgggtggacgaccatcggctgttcaccgtgttcgaggcgctcaagcgcggcatttccgtggagcacatccacgagatcacgaagatcgaccgctggttcctgagcaagctccagaagctggcggattacgaggcgagcattgcccatggcctgacggacgcgcagtatctcgccggcaaaaagctcggctacaccgacgcggcgctgaagcggctctccggcgcgaagacgctgcccgaggtgcagtccgcgttcaagatggtggacacctgcggcgcggaatttgacgcggagacgccctacttctactccaccttcgacgcggagtgcgagtcccgcgcgttcccccgctcgggcaagccggtcatcatcgtgctcggctccggccccatccgcatcggccagggcatcgagttcgactattcctccgtccactgcgtctggacgctcaaaaagcttggctacgacgtggtcatcatcaacaacaaccccgagaccgtctccaccgactacgacaccgccgaccggctctacttcgagccgctgaccgacgaggacgtgctgcgcatcatcgacgtggagaagcccgtgggcgtggtggtggccttcggcggtcagacggccattcgcctgacccagacgctggaccgcgcgggcattcccattctgggcacctccgccgagggcatcgacatcgcagaggaccgcgagcgcttcgacgagctgctggagaaattctccatccgccgccccaagggcgcgggcgtgcgcacgctggaggaggcgctctccgccgccgagacgctgggctatccggtgctgctgcgccccagctacgtcatcggcggtcagaacatgaccatcgctcatcagccctacgacgtgaagcgctacatggcgcgcattctggccggcggcatcgacaacccggtgctggtggacaagtacatgcccggcgtggagctggaggtggacgtgatctccgacggcacggacgtgctgattcccggcgtaatggagcacattgagcgcgcgggcgtgcactccggcgactccatcgccgtctatccgccctacaacatcaacgaccgcatgctgaagattatcgtcgaaagctccaccagactggcgctggcgctgggcacgaagggtctggtgaacatccagtacctgatctacggcggcgagctgtacgtcatcgaggtcaacccccgcgcgtcccgaaccattccctacatcagcaaggtcacgggcgtgcccatggtggatctggcctcccgggtcatgattggccagaagctgaaggatctgggctacggcaccggcctttacaagacgccgccctactgcgcggtgaaggttcccgtcttctccttcgagaagctcaccgacgcgaacagctacctcagcccggagatgaagtccaccggcgaggtactgggcatcggcaaggacatggccgaggcgctgttcaagggactggtcagctcgggcatccgcctgccccatcccggcgaggagacgggcgtgctgctgagcgtggacgaatacgactacttcgaggtgctcgctctggcccggaagttcagcgacctgggctgccggctgtacgccacgtcgggcacggcggcggccatttccacgctgggcattcccgtgcagacggtggaggacattcacgagatgagcgccaccgccgccctgctggagagcggcgcgatccactacatcgtctacaccggcgcgctgctggactccacgctggacgactacatcgcgctgcaccgcaaggcgctgctgctgaacatcgcgtgcctgacctcgctggacacggccaacgcgctggccgacatcatcgccagccgctacaaccagatgaacaccgagctggtggacattaaccacatgcgccgggagcgcggccggctgcgctttgccaagatgcagtccaccggcaacgactacatcgtcatcgacaaccgctccggcgcgctggtctatcccgagtccctgtgcgtcaggctctgccgcccccactacggcgtgggcgcggacggcatcgcgctcatcgagcgctcggacgcggccgacgcgaagatgaccatgttcaacagcgatggctccgagggccgcatggccggcaactgcatccgctgcgtggcgaagtacctctatgacaatggcgtcgttcagagcgacagcctgaccatcgaaaccgccagcggcgtgaaggctctgaaggtttacacacgcaacggtcgtgtctcctccgtgtccgtggacatgggcgttccggatctgcgcaccgccagcctgccctgcacgctgcccgtggagcgcgccgtgcgctatcccgcgcgcatcggcggaaggctgtacaacatcacctgcatgtcgctgggcaatccccactgcgtggtgttcaccgacaaggtggacaccctcgacctgagcgagatcggcccgcggtttgaaaacgcgcccgtgttccccgaacgcgtgaataccgagttcgtccgcgtggtcaaccgcacgacgctgcgcatgcgctgctacgagcgcggcagcggcgagaccatggcctgcggc

SEQ ID NO: 1351 - DNA, 3819 bp, Unknown
  Artificiall/Consensus sequence
atggagataggggtgattgaaggtatggttcatccggtgcaaatgggcaaacgcacgcgaatgagttttgcccgcattgaggaagcactggcagtacccgatctgattgaagttcagaagaattcctataagagctttctgaaggaaggccttcgcgaggtgctggcggacgtttcgcccatcaccgactacagcgagagcctgatcctcgagttcacggattattcgctggacgagaagccgaaatacacgatcgagaagtgcaaggagcgcgacacgacctacgccgcgccgctgaaggtgacggtgcgtctgaccaaccgcgacacccatgagatcaaggaatccgaggtgttcatgggagacttcccgctgatgaccgagcacggcacgttcatcatcaacggcgcggagcgcgtcatcgtctctcagctggttcgttcgccgggcgtctactattccaaggccatcgacaagaccggcatggcgctgtattcctcccagatgatccccaaccgcggcgcgtggatcgagtacgagaccgactccaacggcatcgtgttcgcccgcatcgaccgcgcccgcaagctgccggtgacggtgctgctgcgcgccatgggcatcgagacggacgaggagatcatccgcctgttcggcgatgacgagcgcgtttccgcgaccatcacccgcgacgcgccctccgtcaacgacaagggcgagaaccgctacaagtcccgccgcgatcaggcgctgatcgagatctacaacaagctgcgtccgggcgagccgccgtcggtggaatccgccacgagcctcatcaactcgctgttcttcgaccccaagcgctacgatctggcgcacgtgggccgctataagtacaacaagaagctggcgctggcgctgcgcatcttcaaccaggtgccggtgcaggacgtggtgcatccctacacgggcgagattctggctcccaagggccagcccatctcccgcgagcaggccgaggccatccagaacgccggcgtgaacgaagtggtcgtcgagatggacggaaccgagttccgcgtcatcggcaataacttcgccttcttcaagcccttcatggagggctacgacgccgagctgctggcgcagtatgacgagagcgtggtttccttccacgagcgcgtgcatattccgacgctggtggcgctgctggagcgtgtccgcgaggacggcgtgccgctgaatcaggcgctgaaggagtccgcgcggacgctggtgcccaagcacgtgctggtggacgacatcgtggcctccgtttcctatcagtttggcctgttccacggcctcggcgagtgcgacgacatcgaccatctgggcaaccgccgcctgcgcagcgtgggcgagctgctccagaaccagatccgcgtgggcatgtcccgcctggagcgcgtggtcaaggagcgcatggccattcaggacgcggacaaggttcgcccgcaggatctgatcaacatccgcccggtctccgcggccatcaaggagttctttggttcctcccagctgtctcagttcatggatcagcccaacccgctggccgagctgacccacaagcgccgtctgtccgctctgggccccggcggtctgaaccgcgagcgcgcgtccttcgccgtccgcgacgttcactactcgcattattcccgaatctgcccgattgaaacgcctgaaggcccgaacatcggtctgatcggttcgctggcgacctacgcccgcatcaacgagtacggcttcatcgaagcgccgtatcgctacgtcgacaaggagatcggctgcgtcaccgacaagatcgtgtacatgaccgccgatgaggaggacaagtacaccatcgcgcaggccaccgagccgctggacgagaacaagcgcttcgtccacgagcgcgtcaccgtccgccgccgcgaggagaccatcgaggtcgaggccggcaaggtcgactacatggacgtctcgccgcgccagctgatttccgtcgccaccggcatgattccgttcctggagaacgacgacgcaaaccgcgcgctgatgggctccaacatgcagcgtcaggccgttccgctgctccgccccgaagcgcccttcgtcggcacgggcatcgagtacaaggcggcctgcgactccggcgtggtgcttctggcccgcgagagcggcgtggtcacccgcgtgaccgccgacgagatcgtcatccgcgacgagaacaacgtcgaccacatgtaccatctgcagaagttcgcccgctccaaccagggcacctgcatcaaccagcatcccatcgtgtccgagggcgaggtcgtgcgcgcgcgccagcccatcgcggacggcccgtccaccgacgagggcgagatttcgctgggccgcaacgcgctgatcggcttcatgacatgggaaggctacaactacgaggacgcggttctgctgtccgagcgcctggtcaaggaggacatgtacacctccattcacatcgaggagtacgagtccgaggcccgcgacaccaagctggggccggaggagatcacccgcgacatccccggcgtgggcgaggacgcgctgcgcgatctggacgagcacggcatcatccgcatcggcgcggaggttcgcgccaacgacattctggtgggcaaggtcacgcccaagggcgaaaccgagctgacggccgaggagcgcctgctgcgcgctatcttcggcgataaggcgcgcgaggttcgcgacacgtcgctgcgcgtgccccacggcgaattcggcatcatcgtggacgtgaagatcttcacccgagagaaccgcgacgagctgtctccgggcgtgaatcagatggttcgcgtctacatcgcccagaagagaaaaattcaggtgggcgacaagatggccggccgccacggcaacaagggcgttgtgtcccgcgtgctgcccgaggaggacatgcccttcctggccgacggcacgccgctggacatcgtgctgaatcctctgggcgttccgtcccgaatgaacatcggtcaggtgctggaagtgcatctgggcctcgcggccaaggcgctgggctggcacgtcgccacgccctgcttcgacggcgcgcgcgacgaggacatccgcgagatgctggaaatggccgccaagaaagaggacggcccgctctacgacgagaacggcaagccgctgattcagttcaacaagatcggcatcaatcccaccggcaagctgtggctgtacgacggacgcaccggcgaccgcttcgacaaccccgtcaccgtgggctatatgtactatctgaagctgcaccatctggtcgacgataagatccacgcccgttccaccggcccgtacagcctcgtcactcagcagcctctgggcggcaaggcccagttcggcggccagcgcttcggcgagatggaggtctgggcgctggaggcctacggcgcgagccacgtgctgcaggagatcctgacggtcaagtcggacgataccatcggccgcgtcaagacctacgaggccattgtcaagggcgaaaacatccccgatccgggcgtgccggaatcgttcaaggttctgattaaggagctgcagtcgctggcgctggacatcaaggtgctggacgagaacgaggaagaaatcgaaatccgcgagctggacgacgacgcctacgccaacgacagcgaattcaaggacgagctggttcccaccatcacgcccgaggcgctggcggacgaggaggaggtcgcggccgaggacttcgacttcgacgatctcgagctgggcgacgacgacctgatgctggacgacgatttctga

SEQ ID NO: 1352 - DNA, 2262 bp, Unknown
  Artificiall/Consensus sequence
atgaacagcatgcccagtcagcttcaggaaatcgcgctccgcattcgggaaatgcgggaaatcatggggttcaccgtcgaagagatggccgaaaagaccgagctggatcgcgagacctatctgcgctatgagagcggcgaagcggatctcccctttacgtttatccacaagtgcgcgctggcgttcggcatcgagatcactgatctgctggagggccagagcgcccatctttccagctacgccgtcacccgcaggggcaagggcgtgaccaccgcgcgggagaagggcatccagattcagaacctcgcgccgctgttccgccagaagctggccgagccctactgggttcgctatgattactcccccgagcagcagcatcaccccatccatctgaccacccactccggacaggagttcgacctgatcatcagcggccgcctgaaggttcaggtgggcgaccacgtggaggtgctcaacgagggcgacagcatcttctacaattcctccacgccccacggcatgatcgccgtggacggtcaggagtgcctgttcctcgccgtggttctgccgggcgagccggcggccgagcaggaaatccgcgacaccctcgtctccgccagccagtccgagccgctgctcgtcgagaagttcatccacacccagaccgacgaaaacggcctgctgaagaagatcgacttcaccgacgaggacaagttcaacttcgcctttgacatcgtggacgcggtggccgaccgctatcccgatcagctggccatgctgcatctgagccgcgaaaaggtcgagcgccgcttcaccttccgcgacatgaagcttttgtccgctcaggccgccaactacttcacctctctgggcatccgccgcggcgaccgcgtgatgctggtgctcaagcgccactggcagttctggccggccattctaggccttcacaagctgggcgccgtcgccattcccgctacgaaccagctgcaggctcacgactttgagtatcgcttcaacgccgcctccgtgtccgccgtgctctgcaccgccgacggcgagaccgccgcgcaggtggatgcggtggagagcgcctgcccgtccctgcgcgtgaaggtgctcgtgggcggcgcgcgcgagggctggcacaactacgacgcggagagcccgctgttcacccgcaagtacgtccgcaccgaggacgcgccctgcggcgacgacaccatgctgatgttcttcacctccggcaccacgggctatccgaagatcgccatgcacagctacaagtacccgctgggccactacatcaccgcccgctactggcataccgcccatcgcgacggcctgcacttcactatctccgacaccggctggggcaaggcgctctggggtaagctctatggacaatggatgtgcgagggcggcgtgttcacctacgacttcgaccgcttcgacgcggcggatatcctgcccatgttcgccaagtatcacatcaccacgttctgcgcgccgccgaccatgtaccgcatgatgatcaagcaggatctgacgaagtacgacttcagctccgtggagcgcgccaccaccgccggcgaggccatgaaccccgaggtgttccgccagttcgaggcgctgacgggtctgcggctgatggagggcttcggccagactgagaccacgctgtccatcgccaatctggtgggcgacgcgcacaaggtcggcgcgatgggtaagcccgtgccgctgtatcacatcgagctgctggacgccgagggcaagcccgtgggcaccggcatgaccggcgaaatctgcatcaagaccagcgacaaggttccctgcggcctgttccagggttatctgaacaaccccgaaaagaccgccgaggtctggcacgacggctggtatcacaccggcgacgtggcctggaaggatgaggacggcttcttctggtatgtcggacgcgtggatgacgtgatcaagtcctccggctaccgcatcgggcccttcgaggtggagagcgtcatcatggagctgccctacgtgctcgaatgcggcgtttccgccgtgcccgacgagacccgcggtcaggtggtcaaggccagcatcgtgctgaccaagggcaccgaacccaccgaggcgctgaagaaggagattcagacctacgtcaaggagcacaccgcgccctacaaatacccccgcgtggtcgtcttcaaggagagtctgcccaagacgatcagcggcaagatccagcgcaatctgctgtaa

SEQ ID NO: 1353 - DNA, 2706 bp, Unknown
  Artificiall/Consensus sequence
atgagacattattgcgtcatttcccatacgcattgggatcgtgaatggtatcagacgcaggagcagatgcgcctgcgcctggtggatctgatggacaatctgctggacatcctcgaccgcgagccggaatacgtgtttcatctggacgcgcagaccatcatgctggaggattactgggacgtccgcccggaaatgaaggaaaagtgctgcgactacatccgcaccggccgcatgctcgtgggcccgtggtatgtgcagaacgacttcctgctcaccagcggcgaggccaccgtgcgcaatctgcacatcggcatggcgcaggcggagcggtacggccgctgcatgcgcgtgggctacgcgccggatcagttcggcctgatctcccagcttccgcagattttgaacggcttcgggctggacgcctgcgtgttcggccgcggccacaacatcttctgcgtggacgatcagggccgtctggtccagcgcatgccaccggcggagttccgctggcagagccccgacggctccgaggtcttcgccgtctgcatgagcttctggtacaacaacacccagcgcttctccgcgaatatcgacaaggccatggagctgctgcgctggcaggaggagcatttcaagggaatcgcgcagacggatttcctgctgctgatgaacggctgcgaccacatcgagcctcagaacgacctgatggacgtgctgaagaagatgcaggcgcgcctgcccgagggcagcgaaatccatcaggacacgcttgagagctacctctccgccgtgcgcggggagctgaaggagaccagcctcggcctgcacgtgggcgagatgcttcagggcgtgaacgacaacaccctcaaggacaccaattcctcgcgaatctatctgaaaatccgcaacgcggagcttcagaatctgctggaaaaccagcttgagccgctgtacgcggtgctggagatggccggtctgcgcggctgcttccccaaggggcatctgaatttcctgtggcgcatgctcatccggaaccacgcccacgactccatctgcggatgcagcaaggatgcggtgcatcgccacatggaggatcgcttcgaccgcatcgccgagttgggatacggcctgctggagcggggcatggagctgctggccgcccacgtgcgccgcgacggcatggacatggacgactacatgatctgcgtggccaatccgctgtcccgcccgcgcaccgagtgcgtagacgtggcgctggacgtgctctgcgccgaccatcccaggggcgtacgcgttttcgacgccgagggcaatgaggttcccttcgtgctgctgggccgggagacgctcagcaagcgcgtgatctcgccgctgaacctgccgggcttcatcgaggtggagcgcttccatctgcgcctgacggccaaggacgttccagcctgcggcgcgctgacctggcgcgtgaccaccgaggccatgtccgagcggatgacgcagccggagaacggctcggccgtgctggagaaccgcttcctgcgcgccgaggtggacgcacagggacggctgacgctgaccaataaggagacggggcgcgcctggcgcgacgcgctggcgctggaggacagcgccgacacgggccattcctacgtctcgctgcccctcgaaggcgacaaacccatccgcatgggcgcgccgctgcgcatggaggcgcggaaggacgcgatgcgccagagcctgaccatggacttcgccttccgcctgccccggtcgctgacggaggatcgctccgcccgcagcgcggagacggtggactgcccggtgcgtctgacgctttcgctggacgcggacagccgcgcgctggacgtggagatgcagatcgataataaggccagggatcatcgcctgcgcgccgtggtgcgcacggggctggattccgatttcacccaggcgctgtcgcccttcgacgtggtgacccacgacaagcgggagatcgacacgcgcatctgcaacgagacgcggcacaattcgggcttcgtgtccatcgccgacggagagaaccgcatgacggtggagaacgcgggcgtttacggctacgagaacctccagagcgagcgcggcacgctggcgctgaccgttctgcgcgccaccgggcgcgtctggccggaggaggccgcgggcgcgcccgaggacgacgcgtggctcgcgccggagaaccagtgcctgcgcatcgtgcgcatccatctcgccctgcgccccggccgcgcggacgaacccctcgacgcgctgaccttcgcgtccctggccttccagaacccgctgctggtcggcggctatgccgtggacgggcgcaagttcctcggcggccgcccggcgcttcaggacgcgaacatcgccgagttcttctatcccgccgaccgctatcccgaggcaaagctgccgcgccgcttcggcatgctgacgctggagggcggcgcgcaggtcacggcctgcaagctggccatggacggcgacgcggtgatcctgcgcatgttcaaccccgccgacagcgccgcgcagatgcgtctgcgcgcgtccttcccgacccgcgcgattcagaccgaccttcgcgaactggctgatctcggcgaactggcgcggcaggacggagcgtttgatttcgagcttgcgccgaagcgcatcgccacgctgcgtctggagcgggagtaa

SEQ ID NO: 1354 - DNA, 2280 bp, Unknown
  Artificiall/Consensus sequence
atgaagaagctgatttcactgctgctctgcatggtgctgctggccgccgttccggcgctggcggcgcagggcgatctgatcatcacccggtccgacgacggacagggcgttctgggcgagggcatccgcagttcctgcggcatgggcgattcgctgtacatgattctggaggatggcaagacgctggtggcgcagaaggcgggcgagtcggagccgaagtcctatgcgattcagatcggcccggatacggagaaccccatgaacggctacaccaactatctgctgctcaacggcggcgacgcgctgctggcgctgcgcatggactacgactacagcggcgataccaccgccatgcagagcgccatgtacaagatcaccttcgacggcgaatcggcctcggccgaggagctgtatcccatcgactggagcacagtgatggacaaccccggcgacgtctatctggacacttacgcctccaccggcgcgtggatggtgctgcgcacctacggcgacaacggaacgtctctcttcaggcgcatgaatctggccgacggcacggcgcaggactgcgcgctgggcgatttgcagagcaccgtgctgagcgtcacgtcctacaccgagggccgcgtgctgatcaccgcctacaccgacgagcagcgcaaccgcatcgccttcatcgcctacgatcccgccgcggacgcggcgcagacgctgtgcgaggccgacgtggagcagtatgtcagctatgcgggcattgccaccgacatggacagcggcaagacctatttcacccgcgcgggcgaaatcttcgagattgatcccgccacgggaaccgtgggcgagagcgtgagcgacatgccgctggactacaccgattctcccgcgtccatcctcaccggcggcttctacgcctgctcccagtacagcacctacgtgctgcgcaatgtcaacgcggcgggggagcgcggaacgcggctgaaggtgtacgacaactcctatgccgacaccgtgaccgacgcgttctatcagttctccaacgaacacggcgaggtttccgccgtgctctcccgggaatacaacgacgcgagctccctcgtggacgacatgatgaaccgctccgccgacgtggacgtttacattatgcagacttccacctcggcctttgaggcggtgcgcactcgcggctacatcgccgatgtcggcggcagcgagaccattgaccagctgagcggccgcctgtacgacgccattcgcgagcagctcagcgtgaacggcaagctggccatgctgccggtggacgagaccttctggctgccctatgtcaacgccgcggcgctggaaaagctgggtctgaccgccgccgacgtgcccgccaactggtcggacatgctggacttcatcgcgaaccttgcggacaggctgcccgcggacggctcggtgcgtctgctggatccctacacgacggacaccggcgcgcgctggagcctgttctccatgatcttccagtgctatcagcagacgctgaacgcggatcccaacgccgtctccgcgcaggagatgaccgagattctgcgcaagctggagcagatcgacttcgcggcgctgggtcagcccaccgacgaggacgttcagcgcgacgactatacccccgattacaatgacaacgagtgcctccttcagctgaacatgggcatgtctctgcggggcatcacgaagaatcagctgccgctggtcatggcgctgacgccgaacacgccccgctatctgaacgtcgacggcacggtggcgttcatcaatcccttctccgagcatcaggatctggcgctggagttcatggagacgctggcgcagaacatggacgacgcgaagctggcgacctactgtcaggacgtgaccgagccagtggagaatcccaactacgaacagggcctcgcctccgcgaaggactgggtcgatcagtgcaaaaagcagctggaaaactgcgaggaggtcgaccgtcagagctacgaggagcagctggccaacgcgcagcagaatctggacagctacgaggcggataacttctactcgatttctcaggacgatctgaactggatccatgaaaacgcacagtacttcgtgtacagctgccccaactggctctacgacagcggcgacgacggcagcagcggcgacgcatacgatctggtgcagcagtatgtcgacggcaaaatcaccgcggacaagctgatgcaggaggtcgaccgcaaggtgcgcatgcgcatgatggagggctattga

SEQ ID NO: 1355 - DNA, 2025 bp, Unknown
  Artificiall/Consensus sequence
atgaaaagagcttcccgaaaaacgccttatcgaattctgacgctggatccgctgctgaagccctacgccgcggacgtggcgctgcgcatggagcgcaatgccgccgtccgcaagcagctgctgggcgacagcgccgcgctgtccgcgtttgccaacggatatctgtactacggctttcatcgcacacaggcgggctgggtctttcgcgagtgggcgcccggcgcggatgcgattcacctgatcggcgatttcaacgactggaaccgcgcgtctcatccccttcggcagctggacggcggcgtgtgggagatcgagctttccggcgcagacgcgctgaagcacggccagcacgtcaagctccagatcacccgcgggggccggagctttgaccgcattcccgcctacatccgctatacggtgcaggatcccctcacccatcagctcacgggcgtgatctgggcgccggaaaggcccttccaatggacggacggcggctatggccgcaagaagatctcgccgctgatgatctacgaggcccacatcggcatggcgcaggagcgcgagggcatcggcacctatcgcgagttcgccgatttcaatctggagcgcatcaaatcgctgggctacaacgccgttcagctgatggccgtcatggagcatccctactacgcctccttcggctatcaggtcagcagcttcttcgccgcgtcccactggtacggcgagccggacgacctgaaggccctcgtggacaaggcccacagtctgggcatgtacgtgctgctggacgtggtgcattcccatgcctgcgccaacgtgggcgaaggtctgaacctcttcgacggcacggaggatcagtatttcctgcccggcgagcgcggaaatcaccccgcatggggctccaagctgttcaactacgccaagcacgaggtcatccacttcctgctgtccaatctgaagttctggcaggaggaataccacttcgacggcttccgcttcgacggcgtgacctcgatgatctatcagaaccatggcctgggcgaaaacttcaccgactacagccagtacttcggcctgaacaccaatgtggacgcgctgacctatctgcagctggccaacgagctgattcacgaggtcaaccccttcgccgtgaccatcgctgaggatatgagcggcatgcccggcatggcgctgcccatccgcagcggcggcatcggcttcgactatcgcctgtccatgggcatccccgatttctggattcgcctgctcaaggacgtgcccgatcgccagtgggacatgggccggctctggtacgagctgaccacccggcgcccacaggagaagaacgtgggctactgtgagtcccacgatcaggcgctggtgggcgacaagacgctgatcttccgcatggccgacgcggagatgtacacgggcatggacaaggcctatcattcgctggccatcgaccgcgccatcgcgctgcacaagatgattcgctttatcaccctcgcgctgggcagcgaggcctatctgaacttcatgggcaacgaattcggccatcccgagtggatcgactttccccgcgagggcaacggctggagccatcactacgcacgccgccagtggtcgctggcggaaaacggctatctgaaatacgaatggctggagcgcttcgaccgggagatgctcaagttcgcgcgcaaatatcgcgtcatgaccaagcccgccgcggcgaacctctggatggacgaaaagaacaagctgctggccttcgccaagggcgatctgatctatctgttcaacttcagccccgacgcgtcgcccacggacttcttcgtgcccgcccacatcaccggcgaggggcagtatcgcgccgtgttcaccaccgaccgcatcgaattcggcggtcaggatcgcgtcagcgagcgctatgtctacaccgccaagcccgtcccggacaagggcgtgggctttacggtctatcttcccagccgcacggccatcgtgttcaggcgcgtggactaa

SEQ ID NO: 1356 - DNA, 1746 bp, Unknown
  Artificiall/Consensus sequence
atggttgaatcacgcccgtgcgtttctggcgtgatcgaaaatagatcatcgaaaaaaaggaggagtttgcctttggcaaaaaagaacaaagagccgaagctgaagatcatcccgctgggcggtctcggcgaaatcggcaagaatatgaccgtttatgagtatcagaacgacatcatcgtggtggacatcggctccatctttccgcgcgaggacatgccgggcgtggatctggtgattcccgacacgacctatctggagaagaatcaggatcgcctgcgcggatatttcatcacccatggccacgaggatcacatcggcgcggtgccctatgtgctgcgcaagattcccgcaccggtctacggcaccaagctgacgctggcgctgtgcgagaacaagctcaaggagcatcgcctgacgggcgtcgcgccgctgaacgtggtggaggcgggcgacgtgattaccgccggcgcgttcaaggtggagttcatccacgtcaaccattccatcgccggcgcgtgcgcgctggccatccacacgccggtgggcaccgtcgttcacaccggcgacttcaagattgacttcacgccccaggacggcacgccgctgaacttcggccgcttcgccgagctgggcaacaggggcgtgctggcgctgctggccgacagcaccaacgtggagcgtccgggctatacgatgagcgaaaagaaggtcgccgagacgttcaattcgctgttcgagcgcgccacgggccgcgtcatcatcgccatgttcgccagcaacgtctcgcgcattcagtcggtggtggattcgtccgtgcgcttcggccgcaaggtctgtctcgtgggccgcagcatggtcaacgtggcgaaggttgccatgcagctgggatacctgagcattcccgagggcaagctgatctcggcggacgagctggatcgctatcccgacaacgagatcaccgtgctgaccaccggcagtcagggcgagcccatgtcgggcctgtcccgcatggcctttgccgagcatcgcaagctggagattcgcgaaagcgacatggtcatcatctcggccacgcccattcccggcaacgaaaaatcggtctcacgggtcatcaaccagctgttccgcatcggcgcgaacgtgatttacgaatcgctggccgaggtgcacgtctccggccacgcccgtcaggaggagctgaagctgatgcactcgctggtgcgtccgaagtacttcattcccgtccatggcgagtatcgccatctgcaccatcacgccaatctggccaaggcgctgggcatgcccgaggacaacgtgctcatctgcgaaatcggcgacgtgatcgagatggatcgcagcacgctggacgtgaccggcgtggtgcccaacggctcggtgctcatcgacggtctgggcatcggcgacgtgggcgcggtggtgctgcgcgaccgcaagcacctgtccgaggacggtctgctgatcgtcgtcatgggcgtggatcacgagctgggaagcgtggtctccggcccggacatcatcagccgcggcttcgtctacatgcgcgaggcggacgagctggtggatggagcgcgggaggccgcgcgccgcgccatcgacgccttcggccccatcgactcctccgattggaaccacgtcaagagcgacgtgcgcgagtcggtgcagcgctacatctacgataccatcaagcgtaaccccatgattctgcccatcatcgtggaaatctga

SEQ ID NO: 1357 - DNA, 2085 bp, Unknown
  Artificiall/Consensus sequence
atgcgtttttccaaagcggtggtcaaatgccgcgtaccgattctcatcattgccattctgctgctgattcccgcgaccatcggcatggtcaccacgcgaatcaactacgacatgctcaactatctgcccgacgacatggacaccgtcatcggccagaacgagctgatggaggacttcggcaagggcgcgttctccatgctggtcattcaggacatgcccgaaaaggacgtggccgagctgaagaccaaactcgagcaggtcgaccacgtggactcggtggtctggtacagctccgtcgccgatctgtcggtgccgatgcagctgctgccggataagatctacaatgagttcaacaccgacgacgcgacgctgatggccgtgttcttcgacagcgccacctccgaggacgtgaccatggacgccatccgcgagatccgcgccatcgccggaaaacaggtgttcgtcagcggcatgtccgcgctggtcacggatctgaaggatctgtgcgaaaaggaggagcccatctacgtgggcatcgccgtggcgctggcgtgtctggcgatgatgattttcctggacggctggctggtgcccttcgtgttcctggccagcatcggaatcgccattctgatcaaccttggaaccaactggttcatgggcgagatttcctacatcaccaaggccctgtccgccgtgcttcagctggccgtcacgatggactactccatcttcctgtggcacagctacaacgagcagcgcgagaagacggacgaccgctgtcaggccatggcggcggccatccacgagacgctgaccagcgtggtgggcagctccatcaccaccgtggccggcttcatcgccctgtgcttcatgaccttcacgctgggccgcgatctgggcgtcgtcatggccaagggcgtggtgctgggcgtcatcagctgcgtcaccgtgctgcccagcatgattctgattctcgacaagcccctgcagaagaccaagcatcgctcgctgattccggacatgtccggcttcgcgaagggcgtggtcagggtcttcccgctgttcctggtgctgttcgtggcgctggttccgccggcctataacggctattccaagaccaacgacgaggtctactacgacatgggcgagtgcctgcccgaggacatcgagtacgtcatcgccaactccaggctgcgcgacgagttcgacatcgcgtcgacccacatgctgctgctggacgcggatacgccccgcaggaacgtgtataagatgatcgacgagatgaagcaggtggacggcgtgaagtacgtgctgggtctggaggcgttcgtcagcgaggacttccccgagacgatgattcccgagtccatcaccagcatcctgaagtccgaccgctgggagctgatgctcatcaactccgagtacaaggtcgccagcgacgcggtcaacgatcagatcgacgagctgaacgccatcctcaagaagtacgacgagggcggcatgctcatcggcgaagcgccctgcatgaaggacatgatcgagaccaccggccacgacttcgaggtcgtcaacgccgtgtccatcctcgccatcttcgccatcatcctgctggtggagaagagcctgagcctgccgttcatcctcatctccgtcatcgagctggccatctttatcaaccttggcctgccgcattacatgggccagtcgctgccgttcatcgcgccgatctgcatttccaccattcagctgggcgcgacggtggactacgccatactgatgaccacccgctacaagagcgagcgcgcggccggcaggacgaagcgcgaggcggttcagatcgcgctgagcacctccacgccgtccatcatcgtctccggcatgggcctcttcgccgcgaccttcggcgtggccgtctattccgatatcgacatcatcagctccatgtgcatgctgatggcccggggcgccatcatctccatgctgtgcgtgctgctgatcctgcccgcgctgctgatgctgtgcgacggcctgattcgccacacgacgctgggtatgaaagtcaaaaccgtcaaggaggagaactga

SEQ ID NO: 1358 - DNA, 3282 bp, Unknown
  Artificiall/Consensus sequence
atggcgacgcacaagctcggaaagctcaaattccggattcaggaccgcggaatcgaattccgctggggagacggcgagatccgtcgctttggtctgggcaaaaagagcggcgagaccgaatatgacgattcctacgagcaggagggcgacggcgcggagtacgattccggctattccgattacgcggaagagcccacggaggacgcgggcgaaagcgcgtacagcggccgcttctccggcgacgagagcgaatacgacgcctatgtagacgacgcctacgccgacgatcggtacgcctccaacgaggagccggacgatcgctacgcgcaggaggattacgcggacgacgacggctatgccgacgaggatcgctacgcggatgaagatcgctacgccgacgacggctatgcggatgacgacgggtacgccgacgaggatcgctatgccgacgatggctacgcggacgataatggctatgccgatgacgacggctatgccggagacgacggcgaatacgccgacgaggacggctattacgacgaaaacggcgaatacgtcgacgacggcgagtacgcgggcgaggaggagtattccggcgactatcccgagggaacgctgggcgccgtgcttcgctatgtggacgaaaacgactgggtgacgtatctgctgctgttcctgctgccgccgctgggcatctatctgctctggcgcaggaaccgcttcgatcagacgctgcgctatgcgctcaccgcgggctcggccgtatggttcatcgtgctggtgatcctgctggcgatgcagctcttcggcggtcatagcgacgttcagaccgggccgaacctgccgacgctcgcgccggcgcagacggtggaggctaccgaaacgcccgagccgcagacctcccttgcgcccgaagccaccgtctcctccgacggaagcggcgtaatcggcgcaaccgacgcagtcgccccctcggccacgcccatcaccggaaccaacgtcggcaccagcagcaacctcgtctgggtttcctccacgagcctgctgtatcacaagaacaacacctgctcgctcattggcgcgagcgaaaccgtctctcaggtcacgctggacaacgcaaagcagcgcaacaagttcgagtgccccgagtgctacggcggggagacttattacgccacggccaacggcgactattaccacaaggatccgacctgcagcggcatggaaaacgcggtggtcttcccgaaggacgctgcggagcactaccacaaggatgcgtgtcccgtctgcgtgaccggagagaagaagtccctggacgagaagacatcgaccaccggcggcgtgtacatcagcacctccaccaccgacaagagcggcgtgaaggtctggtgcaccaggggcggcaagcactaccataccacggccacctgctccggcatggagggcgcgagccagatcagcctgcgcgacgcaattctcgccggcaagaccgcctgctccacctgctgcgcggcggcggcaactcaggtctactgccgctccgacggaacctattaccatgccaacggcacctgctcgggcatgaagaacgccaaggccgtgacgctggctgaggcgatggtgctgggcaagaagcgctgccccacctgcctgccccagacgcagagcggcggcggctccaaccagaccacgggtcagtactacgtctacgccacgcccacgggcaagtactatcacaccaagagcaactgcggcggcatgaaggacgcggtgcaggtgacgctcagatccatggtcgaagcgggtcgtccggcctgccccacctgctgcagcggcgcggagatgtcggtgtatgtctccagaggcggaacctactaccattcctacgccacatgctccaacatgaaggaggcggtggagggcacgctggctcaggcgctggcctggggctatcagaagtgtcccaagtgctggggctccaagaccaacggaaccaccggcacgaatacgcaggatggtcagacgacggacagcaacgcatacaccgccactcgcgacaccatcatggtctatgcccggcaggacggcgcgtactatcacaccaagagcaactgctcgggcatgaagaacgccagccacatctccctcaagacggccatcgaggccggcaagaaggcctgcccaacctgcgcgtcggcggcggaacagctggtgtactccacgcagggcggaaaatattatcataagatcgccgattgcagcaacatgaagaacgcttcgcgccgcaccatcgcggacgcgctgatgctgggccagacggcctgccgggtctgctggaacactgtgacggaggatcagcagggcgatcccctgcctaacgacaatgccgacgtgaaattcatcgtcggcacgtcgggcatcaaggtctatgccgcgccgaatcagaagcactaccatctgaagagcaactgcacctcgggactgacccaggtggcgctggagacggcgctgaactacggcaagacggcctgtcccacctgcgcgaaggtggcggatcaggaggtctacgccacgcccaacggcaagtactaccacgtcagccagagctgcgcaggcagcggcgcggtcagcggatcgctggccaaggcggtggcgctggggttcaagccctgcccctactgcgtcgcgactacggataatggagccaacggctcgaccgcggagatttcccaggaggttcagaagtacgggaagggcagcggaacctataccgccggcaaatccggcgtgaaggtctactccaaggccagcgaccgctactatcactccagcaagaagtgcgcgggcagcggcgcggtgcacgtcacgctggagacggcgctgaattacggcaaaaaggcctgtccggagtgctgctccgtcgccgaaaagacggtgtatgccgctaagggcagcggaaccttccacgcgcgcaagagccatgcgggcgataacgccgtggcgggcacgctggctcaggcgctggcctacggcctgaagccctgctccacctgcttcaccaccacggaaaacgccggcacggtcacgccgggcgaggactattccgctccggccgattcgagcgtgtacgtcgacctgtactccgacgactactattaccacaaggattcgaagtgcagtcagacgggcatgagcggcggcaccaaggtgacgctggagttcgccaaggatctcggctatgccagatgcccctactgcaaccccgcgtcgagcattcagtaa

SEQ ID NO: 1359 - DNA, 4515 bp, Unknown
  Artificiall/Consensus sequence
atgaagcatcaggaaagcacgacgaacaacctctatctgcccgaaatggagcacgacgcgtgcggcatcggcgcggtggtcagcatcgatggcgagaagagccgcgccatcgtggatcaggcgctgaagatcgtggaaaagctggagcaccgcgcgggcagggacgcggacggcagcaccggcgacggcgtaggactgatgactcagattccccacgccttcttccgcgcgcagccgctgagctttgagctgcccggcgagcgggactacggcgtggccatgctgtttctgtcccccgaccggctcaagcgggcgcaggcgcgcaagctgatggagatcgtggtgcagaaggaggggctgcgctttctcggctggcgcgaggtaccggtgaacgccggcgtgctgggcgagcgggcgcgcgcctgcatgcccgtcatcgagcaggcgttcatcgcccgcccggaggacactgcccggggtctggacttcgaccggcggctctacaccgcccggcgaatcttcgagcagagcaacgccgacagctacgtctgctccatgtccagccgaaccatcgtctacaagggcatgttcctcgtctcccagctgcgggcgttctatcccgatctgcagagcggggagttcgtcagcgccatcgccatggtgcactcccgcttctccaccaacaccttccccagctgggagcgcgcccatccgaaccggctgattctgcacaacggcgagatcaacaccatccgcggcaatgtggatcgcatgatcgcccgggaagagacgatgtcctcgccggtgatgcagggcgacatggacaaggtgctgccggtcattcaaggtgagggcagcgactcggccatgctggacaacacgctggaattcctgatgatgaacggcgtgccgctgccgctggcggtgatgatgaccattcccgagccgtggcagaacgagcgcgacgtctcccgcacccgccgggatctctatcgctattacgccaccatgatggagccctgggacggcccggcggccatcctgttctccgacggcgacgtgatgggcgcggtgctggaccgcaacggtctgcgcccggcgcgctactacgtcaccgacgaccggatgctgattctggccagcgaggtgggcgtgctggacattccgccggagaagattctgcgcaaatcccgcgtccgctcggggcagatgctgctggtggacacggtgcaaaggcgcatcatcgacgacggcgagctgaaggagtcctatgccgcgcgccggccctacggcgaatggctggacggccatctgctctcgctgagcgatcttccgctgcccaaccatgccatcgctcccatggagcaggagctgcgcgaccggctgtacaaggccttcggctacacctacgaggaggtcaaggaggtcattctgcccatggcgcagaccggcgcggagccgacggcctccatgggcgcggacattccgctggcggtgctctccgaacggcatcagccgctgttttcctatttccgccagctcttcgcccaggtgaccaatccgcccatcgacgccattcgcgaaaagatcgtcaccgacacggcggtctacgtgggcagcgacggaaacctgctggaggacacgccggagaactgcgccgtgctgcggctggaaaagccgattctgtccaattccgacctgcagcgcatccgctcctccaaggccgccgccatccgtccgacgaccatttccatgctctattaccgcaccgaatcgctggagcgggcgctgaaccatctgttcatcgcctgcgaccgggcgtataaaaatggcttcaacgtgctgattctgtccgaccgcggcgtggacgaaaaccacatggccattccgtcgctgctggccgtctcggcgctggagcagcatctgatccgcacccgccgccgcacggccgtcagcgtcgtgctggagacggcggagccgcgggacgtgcaccacttcgcgctgctgctgggctacggcgcgcgggcggtcaacccttatctggcgctggaatgcgtggatgagctgatcgagaagggtctgctggacaaggatcgccacgccgccgagcaggattacatcggcgcggccgtgagcggcgtcagccgcgtggcctccaagatgggcatctcggtgctccagtcctatcagagcgcccagatcttcgaggccgtgggtatcgccaaagacgtgatcgaccgctatttcaccaagaccgtctcccgcgtgggcggcgtgggtctggccgaaatcaacgaggacgtggaattccgccacgaccgggccttcgacccactggagctggaaaacgacaccacactggactccatcggcatccatcggctgcgcagcggcggcgacaaggaggatcacctctacaacccgctgaccatcaccacactgcagcgcgccgtgcgggaggacagcttcgagaccttccgacgctacaccgagatggtggacgacgagacccggccccacacgctgcgcggcgtgctggagttcgccttcgaccgctgcacgccggtgccgctggacgaggtggaaccggcggaggagatcgtcaggcgcttcaagaccggcgccatgtcctacggttccatctctcaggaggctcacgagtgtctggccgaggccatgaaccggctgggcgggcgctccaattccggcgagggcggcgagcgccgcgagcgcctgaacacctcccggggctcgaagatcaagcaggtggcctcgggccgcttcggcgtgaccagcgaatatctgatgagcgccgaggaaattcagatcaaaatggctcagggcgcgaagcccggcgagggcggacatctgcccggcggcaaggtctatccatgggtcgcccacacccgctgctccacgccgggcgtgagcctgatctctcccccgccccatcacgacatctactccatcgaggatctggcgcagctgatctacgacctcaagtgcgccaaccgccgggcgcgcatcagcgtcaagctggtcagcgaggcgggcgtgggcaccgtggccgcgggcgtggccaaggccggcgcgcaggtgattctcatctccggcgcggacggcggcaccggcgcggccccgcgcacgtccatccacaacgcgggtctcccctgggagctgggcgtggccgaggcgcaccagacgctggcgctgaacggcctgcgcagccgcgtggccatcgaggccgacggcaagctgatgagcggccgggacgtggccgtggcctgcatgctgggcgcggaggagttcggcttcgccaccgcgccgctggtgtgcatgggctgcgtgatgatgcgcgtgtgcaatctggacacctgtccggtgggcatcgccacccagaaccccgagctgcgcaggcgcttcaagggcaagcccgagtacgtaatgcgctttatgctgttcatcgccgaggagctgcgcggcatcatggcccggctgggtgttcgccgcgtggacgagctggtgggccgcggcgatctgctgcgcatgcgtccgaagcaggcgagccatcgcgccgcgaccgtcgacctaagccgcgtcatcggccagaacatcaaccagcatcgcgttcctgaggacgcgttcgacttccagacgcagaagacgctggacgagcgcgtgctgctcaaggaattcgacctgtcgcgcgccgagccgcagcgcatcgccctgaccgtctccagcaccgaccgcgccttcggagccatcctcggcagcgaggtcacgcggctgtacggaagcagactgcccgaggacgccttcaccatcgacgcgcagggcggcggcggccagtccttcggcgcgttcctgcccaagggcgtgaccatccgccttgcaggcgacagcaacgactacttcggcaaggggctctccggcggccggctggtgctgttcccgccgaagaacgcgcgctttgccgcggacgagaacatcgtcgtgggcaatgtggcgctttacggcgcgaccagcggccaggcctacgtctgcggtcaggcgggcgagcgcttcgccgtgcgcaattccggcgccgtcgccgtggtcgagggcgtgggcgaccacggctgcgagtacatgaccggcggctgcgtggccgtgcttggccgcaccgggcgcaacttcgccgcgggcatgtccggcggcgtggcctacgtgctggacgaaaaccacgacctctacctccgggtgaacaagcagctggtggacatcgaggagctgcgcagcgaccacgaccgggagacgctgcgggcgatgatcgaggagcacgtgcgccagaccggctccgaaaagggccggcgcattctcgaaaacttcgacgcgtccgcggacaaattcaagaagatcattccccgggattaccggcggatgctcagcgccatcgcccggtgcgaggcgcagggcatgtcccgcgacgaggccgagctggaggccttccgcgaaacgaccgaaggcaggtga

SEQ ID NO: 1360 - DNA, 2049 bp, Unknown
  Artificiall/Consensus sequence
atgaaaaagaaaaacgccgccgtcaaccggcggttcgacgagtccgacggaagaaagcgcgtgctgctgctgccaatgctggcgctggcgctgacgctcatcgtcgagggctgcaaccagaagggcgtgcccggcctgtggcgctatatcaccggtcggccgctgtatttcctgtacaatttcctgatcgtgctgacgacgctgacgttctccgagctgttcaagcggcgcaaggcggtgctgtacaccaccggcgtggcctggatcggcctgggaatcgcctgcttcatggtctcccgggagcgcacccagccgtttacgtccatggatcttctgatgctcaaggacgcgatcacgctgaccacgctgtactacacatggccgcagatcatcctgatgttcggctccatcttcgcggctctcgtgctggtcatctggatgattacgcgcctgcccaaacggcgtaaggtcaactacacgctgtcgctgtccgtcttctgcggctttctgacgctgtgctgctgcctgtgctcgctgggcatctacttcggcctgttcccgagatattacgacaacctcgtggacgcctacgagcagtacggcttcgccacgtgcttcaccttcaccttcggagacatgggtgtgaagaagcccagcgagtattccgacgaaaaggtgacggacatcgtggaggagatcgacgacggccccgaggccacgccggaagcgcccgcgcggcacatcttcggcgtgagcgaccagctggagcgccccaacatcatctacgtccagctggaatccttcttcgacgtgaacaccatcatcggcgcggagtattccgaggatcccacgcccaacttcaaccgcctgtcccgggaattctccagcggcgagctgtacgttccgtccatcggcggcggcacggcgaacgtggaattcgagatgctctccgggctgaatctggacttcttcggcgcgggcgagtatccctacagcaccgtcctgcaggataccacctgcgaaaccatcgcctacaacctgcgcgagcagggctacgccaccacggccatgcacaaccacacgggcacgttctacgaccgcaacgagatctatccgcgcctgggcttcgagcatttcgtctctcaggagtacatgccctatgtgacctacaccgaggtgggctgggcggaggacgtgatcctcgtggacgagatcctgaaggcgctggaggccacgcccgatcagcgcgacttcgtgatggccatcaccgtggaatcccacggcaaatacgacgaaaactacacctatcacgagggtgatccggtggtgctctcgctgccggagcagatcaacaaggacagattctccagctatctgcacctgatctcccagaccgaccagtttatcggcaagctgattcagcggctggagctctacgacgagccggtgatctgcgtgttctacggcgaccatctgccgggtctggacttcaccgccgatctgctgaccacgggcagcctgtacgccagccgctacgtcgtctggaacaatttcggcggcgaattcgaagcgcccgaccttcaggcctatcgcgtcagcgccaacctgctcaagcagctgggcatgtccggcggcgtgatcacccgcttccatcagtccgcggcgctggacggcagcgacgagggctatctggacaagctgcaggtgctggaatacgacctgctgtacggcgatctgagcgtctacgacggcgtgaatccctatgcgccggtggcggatttccagatgggcagcgtgcccattgagatcaccgccgtgtccgaccgctatggccgcgtgctggtggacgggcgcaactttaccgagtgcagcgtgattctcatcgacggagagagctaccccacggccttcgtcagcagctcggagatcgtggccattgtgccgcgcaccacgccggtgagcgaggtctgtgtggcgcaggtcgcccccgacggcaccgaaatgagccgcaccgacgttttcaccgtggacaatacgccgggaagataa

SEQ ID NO: 1361 - DNA, 3396 bp, Unknown
  Artificiall/Consensus sequence
atgaatttgaagcgatggatcgcgatgctgctggtcgcggcgctgctggcgacggcggctccggctctggcggcgccgagctactacgtcaccgtggatctgaccaatcagatcgtgacggtctatcaggcgggcaacgtcagcaagtccggcattgtgcgccagatgatctgctcgacaggcaagaaggacacgtctacgcctacgggcacctttacgctgccgaagaagtcccgctcgtccgagcgctcggaatggtattatttcagcgagtatcgctgctatgccaaatgggcgacgcgcatccgcggcggcatcctcttccattccgttacatacagtaccaagaagtccggcccgtccgcgtcggcggtgcgcaatctgggttcgcccgcatcccacggctgcattcgcctgcgcgtggaggacgcgaagtggatcgcggacaactgccccgcgggcacgaaggtcaaaatctattacagcggcaagcgcgacagcgcgctgcgcagccgcctcttgaagaagaccttctccgcgtcgaatcagacctacggcgagttcaccggaaccagcggcgtgctggaaaagggcagctccggcgacaaggttcgccagctgcagaaccgcctgattgagctgggctatctgcgctcctccgccgacggcatctttgggaacgacacgcacaacgccgtgacggcgtaccagcagaatctgggcgtgacggccaacggcaaggtggacgcggcgctgtgggacaggctgttcgccgcggatacgcccgcagccggactggtgcagggcgattcgggcgagaaggtcgtccgcctgcagaaggcgctgaagggactgcgcctctattccggcgcggagaacggctcctttgacgcggccacggcggcggcggtgcgcgaatatcagaccatgaacggccagtccgccaccggcagcgtctccgacgcgctgctttccgccatggaaaatcgcgccgacgagctgaagaagcagttcggcgattcggactaccggctggtggaaagcaccgtgagcgtcaatcgcgcgaaggtgaaggtcagctccagtctgaatctgcgccagaaggcctctacctcgtccaaaattcttgccaggatgaagaacggcgcggtggtcaccgtgctggaaaagggcggcaagtggagcagggtgcagtatggctccgccgtcggctatgtgatgaacagctatctgcgctgctatgccgacaccactacctctcggatctacgaggccgtgcttgagccgaccccgactcccgagcccacggcgacggtcgaacccacgccgactcccgaagcgaccgctacgcccgaggcgacggcgaccgcggaaccggcggttacgccgactcccgagcccaccgcccaggcgaccacgctgaagtggggaagccgcggcgagggcgtggcgaatctccagcgcgcgctgaaggcgctgaagctctacaacggcgaggcgagcggcagctttgacgaagccaccgtggacgcggtgaagctgttccagcgtgtgacgggtcagagcgaaaacggcgaggccacgccggcgctgcagaccgcgattttcgaaaaggtaaaggccgtgcgcggcgaattcggcgacaaggactacaacgccgtcatctccaccgtatccaacacgcgtgcgaaggtaaaggtcagatccagactgaacctgcgccagaaggcctccacctcgtccaagagccttgccaggatgaagaacggcacggacgtcgccgttctggagcgcggctcgaagtggagcaagattcagtatggttccaagatcggctacgtgatgaacagctatctgcgcctctatacgcagtcctcctcttcgctgagctatgaggaggctccggttacgcccgtgccgacggcgaccgccgtgccgacggaaatgcctgcgccgacggaaacgcccgtgccgacggaaaccgctgcgcccgcggaaacgcctgcgccgacggaaacgctcgcgccgacggaaacgcccgtgccgacggaaacgcctgcgccgacggcgaccattgagcccgagcccactgcccaggcgaccacgctgaagtggggaagccgcggcgagggcgtgacgaatctccagcgcgcgctgaaggcgctgaagctgttcggcggcgagatcgacggcagctttggcgagaccaccgtggacgcggtgaacctgttccagcgcgtgacaggtcagagcgagaccggcgaggctgcgccggcgctgcagaccgcgatcttcgaaaaggcgaagaccgtgcgcggcgagttcggcgacagggactacaacgctgtcatctccaccgtgtccaacgcgcgtgcgaaggtgaaggtcagctccagcctgcacctgcgccagaaggcttcgacctcgtccaagagtctggctaagatgaagaacggcacggacgtcgccgttctggagcgcggctcgaagtggagcaagattcagtatggctccaagaccggctacgcgatgaacagctatctgaccttctacacccagtcgtctgcttcgctgagctatgaggctgtggaggtcaggacgctggaagccgagattggagaggttctcgcgatcgccgtcgagccgatggagacggaggagccgatgcctgtgctgccgccggaggaaacggtgcagccggaagcgaccgccgagccctctcaggaaccggcgcagaccgccgagccgatgcccgtgctgccgcccgaggagccgcttgagccggaagtgaccgccgagccctctcagaaaccggctcagaccgagcagccgatgcccgtgctgccgccggagactccggcggagaccgtcgagccgaccgaatcggccgcgcctgcggagactgttcagcctgagaaacccgtacagacagccgcgcccgaggagtccgcagaaacgcccgctccgacggccaccgctctgccgaagccgctctacgccgtcgtaaagaaggacgacgcggcgctgcgaagcgagaaggagttggcggagaagtacgtcgtccgtccgctggttcgcggcgaattcttcgaggtagcggagaccgacgaggaatggacgaccgtccgcgaagaggatttcgtctattatatccgcaccgaggaaatcgagctgacggagatcaagcccgagcccacgccgcgtcctacggaagcgccgagcgtgacggaagtgccgcatgtaacggaagcgccgcgtgagacggaagcgccgcatgtaacggaagcgcctgcgccgacgatcgccacggagccaaccgagacggttgagcccgcggaaacgcctgcgccgcaggaggaatccaacgaagaacaaccggaggagaaagccgaatga

SEQ ID NO: 1362 - DNA, 2301 bp, Unknown
  Artificiall/Consensus sequence
atgaagaaactcgtttctctgctgatcgctcttgcgatgcttctctccgtggccgccttcgccgaaccggcggcggacacgacggaagccgagggctccagcgcggtgtatgcaactgcgacctttggtcagaagttcagcaccttctttgctgcgaccgcttatgaccaggaagtggtcgatctcaccaccggcagcctgctggctggggaccgcggcggcaacgtcatccgcaacggcatcgagggtgagaccgtcaactacaacggcactgactatacctattacggcatgggcaacgtcgaggtcgtcatgaacgacgacggcaccgtcgactacaacctgaccatgcgcgatgacatcaagttctccgacggcacccccgcggacatcgacgacgtcatcttcggcatctacgtgctgtccgatcccacctacgacggcgccgcgaccctctatgcgcagcccatcgaaggcatggacgagtactacaacgccatgtcccccctgtccacgctgctgctggccgccggccgcgacaacacggacttctccaagtgggacgaggccactcagaccgctttctgggcggacgttgacgctgcgggcgccgcgctggctcaggagatcgtcgattacgtcgtcgccaactacgccgacagcaacgccgcggacatcggctctacccccgacgagatcaaggccgatcccgaaaagcagatgcagttcggcatggccatgtggggctacggcgattcctacaccgagggctgcaccgccgcggattactggaacgccatcgtggccaactttgacggcgacgtggttgccgccgcggaaaccgagtccgcgggcaccgcgctgttcgacttcatcgacgactatgccgagaagtacggctacggcgtggcctccggcgatgcggtcaccagcatcaagggcatcatccgcaccggcgactactccatgaccgtgcacatgaccgagtacgacgccacctccatctacaacatgtccttcgccatcgcgccgctgcactactacggcgacgagagcctgtacaacggcgtggactccttcggcttcccgaagggcgatctgagcatgatccgcgccaagaccacccagcccctcggctgcggcccgtatgtcttccagagctatgaaaacggcgtcgtgaccctgaaggccaacccctactacttccagggcgagcccgccatcaagaccctgatgatgcaggagtccacggatgcggactacgtgcccggcatcgtgaccggcagcttcgacgtcgccgtgccctccatcaacgaggacaccctgaaggccatctgcgacgccaacagcaacggcgagctcaccggcgacgtggtcaccaccgttctggtggactaccgcggctacggctatctgggcatcaacgccgatctggtcaaggtcggcgaggattccggctccgccgagtcccgcgatctgcgcaagggcttcatgaccgtgctgagcgtctatcgcgacaccgtcatcaactcctactacggcgaccgcgccgccgtcatccagtatcccatctccaacacctcctgggcggctccgcgtcccaccgacgagggctaccagaactgctactccaacgatgtggacggcaatcccatctacaccgagggcatgagcgacgagcagaagtacgacgccgcgcttcaggccgccatcggcttcttcaaggccgccggctacacctgggacgacgcttcctccaccttcaccgcggctcccgacggcgcctccctgtcctacgagatcatgatccccggccagggcattcaggaccatcccacctacggcgtggccgtcgccgcggctgagtcgctggccaagatcggcatcaccctgcaggtgaacgacgtcggcacctccacctggaacaacgctctggaagccaacaccgctcagatgtgggtcgccgcgtggcagtccactccggatccggacatgtatcaggtctatcactccagcaacgcccacggcgagaacaccaactccaaccactaccagatcaccgatcccgagctggacagcctgatcgtcgccgcccgcaccagcgccgacaacgatttccgcaaggccacctacaagaccgccatggaaatcatcctcgactggggctgcgagctgccgatctatcagcgcaaggactgctccaccttctccagcatccgtctggacaccgacaccctgccgaaggacatgactccttactggggttggtacgccgagatcgagacccttgccaccaagtaa

SEQ ID NO: 1363 - DNA, 2805 bp, Unknown
  Artificiall/Consensus sequence
atgctgaaattcgtattgcgcaggatgctgaacaagcgatggatgattctctcgctgctgatcggcaacctgctgctggtgagcatcacctgcaccaaccccatgtacacccgcgcggtgctgcagcgaatgctcatcagcgattttgccaacgatctggaagaaagcaacacctatcccacgacgctcaccgtgacctcctcgccaccgctggtcaacatcgaccagatcagcgaggcggacgcggccgtcgaggaggccattgccgactacaatcttccgctgctggagaagattcggctgtactccaccaagtcgctgagcatcgccccgcggctggcgcgcgaggaaatggagcacaagaccatgctcatgagcgccatgtccgatctgcccgagcatgtggagatcgtcgccggacggatgtattcctccgagcccgacgcggacggcgtgatcgacgtcatcgtcagcgagcgctgtctggtgaacatgaacctgctggtggacgagatcatcgacatgccgccgctgatcctgcccgatggctcctccatgaccttccgcgtggccggcgtgttcaagaacagcgcgtccgacgacgcgtactgggtgcgctcgcccagctattactccacctcatgcttcatggacttcgacctcttctgcaggtacttcgcggacgcggcggagcctcagaacgccatctgcggcacttggtatgtgctgttcgactacacgaagctccgcggcgacgacgctcagcgcatcttcgcgctgacgcagaaatacgacgacgcgttcagtacgctctactatcgctccttcagcgccaacttcgaaaagacgctgagcgattacctctccatgtccaagaaggtcagcgtgaccatgtgggtgcttcaggctcccatcttcgtgctgctggcggtgttcatcttcatggtctcccgccagatgctggacatggagcagaacgagatcgccgtgctcaagagccgcggcgcaaaccgccgtcagctgctgaccctctacacgctgcagagcctgattctggcggccgtcgcctatgccggcggcgtggcgctcagtccctatctgtgtcaggtgctcggctcggccaattctttcctggaattcgtgcgccgaagcgcgctggacgcgcagatcaattccaccgtgctgctctacggcgcggcggcggcgctgctgtccgtgctggccatggtgctgccggtgctgcgccgctctaaaacgaccatcgtctcccacaagcagggcaggaaccaccggcgcagcgaccgcccgctctggcagaagctgggcctggacgtgattctgctgggcgtttccctctacggcctgtacagcttcaacggccagaaggaggcactttcccagaaggtgctggagggcgcgtcgctggatccgctgctgttcctgtcctcgtcgctgttcatgatcgccgcgggcctgctggcgctgcgcgtgctgccggccgtcgtctggctggtgttcacgcccttcaaaaagctctggagtccggcgctctacgcctcgttcctgcgcattctgcgcacccggcgcagtcagggcttcatcgtggtgtttctggtcatcaccatcgcgctgggcgtgttcaacgccgacgccgcgcgcaccatcaacggcaacaaggaggacaatctgcgctacgaaatcggcgcggatctcgtgcttcaggaaaagtggtcggacaacagcgcctctctgacggacaatcccaatctggatctggtctacaacgagccggattacggacgctttctggccatggacggcgttcagtcctgcgccaaggtgctcaccgacagcgtgtcggtctccgtctccggcggcacgctgaagaacgttcagctgatggcaatcaacacgaaggccttcggccagacgatctggatgaaggaggggctgaacctctaccccatcaacgcctatctgaacgccatctcccagaacagccggggcgttctggtctcgcgcaacgcgcagaccgacttcggcatgaagctgggcgacgtaatcagctacaagatgagctccggcgagtccatccgcggcacgatctgcggcttcgtggactacttcccgagctatgcccccgtgacctacgccaagggcacggacggactgtatcgcgaaacgcccaactatctggtggtggccaatctctcgcaggtgcaggccgagtgcggcgtcacgccctacgaggtctggatcaagaccaacggctccacggatttcatctacgactttgccgaggaaaacggcctgaccttcacgcgcttccgcgacgcgtccgccgagctggtagagatgaagaacgatccggtgctgcagggcaccaacggcattctgaccgtgggcttcatcgtggtgctgctgctgtgcgcggtgggtttcctgatctactgggtgctgtccattcagtcgcgcacgctacaattcggcatttttcgcgccatgggtctgtccatgcgcgaaattctgaccatgctgctcaacgagcatctgttcatctcgggcctgtccattgtgaccggcgcggcggtgggcaagctgaccgccaagctgtacatgccgctgattcagctggcctacgccgcgtcggacaacgcgctgccccttcaggtggtgtcccgcagcggcgacatggcgcgcatcgccatcgtggtgggcgtgatgctggcggtctgcctgacggtgctgggcgtgctgatttcccgaatgaagatcgcgcaggcgctgaagctgggagaggattga

SEQ ID NO: 1364 - DNA, 1752 bp, Unknown
  Artificiall/Consensus sequence
atgaaatcaaggctcgcagttcctgcggccctgattgccctgattgctctcgtacttttgtccgtcaataacagtctggatattgcggaggcgaagaatcaaagcgttctggcggagctccagggaatctgccagatcgccggcgattcgacttcctcgatggaggcggaggagcgcgccgacgcgctcgcttcgttccagatgccaaatggggttttctgcgaatatcgtctgccggacggtcagtcggtctatgcatcctccgagggcgcggacgcgctgttcgaaaagatgccgaccctctccctgaagcgcacggttcgcacctatacgcatgaggactcgaaaggtacgccgtcgatttgcgccatctatcaatatgaagatggcgcatttttgctgtattacgccgccgagagcaagcctgtggcgattctgtccgcgcgcaacatcatctgtcttgtgcttctgacggcctcgctggccgcgttcatcgcgatctggctggccatgaactccaaggaacgtctgatcgacagcgccatgcgaacgctcgatgagttttcggacggcaattttgacgcgcgcatcgaggaaattcccggcaagacgggcgaggtggccaagtacaacgccgtcatctcgcgcatccagagccgcattttccagcagcgcagccagaaccacgccatgagcgtggtcatgtcccagatgcagaacggcatcatcgccgtggatcaggaccttcgaatcattctcatcacgccggtggcgaagaagctgctgggcgtggtgggcaattccgagggcatgcctgtcagcgaggcgagccgcgacgtccgcctggacgaggtgttcaacgaggccatgaaccagccgggcgtgtacaccaacgacgtggccgcgcgcaccgccgtgggccgcgggcatcggccgctgcgcctgtacgtttcgcccatgcgcaacgacggcaaggtcgtgggtgcgctggccatggtggaggacatcaccgagctgcgccggctggagcaggtgcgcaccgacttcgctgccaacgtgtcccacgagctcaagacgccgctgacgtccatccgtggcttcgtggagacgctggaggccggagccatcgacaatccgcccatggcgcacaagttcctgcgcatcatcatgctggaaaccgagcgcctgacgcggctgattaacgacattctgtccatcagcaagctggaatctggcaacgacgaggtcgccatcgagcgcatccgcctggacaaggtggcctacgacgtgtgcgacatgctgaccattcacgccggcgaaaaggaagtctccatccacgtccacatgaacgaaaaacccgtgtatatcatgggcaatccggatcgcgtggagcagatgctgatcaatctggtggagaacgccatcaagtacaacaagcccggcggatcggtgacggtgcaggttttctccgacgcgaaggaggccaacgtgaccatctccgacacgggcatcggcatcgccgaggagcatctgccgcgcatgttcgagcgcttctatcgcgtggacaagggccgttcccgccagatgggcggtacgggtctcggcctggccatcgtcaagcacatcgttcgttcgatgaacggcgaaatcgaagtacattccaagctgggcgaaggaaccgagttcctgatctctctgccgctcgcgccgaaggattcgccggacaaggataccatttttgacgacatgtga

SEQ ID NO: 1365 - DNA, 2628 bp, Unknown
  Artificiall/Consensus sequence
atgcagaagtacgtatatctcttcagcgaaggcaacgctcagatgcgcaacacgctgggcggcaagggcgccaacctcgctgagatgaccaatctcggcatgcccgtgccgcagggcttcaccatctccaccgaagcctgcacttcctattacgacaacgaccgtcagatcacctctgagatcatggatcagatcgaggaagcgctggccaagatcgaaaagatcaacgagaagaagttcggcgacgccaagaacccgctgctggtctccgtccgctccggcgcccgcgcctccatgcccggcatgatggacaccatcctgaacctcggcctgaacgacgaagtggccgccggcctgatcgcgggcaaccccgatcccaagtttgagcgcttcgtgtacgattcctatcgccgcttcatccagatgttctccgacgtggttatggagctctccaagaagcgcttcgaggtcatcatcgacgaagtgaaggaagccaagggcatcacccaggacatcgatctgggcaccgaagacatgaagctgctggtcaggcgcttcaaggagttctaccgcgaggagaagggcgtggacttccccgtcgaccccaaggagcagctcctcgaggccatcaaggccgtgttccgctcctgggacaacccccgcgccaacgtctatcgccgcatgaacgacatcccctattcctggggcaccgccgtcaacgtgcagcccatggtgttcggcaacctgaatgagaagtccggcaccggcgtcgccttcacccgcgaccccgccaccggcgaaaaggcgctgttcggcgagtacctcatcaacgcccagggcgaggacgtggtcgccggcatccgcacccccagccatatcacccagctggagaacgacatgcccgaagtgtacgagcagttcaagcagatcgccaacaagctggagaatcactatcgcgacatgcaggatatggagttcaccattgaaaacggcaagctctacatgctgcagacccgcaacggcaagcgcaccgccgccgccgcgctgaagatcgccgtcgacctcgtggacgagggcatgatcaccgagcgcgaggccgtgatgcgcgtggagcccaagcagctggattccctgctgcaccccatgttcgacgccaaggcgctgaaggctgccaagcccatcggccagggcctcgccgcttctccgggagccgcctgcggccaggtcgtgttcaccgccgaggacgccaagaagtgggccgagaagggccacaaggtcgttctggttcgcctggagacctctcccgaggacatcgagggcatggtcgcctctcagggcatcctgaccgttcgcggcggcatgacctctcacgcggcggtcgtcgcccgcggcatgggcacctgctgcgtctccggctgctccgagatcaagatgcgcgaaggctccttcgagctgggcggcaagacctacaccgagggcgactggatctctctggacggctccaccggcaagatctacggcgagcccatccccaccgcggaagccagcatctccggcgacttcggccgcttcatggcgtgggccgacgcggcgcgcaggctgaccatccgcaccaacgccgacaacccgcgcgacgcggcgcaggccgtcaagttcggcgcggagggcatcggcctgtgccgcaccgagcacatgttctttgagggcgaccgcatcaaagccgttcgcgagatgatcgtggccaagaccgtcgaggcccgcaagatggcgctgaacaagctgctgccctatcagcagagcgacttcgaggccatgtaccgcgtgctggaaggccgtcccatgaccgttcgctatctggatccgccgctccacgagttcctgcccacccgcgacgaggacatcgccgatctggccaaggaaatgaagatctccgtggaggagctgaaggaaaccgtcgccaatctgcatgagttcaacccgatgatgggccatcgcggctgccgtctggccgtcacctatccctgcatcgccgagatgcagaccaaggccgtcatctccgccgccatcaacgtcaaccgcgagcatcccgagtacaacatcgtgcccgagatcatgatcccgctggtgggcgaggccaaggagctcaagttcgtcaaggacgtcgtggtcaaggtcgccgacgagctcatcgccgacgcaggcgtgaagatggagtaccacatcggcaccatgatcgagattccgcgcgcggccgtcaccgccgacgaaatcgccagggaagccgacttcttctccttcggcaccaacgacctgacccagatgaccttcggcttctcccgcgacgacgcggcgaagttcctgaacgcgtactacgatcacaagatctacgagttcgatcccttcgcgaagctggaccaggtcggcgtgggcgcgctggtgaagatggccgcggaaaagggccgctccacccgtcccaacatcaagctgggcatctgcggcgagcacggcggcgatccgtcgtccatcgagttctgccattccatcggcctgaactacgtgtcctgctccccgttccgcgtcccgatcgcccgtctggccgccgcacaggccgccatcaagctgggctga

SEQ ID NO: 1366 - DNA, 933 bp, Unknown
  Artificiall/Consensus sequence
ctggtgcagcgggtgaacacctacgcgttccagcatccggtggagctgatgcagaacatcgaccgggtaacggagcacatccgccgggagcggccgaagaaccagagcctgcacttccaccacacggaggatcggaagaactacctgatggacgacgacggcttctggcggctgagcaactacgtgccgtcggtgacctttgacagctgcgacgatctggacgtggtgcgcagcgcgggcgaggccttcggcgatttccagatgatgctgtccgacttcgacgcggcgcagctgttctacacgattcccgatttccacgacacgcgcaagcgctacgcgaagctcagggaggacgcgcaggcggatccctgcggccgcgtttccgaggtgcgtgaggagctggactggcttctgagcgtggaggacgaggcgtgcaaacttaccgacctgtacaacgcgggggagcttccgctgcgggtgacgcacaacgacacgaagatcaacaacgtgctgttcgacgaagagacgcggcgtgcgctggtggtgatcgatctggacacggtgatgccgggtctggtggggcacgacttcggcgacgcaatccgcttcgcggccaacttcgtggaggaggactgcgacgaggcggagaaggcgggcgtgaacctgaacgtctactgggccttcgccgagggcttcctgaaaaagacggcggcgacgctgaccgatgcggaggtggacacgctggggccgagctgctttgcgctggcctgcgagctggcgacgcgctttctggacgattacatcgtgggcgacaagtacttcaaggtcaaaaagccgaagcacaatctggtgcgcacgcgctgccagatcgcgctggccaaggacatgcagcgcaagatgaacgccatgaccgccatcgtccgcgactgcgcc

SEQ ID NO: 1367 - DNA, 1527 bp, Unknown
  Artificiall/Consensus sequence
gtgaatcatgaaaacgccattgaactgaggaacattaccaagcggttcggcaaggtggtcgccaacgacgggatcagtctgaccattcgcacgggggagatcctcgccattctgggggaaaacggcagcggcaagacgacgctgatgaacatgatctcgggaatttactatcccgacgaggggcagatcctggtgcatggcgaggaggtttcgatccgctcgcccagggacgccttcccgctgggcatcggcatgattcatcagcacttcaagctggtggacgtgctgaccgcagcggagaacatcgtgctgggcctgcccggtgagaagcggctggacatcgccaaggtcgccacgaagatcaacaagctgacggacaaatacggcttcgagctggatcccttcaagaagatttacgagatgtccgtttcagaaaagcagacggtggagatcgtgaagatgctctatcgcggcgcgaagattctgattctggacgagccgacggcggtgctgaccccgcaggagacggacaggctctttgcggtgctgcgcaatatgcgtcaggatggaaacgccatcgtcatcatcacccacaagctcaacgaggtgctggagctgtccgaccgggtgtcggtgctgcgcaagggcaagtatgccggcacggtggagacgaaggacgcgacggtcatgagcctgacggagatgatggtgggcaagcgcgtggagctgaacattcagcgcgacgagccggtgaacctcaccgagcggctgaaggttcgggatgtgacgtgcgtcaatcccgacggcgtgattacgctgaaccacgccagcttcgatctgcagggcggcgagattctgggcattgccggcgtggccggcagcggtcagcgcgaaatcctcgaggccatcgctggtctgacgcccgtggaatccggcgagatcgactacttcccgcccgaccacgaggcacaggagctgaccaagctcagcgccgtggagatcaaccggctgggcgtgaagctgtccttcgtgcccgaggatcgactgggcatgggtctggtcgggccgatggacatggtggacaacatgatgatccgcagctacaagaagggcggcttcttctgggcggatcgccgctcgcccaagacgctggccgagcacatcatcagcgagctggaggtcgtcacgccgggcgtatccacgccggtgggcaagctctccggcggcaacgtgcagaaggtgctggtgggccgcgagatcgcctcgaatcccatcgtgctgatggtggcctatccggtgcgcggtctggacatcaattcgtcgtatacgatttacaatctgctcaacgagcagaagcgccgcggcgtggcggtgctgtgcgtgggcgaggatctggacgtgctgctggcgctgtgcgaccggatcatggttatgtgcggcggccgggtcacgggcgtggtggatgcgcgcacgaccaccaaggaagaggtcggcatgctgatgatgcaggacggaagggagcgttga

SEQ ID NO: 1368 - DNA, 2661 bp, Unknown
  Artificiall/Consensus sequence
atggaaaaccagcaggaattcaccatggagaaggtctttgcgccccagcaggtggagggcaggatctatgacatgtgggagcagtccggcgcgttcgagccgaagaaggatcccaacaagaagccgtttaccatcgtcatgccgccgccgaacatcaccggtcagctgcacatcggccacgcgctggacgaaatgccccaggacgtgctgattcgctaccatcgcatgaagggcgatcccacgctgtgggtgcccggcaccgaccatgccgccatcgccaccgaggtcaaggtggtggacgcgctgaaggccgagggcctgaccaagaaggacgtgggccgcgaggagttcctgcgccgcacgtgggaatggaaaaaggaatacggcggacgcatcgtcaggcagctgcgcaagctgggcgtctcctgcgactggaagcacgagcgcttcaccatggacgacggcctgtcccgcgccgtgcgcgagacctttgtcaatttgtatgaaaagggcctgatctatcgcggcgaccgcatcatcaactggtgcccgacctgccagaccgcgctgtccgacgcggaggtggagtacgtcgagcaggattcctccctgtggcacatccgttatcccggccccaacggccacgatgtggtggtggccaccacgcgcccggagaccatgctgggcgacaccggcgtgtgcgtcaaccccagggacgagcgctatttcgatctggtgggcaagaccgtgacgctgcccatcatgaaccgcgagattcccgtggtcgccgacgactacgccgacatggagtacggcaccggcgcggtgaagatgactcccgcccacgacccgaacgacttcgaggtgggcaagcgccacaatctgcccatcatccgcgtcatgaacgacgacggcacgatgaacgaaaacgccggcaagtactgcggcatgacccgcgacgagtgccgcaaggccgtcgtttcggagctgaaggagctgggtctgctggtcaagatcgagccgctgaagcacaacgtgggcacctgctatcgctgccacgataccatcgagaccatcatcggctccaagccccagtggtacgtcaagatggagcccctggccaaacccgccattcaggtggtcaaggacggccagctgcgcttcattcccgagcgctttgaaaagacctacttcaactggatggagaacatccgcgactggtgcatcagccgccagctgtggtggggccatcgcattcccgcgttctactgcgacacctgcggcgagatgatcgtctcccgggaggatctgaccgtctgcccgaagtgcggcgcgccgatgcgtcaggacgacgacgtgctggacacctggttctccagcgcgctgtggccgttctccacgctgggctggccggacaagaccgaggatctggcctattactatcccaactccgtgctgtcctgcggctacgacatcatcttcttctggctggcgcgcatggtgttctccggcatcgagcagatgggtcagtgcccgttcagcgtggcgctgatgcacggcctcgtgcgcgacgcgcagggccgcaagatgtccaagtcactgggcaatggcatcgaccccatcgaggtcatcgacaagtacggcgcggacgcgctgcgcttctcgctggtcatgggcgttgcgcccggcagcgacatccgcatgtccgaggaaaagatcgagtccttccgcaatttcgccaacaagatctggaacgccagccgcttcgtgctgatgaatctgcagggcttcgagccgcagggcatcccgtccacggacaagctccagctggccgacaagtggattctgacgcgctatcaggagacggtgcgcgagatcaccgacaacctcgaaaactatgatctcggcttcgccgccaccaagctgtacgacttcatctggtccaccttctgcgactggtacatcgagatggccaagcagggcctctacgccgacgatggcgaggccaagcgcaccactcaggaggtactgctctacgtgctgaccggcacgctgaagctgctgcatccctacatgcccttcatcaccgaggaggtgttcggctatctgcccggacacaagggcatgctcatcacgtctcagtggcccgaggcgaagcccgagtacgacttccccgccgaggccgaccgcatggagggcgtgatggaggtcatccgcgccatccgcaacctgcgcgctgagatgaacgtcgcgcccggccgcaaggccacgctgatgctcaagccgcacgagggctggagcgacgcgctgctggccgccgacggctatttcaagcgcctggccggcgccagcgccgtggagctgctggctgccgacgcgcccaacccggccaagtccgcctccgcggtgtgcgatccctgcgagctgttcatcccgctgggcgagctggtggatgtggacaaggagctggcgcgcctggaaaaggatctcaagtccgccgagggcgaggtgcagcgcgccgagggcaagctgagcaacgagaagttcgtcgccaaggcgcccgccaatctggtggaagccgagaaggaaaagctcaccgccgcccgcgcgcgcgtggaaaagctgaagtcccgcatcgccgaaatggaagcgctgaagtaa

SEQ ID NO: 1369 - DNA, 1221 bp, Unknown
  Artificiall/Consensus sequence
atgaacgatcagatacgcatccagatgatggatcacttcaccatctacatcaacgagcagaaggcggactatttggtcaacaagacccgcaagggcgtcgcgctgatggagtatctgattctgcatcagggtcagcccacgcccaactatcgcctgctggtgacgctctggtccgaggacaagagcgccaacccggagaacgcgctcaagacgctggtcagccgcctgcgcgcgctgctgaaccagatttcgccgggtctgggcaaatgcatcgtggccgaccgcggcgcgtaccactgggagacgctgccgggcatgacggtggacgtgttcgaaatcgagcagattttcgacgagctggcggagaagaaggacgaccccgaggcgaaaaaggcgctgtattcgcggctcatccgcctgtatgtgggcgatcttctgcagaacggcgagcagaacgagtgggcgctggcgaggggcaccacgctgcacaataaatacatgatggccatctactcctacatcgacctgctcaagcaggaggaggactacaaggagatcgtcaacgtctgccgctcggcgctggacgtggacaacttcgacgaccggctgcacatggagctgatgaccgcgctgatcaagaccaaccgctccaacgaggcgctggtgcagtacaagcacgtgatgcacctgaactaccgctatctgggcgtgcagcccagcgaggacatgcaggagttctacaagcagattgtgcgcgcgggcaagacgctggacttcaatctcgaggccatccgcagcgagctgcgcgagagcggcgagcagcgcggcgcgttcgtctgtgaatacgccgtgttcaaggagatcttcaacctccagatgcgcaatctcgagcggctgggctcgaccatgctcctggcggtcatcatggtgggcaatcccgacgaccccacgatgaacagcatcaagcaggacaatatcatgaacggcctgctggagatcctgcgcgacaacctgcgaaatggcgacaccatcacccacttctcccccaccatgttcgcgctgctgctgcccacggtgaattacacgacgggtaacatggtgatggagcgcgtgaaacggctgttctaccgcaagtacccgaattcgaacattccctttgcctatcgcgtcggcccgctgaacacgaaggtcgatgtgagcgacaatgcggtggaaaattga

SEQ ID NO: 1370 - DNA, 1980 bp, Unknown
  Artificiall/Consensus sequence
atggcctattcttacgaagcaagcaacgacgctgcctatatcaaggccaaaaagcttggcagcaaggcctatcacgccgcggtgcagcggcacgaaacgccctatcttccggtgctggacgaggttgcgcccgacaacctgtcctatccccacgtcaatctgggactggtgaccattcccatggatcgcgtggtgggcacgggcacccggggccgcaccaacgccttcgcgtgcaatttcatgcccatgctggaggagggcagcgagttctccggcaagtggtcgcacctgtacgccagcgtcgtggaaaacggcgtgcgcgagcccatcaatgtgctggagtacatgaacaaatactacgtggtggagggcaacaagcgcgtcagcgtgctgaaatatctcggctcgcccatgatggaggccgaggtcacgcgcatcatcccgccgcgcacgggcgaaaaggaaaacaacatctactttgagttcctcgatttctacaaggacactcagatcaactacatatggttctccgacgagggcggcttcgcccagctctacgacctgacgggcaagaccccgggcgtcaaatggacggccgaggagcaggcggacttccgcgccgcctacacccgcttcagcgaagccttcgagctggccggcggcgacctgctgaagatcacccccggcgacgcgtttctgatctatctgaaggtctacggctatcgcaaggaatccttcgccgtgtcctctgagattcgcaccaacctgaaccggctgcgcaacgaattccgcgccaaggctcaggaggaatccatctcgctgctgatgaccgccgacggccagaagccgggcctgctgaacaagttcatctactccggccccagcaagatgcgcgtggccttcgtcaaccgccgctcgccggaggtctccggctggacctactggcacgagctgggcaagaaccgcatcgagaccgtgttcggcgacaaggtggagacccgcatggtcaacgacgtgacccccgagaactgccagcagaccatcgagtctctcatcgccgagggctccaacatcatcttcaccacgtcgccggtgctgctggacggcgccatgaaggccgccgtgcgctatcccgacgtgaagattctgaactgctcgctgctgcccagctaccacaccgtgcgctcctactacctgcgcatgtacgaggcgaaattcgtcatcggcgccatcgccggcgcggtgtgcgaaaacgaccgcatcggctacatcgccgactacccggtctacggctcggccgccagcatcaacgccttcgcgctgggcgcgcggctgaccaatccccgggccaaggtctatctggagtggtccaccatccgcgaccacgacccgctggaatccctgaagcgcaatggcgtgcgcgtgatctgcaaccgcgacatctccgcgccgtcccatcagtccatggaattcggcctgtactccattcagggcgaaaccacccggaaccttgccatgccggtctggaactggggccgcctgtacgaggatctgctcaggcgcgttcagagcggcatgtggcgcaccgacgcgctggtcaacggcgcgcaggccatgaactactggtggggcatggactccaacgccatcgacgtgttctattcccacaagctggatgtgggcacgcgccggctggccgatctgctgcgccatcagctgcgcgacggcgcgatgaagcccttctcggagaccattctctcccaggacggcacgctgcgctgcacgcccggcagcaccctgacccccgcggaaatcatctccatggactggctggccgacagcgtaatcggctccatcccgtccgccgaggagatgaagcccgaagcgctgcccttcgtggaaatgcagggcattcacagcatcaaggcgcccgacgcttccgacatctgctggaccgatcccgccaaggatggagactga

SEQ ID NO: 1371 - DNA, 2265 bp, Unknown
  Artificiall/Consensus sequence
atggatattcaaaaaatcatctctcaaatgacactggaggaaaagacggcgctgctcaacggcaaggatttctggcatctgaagggcgtggaacggctgggcgtgccgtcggtgatggtgacggacggccctcacggactgcgcaagcagcaggcgggcgcggaccatctgggactgaacgcgtcggtgccggctacggcctttcccacggcgtcggccacggcatgctccttcgaccgcgagctgctctatcagatgggtcaggcgctgggcgatctgtgtcaggaggaggacgtgtccgtcatcctcggccccggcgcgaacatcaagcgctctccgctgtgcggccgtaacttcgagtacttctccgaggatccctatctgacgggtgagatggccgcggcgcacatcaggggtgtgcagagccgcaatgtgggcacgagcctgaagcacttcgccatgaacaatcaggagcatcgccgcctgagcgtcagcgtggaggccgacgagcgcaccatgcgcgaaatctacctcaccggcttcgaaaaggccgtgcgtcaggccaagccctggacggtcatgtgctcctacaacaagatcggcggcgtgtattccagcgagaaccgctggctgctgcgcgatctgctgcgcggcgagtggggcttcgacggctacaccatgaccgactggggcgcgtgcgccgatcacgtcaagggcgtgctggcgggcatggatctgtccatgccgtcgctgggcgatgctgccgacgcggagctggcgcaggcggtgcgcgacggccgcgtgcccgagagcgtggtggacgaggccgtgaaggagatcctcatcatcgtcgaccgctatgtgaccaaccataagaaagatcccgacttctcgctgggcgtgcagcaccatctggcgcgcaaaatcgcccgggagagcgcggtgctcctgaagaacgacggcgcgctgccgctgaagagctcgggcaggatcgcgttcatcggcgcgttcgccgaaacgccgcgctatcagggcggcggcagctcgcacatcaacgcctcggagacgacctccgctttgcaggcggcgcgctcggtggcgcaggtgcgctatgcccagggctatcgcaccgacagcggcgaaacggacgcggcgctgcgggacgaggcggtgaagctggcgcaggaatccgacgtggccgtggtgttcgccggactgcccgacgcgttcgagtccgagggcttcgaccgcgcgcacatgcgcatgcccgactgccagaacgagctgatcgacgcggtctgcgcggtgtgcaaaaaggtggtcgtggtgctccacaacggcgcgcccatcgagcttccgtggttcgacagggtgcaggcggtgctggagatgtatctgggcggtcaggccgtgggcggcgcggcggtggatctgctgttcggcgcggtttcgccctgcggcaagctggccgagaccttcccgctgcggctggaggacaacccgtcctatctgaattttcccggcgacggcgaccatgtgcgctatgccgagggactgtacgttggctaccggtggtatgatgcgcggaagatgtccgtgcgctttcccttcggctttggcctgagctacacgaccttcgagtattccaatctgcgcctcagcgcagagaagctgggcgcggacggaacgctggaggtcagcatggacgtgaccaataccggcaaattcggcgcgaaggagatcgttcagctctacgtggccagcgctcacgacggcgtttcccggccggtacaggagctgaagggcttcgaaaaggtctatgtcgcgcccggcaagaccgagacggtgacgatggcgctggatcgccgcgcgttcagctatttcaacacggacattcacgactggtatgccgaggatggcgcgtatgagattcgcatcggcgcgtcctcccgggatattcgcctgacggcgaaggtggagctgaccggcgcgaagccgctgccggtgcgcgtcacggcggacacgaccatcggcgacctgatgcgcattcccggtgcggataagctgatggcaaaggtgatgggcgcgatgggcggcgccttcggcggcggagacacgccggatctgggcgagggcgcggatgcgatgatggcggcgatgattgagggtacgcctctgcactcctgcaagtcctttacgggcggcgcgttcaccgacgagatgatgaacggcctgatcgacgcgctgaacgaaatgcagaagtaa

SEQ ID NO: 1372 - DNA, 3408 bp, Unknown
  Artificiall/Consensus sequence
atggacagaaaggaactgcgggcgcagtttgagcgcccgggcagcgcgtatcgcggaaagcccttctggtcgtggaacggcgagctggagaagggcgagctgctgcgccagatggacgtgatggagcaaatgggcttcggcggattttttatgcactcccgctcggggctgattaccgagtacatgggcgacgagtggttcgactgcatcaacgctctggccgacgcgggcgcgaagcgcggcctggaggcatggctgtacgacgaggatcgctggcccagcggcagctgcggcggaaaggtcaccgaggacgcgcggctgcgcatgaagagcctgtatctctatgagcgcgatcccgcgccgtggcttgccggtgagcgcgggatggacggcgatgcggactggtacgcggcgcgcatcggcgcggacggcgtgtccatgagcgactatcgcgccatccaaaacggcgacgcggctgcggccttcgcggcgctgaccggcgaaggaaccgactgcctgctggaaatgcgcgtcgtgcccgactcgcccagcagcgactacaacggcaacacctacatcgacaccatgagcatcgaggccgtggaccggttcatcgagctgacccacgaggaatacgcccaccgctgcggcgaccgtcttggcgcgtccatccgcggcatcttcactgacgagccccatcgcggccacgcgctggacaacaccaggaccgagccggacggcacgcgctcctgcgccgtgttctacaccgacgacattttcgacgagttccgccggcgctatggctacgacgcgcggccgcgcatgcccgaggtgttctatcgcctgcacggccgccccatctcccgcctgcgcgtggactacttcgatctgggctgcaatctgttcaacgagcgcttcatcggccgcatcgacgactggtgcacccgccacaacatcatcctgaccggacatgtgctgcacgaaaacagcctgtccaatcaggcgattcccaacggctcgctggcgcgcacctacgagaacatggcctggccgggcgtcgacttcctctgcgaggacgagcgctgctactggatcgccgtgcagtgccgctcggtctgccgccagcagggcaagaaatggatgctgtccgagctgtacggctgcacgggctggcggtcggatctgaggatgtacaaggtgattggcgactggcaggcgctgctgggcgtgaacgtgcgctgcccgcacctgtcgtggtacaccatggagggccagagcaagcgcgactatcccgccagcatctcgtatcagtcgccctactggcgggattttgccgagctggagacctatttcgcccgcttcggcctgatgatgagtcagggcgagccgctgtgcgacacgctggtgctcagccccatcgagagcgcatggggccttgcccacatcggctggtcggagtggatcttcgccacagcggcggacgaaagggcgctggagcagcgctacgccgacgtgttcaacgaactggcgggcgtacatctggacttcgactacgccgacgagcagacgctcaagcgcatggccagcgtggagcgcggcggcgacggcgtgttcctgcgcgtgggacaggcgcgctatcgtcaggtgctgctcacgggcatgctcaccgtgcggtcgagcacgctgcgcattctccgggaattcctcgccgccggcggccgcgtggcgctggccggagagcttccgggctatgtggacggagaaccgtcggacggctgccgcgcgctggaggccgacggcgcggaaatgctgcccgagaccggctttgccggggcgctgacccggggtgaaaactgtcccatccactgcacggccggttcgcaggtgctgatgcaggtgcgctgcacggacgacggctgcatcgccgcgctgctgaacaacgaccgcgagcatcccaccgaggtcttccgcgtggaaggccccgagggctgtcaggcgcaggagtgggacatgcgcaccggcgcgcgctatgccgcgggcgcggaatttaagctggagccggcgggcacgctgctgctggtgtttacccgcgaggcggaggatctcccgcgccgggaggaaccggcgcagagaaagaccgtgcgcgcgctggccgacggcgaatatggttaccatctggacgaacccaacgtctgcctgctggatcaggcctcgtggagctttgacggcggcagcgtggaaaacggcgaaggacagcccaacggctgcttcagcggcgatgcggaggacggcgaaggacagcacgaccgctgcttcggcggcggtacggagcaggccgccgccgcgcgctgcgaaggtcgcttcgatgtctccgcagagaacgaagaagggcggtcggcgcgctccggcggcggcgcagagcaacccgacggccgcttcggcgatggtgcggagcagcccaatgcccacttcagcgctggtacggcgcagcccgctgccgcgtgccgcaaagatcagcccgaccatcccaatgaccgtttcgccgtggagtatcccgccgaggaggtgctgcgcgtggacgggcgcgtgcgcgatctgctgggcgtcgagcgccggggcggcgcgatgctccagccgtggtttgcgaagagcgcctatgcgcagccctacggcacgctgcgcctgaggtatcgcttccggtgcgagacgctgcccggggggccggtgttcctcgccggagagcgcccgcgggagcagcgctgcagtctgaacggcgttgcgctgcacgcgcccgacctgaacgactggtgggcggacaacgcctttgtgaagacgcccgtgcccgagggcgcgctgcgtctgggcgaaaacgtcgtggagatcgaggtggaatttaagcgcaccaccaacgtggaggcgctgtatctgctgggcaatttcggcgtgcgcgcgggcgcggactgcgtgaacaccgtcacatcgctgcccgggacgctgccgctgaacggtacggcggaaaggggcctgcccttctacacgggccgcattacttacgaaattccggcttcgcgctatgccgattgcgtggacgaaagcgcccgccgggtgaagctgcgcgttccccgcgccgtgggcgcgctgaccgcggtggacgacggcaagcggacgcagcgcctgttctgcgagcccttcgaggccgacgtgaccggcgcggtgcgcgcggggcggacgctgaagctcacgctggtgaacacccggcgcaacgtgttcggcccgatgcacgtgctgcccgccgagtgccgcgtctgcggcccggagcacttcgtcaccgacggcgaccagtggagcgacagctacaccttcgtgcccgcgggattgggcgaggtagaattcgtctccgagaaatag

SEQ ID NO: 1373 - DNA, 1986 bp, Unknown
  Artificiall/Consensus sequence
atgaataaggggttttatctgaagctggcgctgtcgaacctcaggcgcagccgcaagttctacgcgccctatctgctggccagcgtggtgaccgtgagcatgtgctacatcattctggcactcaacgccggacacatgctggacggcatgcgcggcgagacgatcatgcgcggctacatggcgctgggcggcgtggtggtgctgatcttcgcggccatctttctgttctacaccaacagcttcctcacccgccggcggcggcaggagttcggcctgtacagcattctcggcatggagaagcgccacatcgcccggctgctgagcgtggagacgctgatgctgttcgcggcttcgctggggctgggcctcgggctgggcgcgctgctgagcaagctggtggggctgggcgcgctgaagctgattcaggccgacgcggtattcggctttgagttcgtgcccggcgcggcgaagctcacggcggcggccttcggggcgatcttcgcgctgattctgctgttcgagggcgtgcagctgcgccgcgccacggccatcgacctgatgaagagccgggagcagggcgagcgcgagccgaaaaccaaggcgctgatggcgctgctgggcgcgatcgccatgggcggcggctactacatcgccatcgtgaccgagaaccccatcaaggccaccatgctgttctttgtggcggtgattctggtcatcatcggcacctatctgctgttcaccgccggctccatcgccgtgctgaaggcgctgcgcaagaacaaaaagtactactacaggcccaaccacttcatctccgtctcgggcatgatctaccgaatgaagcagaacgccgcgggactggccagcatctgcattctgtccaccatggtgctggtgatgctgtcggcgacgatctcgctgaccatcggttccgaggacgtgatcgcgaagcagtatccccatgaaatgcagtacgcgtccatggacggggactggccgaatttctgggagacggtggacgaggcgctcaggccgctgggcgtggagccggccaacgccgtggagtacgatctgctcaccttcgccgcggcgaaggagggcggcgagctgctgctcacgcccgacgaccggatgaacccggcctatgtccgggtgctgaagtacgacgactacgccgccatggcgggcgcggacgcgctgccccggcccggacaggacgaggcgctcgtcgtgcagggcgaatggcccgaggacgcgctcaccgtgggcggctggacgctgcgcatcgccggccgcgccgacggcttcagcggagccaacgacggcatgctgtacgccgtggacatgtacgtgctcgtcctgcccgacggcgcggcgcttcagcgaatggacggcattcagcgcgaggcctacggcgatcacgcgtccgagctgcgccgctggtacgccttcgacgttccgctcacgggcgacgcgctggagcgcgccaccaccgacgtggaggccgccatcgcccgggcgggctggcccggcggcggctacagcgcctcgggcgcccgctgggcgggccgggaggatcagtacgccctgtccggcgggctgctgttcctgggcgtgttcctgggcatcctgttcgtcatggccacggtgctgatgatgtactacaagcagatttccgagggctacgaggatcgcacgcggttcgagatcatgcagaaggtgggtctggatgaccgggagattcagcgcagcatccgcagtcaggtgctgaccgtgttcttcctgcccctcgtcgtggcgtgcatccacaccggcggcgcgttcttcatcgtgcgccgggtgatgatgctcttcagcctgaacaacggcccgctgatgctgaagtgcacgctgggcaccatgggcgtgttcgcggccttctacgccgcgacctacgccgtgaccgccaacgtctactaccgcatcgtcgcgcgcagcgcgcagtga

SEQ ID NO: 1374 - DNA, 1602 bp, Unknown
  Artificiall/Consensus sequence
atgaagaaatttgtggttcggttcctgagcctggtcatggccgcactgatggtgcttggctgtgccgccttcgccgaggaggattactccggcaaggttaccatcagcctgtactccggcaagggcgtcgaagaggcgtggcgcgcggtgggcgatgcctacaccgccaagcaccccggcgttgaagttgttgtcgacctgaagccccaggacagctacgcggactgggtcaaggccaccttccagggctatgacagccagctccccgaggcggacatcgtgtacggcaacctcgccggcaacgaccgcgtcgataaggtcatcaacttctacgattacgcttatgatgagagcgcctactccgacggcgactggaccgagcagatcgcgttcgacatgcagaacatcgacatggtgaccggcatgtgggactgcgtctccatcaccggcgttcaggttctgtggttctacaatgtcgacatcttcaacgaggtcggcgttgaggctcccaccacctggagcgagttcgtggacgtctgcgcgaagctgtccgaggccggctatcagcctctggccgttgcgggcgacttccagtccttctgggccgagcagatgggctggctggcgcaggcttacgccgatcagaccacccgttcccagatcgaaatcatccgcgctcaggaaggcgactactgctacgatcccgacgtggacggcaagttcgtctatgatcccaccgatccccacaacgacgacactcccgcgaacgtcaacatcaacgccgttcgtttctggaaggccttcgtcgaggacggcaccatccgcgcggacagcgacggcatgaagaccgtctggtccagcttcgctcagatcttccccacctacgccggcggtgagaacttcttcggcaccgacgccaacggcgcgaagaccctgttctatcagggcaaggccgcgatctacctcagcggctcctggttcttcggcgattacctgaacaccatggcttccatcgatgcgggcgaagcggtcaccatcggtgacggcgacgcggcggtcgagctggaaggcctgaagaagttcgcgctcggcaccttcgcgatgcccagcatggaaggcgaaggcatcgaagccaaggcccgcaccatcgaggttgccaccggcttcctgtccgccatcaagaaggacatcgaccacgacgaaatggtcgtcgacttcctgaagttctacacctccgccgaaggctactccatcttcctcgaggctctgatcgaaaacggcggcgtgccggatggcctgcccttggtcaagggcgttgagctggaaggcgagctggctgagatgttcgccaacatcgagtacatcggcaactgccagaagggcttctgccaggctctggcccgcggcatcggcgacaaccaggaagctctgcgcgcctggtacggctactccatggatctgctcaacggcaagatcaccgtggatgagtgggccgagcagcatcaggccaaccagctgaagtacgctcccgaggtcatggaatcctccaagatctccatgaacgatctggccaacccccagaacgagccctccggcaactga

SEQ ID NO: 1375 - DNA, 1740 bp, Unknown
  Artificiall/Consensus sequence
atgaagaagcagaacacaggcacccttcgacgggtgctgagcgccatcgggcgctacaaggctccggtgttcgcgtccttcgcgctggccatcgtctcggtggcgctgacgctgctgattcccgtgctggcgggcgaggccatcgaccagatcgccgacacgggcgtgcatttcgacgccatgctgcccatcctgacgcggattctcctctgcgccggcgcggccagcctgatccagtggctgatgaacgaggccaacaaccgcgtgaccttctcggtggtgcgggatctgcgcgagcaggcgctcaaaaaaatcgagtcgctgccgctgtcctatctggacagccatccccacggcgagatcgtcagccgcgtcatcgccgacgcggacgccttcgccgacggtctgctgatgggctttactcagctgttcaccggcgcggccaccatcttaggcacgctgggcttcatgttcgcaaagagcgcgcccatcgccgcggtggtggtggtcatcacgccgctgtcgctgttcgtggcgcggttcatcgcccggcgcacccacgacatgttcctgcttcagtccaagacccggggcgagctgaccgcctacatcgacgagcacatcggcggcgcgaaggtggtcaaggcctacggccgggaggagaaatccctccgggaattcgacgagatcaacggccggctcgagaaatgctcgctgcgcgccacgttcttttcgtccatcaccaatccggccacgcgcttcgtcaacgccgtggtctacgtgggcgtgggcctgaccggcgcgctggcggcgctgtccggcggcatgaccgtgggctcgctgacctgctttctgagctacgccaaccagtacaccaagccctttaacgagatctccggcgtggtgacggagcttcaaaatgccatcgcctgcgcggcgcggctgctggagctcatcgacgcgcccgcccagccgcccgagccggaaaacgccgtgacgctggaaaatgtgcgcggaacggtggcgctgaaggacgtatgcttctcctatgtgccggagaagaagctcatcgagaacttcaacctgtccgtccatcccggccagcgcgtggccatcgtcggccccaccggctgcggcaagaccacgctgatcaacctgctgatgcgcttttacgacgtggacgcgggctcggtctcggtggaaggcgaggacgtgcgtcagatcacccgccggagcctgcgctcgtcctacggcatggtgcttcaggagacgtggctcaaggcgggcaccatccgcgagaacatcgccatgggccggcccgacgcgtccgaggacgaaatcgtcgaggccgcgaaggccgcccacgcccattcgttcatcctgcgcctgcccgacggctacgacacggtcatcggcgaggacggcggcatgctgtcccagggccagaagcagctgctgtgcatcgcccgcgtgatgctgtgcctgccgccgatgctgattctcgacgaggccacgtcgtccatcgacacgcgcaccgagctgaagattcagtcggccttcgcccggatgatgcagggccgcaccagcttcatcgtcgcccatcgcctgtccaccatccgcagcgccgacgtgattctcgtcatgcgcgacggcagggtcatcgagcagggcagccacgaggagctgctgaaacagaacggcttctacaaggagctgtatctggcgggacaggcggaatag

SEQ ID NO: 1376 - DNA, 1983 bp, Unknown
  Artificiall/Consensus sequence
atgaagaagcttctggcctgtttcctcgctctgatgctggcgctgaccggcgcggctctggctgagccggcagacgctgcggcgacgccggaacccgtggtcgtcacgggcccgatctatcccgccgacgagctggtcgtcggcgccaccaccgccctcagcggcaatttcttcaacgaaatgtggggcaacaacaccagcgatctggacgtgcgcatgctgctgcacggctacaatctggtacagcgcgagtacgagaccggcgtgttcgtcgtggacgactcggtggtcagcggcctggtcgtgaccagggaggacaacggcgaccgcacctacacgctcgagctgtacgacgacatgacctattcggatggaacgcccatcaccgcgaaggactacgcgttctccatcctgctgtccatggccccggaaatggaggccatcggcgcggccaccaacgcttccaaccacatcgtcggatcggatgaatacaaagccggcacggcgagcgcgctggcgggcctgcgcgtgctcagcgacacgcagctgtccctgcgcgtgaaggcggagtacctccccttcttctacgagctgggtctgctgaactacacgccctgccccatttccgtcatcgctcccggctgcgaggtcgcggacgacggcgagggcgcgtacattcgcaacatcgattccactgtgaccgagccgatcttcaccgccgagctgctggaaaagacgatgctcgacccggaaaccggctatgtgtcccatccttcggtggtcagcggcccctacaccctgacctcctacgacgcggacgcgcatgtggcggaattcgccatcaacgaagcctacaagggcaactccgagggccgcaggcccaccatcgccaggctggtctataagcaggccgagaacggcgacatggtggatctgctgagcagcggcgagttcggcctgctgcacaaggtcgtcaacagcgataccatcgattccggcatgcagctcatcgccggcagcgacgcctgcgccatgagcagctatgcccgcagcggcctgagcttcttctccttctgctgcgagcaggcgggcgtgagcagcgccgccgtgcgtcaggccatcgccagctgcctggacaaggacgcgctggtgaccgactatgtgggcgtctacggcctgcgcgccgacggctactacggcatcggccagtggatggtgcagctgctcaacggcaccaccgtcatccccgagggcaagttcaccgacgaggatcaggccaaactggacgagatctcgctggacgatctgaagaagtacgacctcgatctggacgcggccaacgcgctgctggacggcgacggctggacgctcaaccgcgagggcggcgaatacaatcccgagaccgacgacgtgcgctgcaaggagatcgacggaacgctcgtggcgctggatctgaagctgatctatcccgagggcaacgccatcgccgacgcgctggacgagaccttcatctccaacctcgcgcaggcgggcattgcgctcaccgccgaggccaaacccatgaccgagctgctccagctctactatcgtcagcaggagcgcgactgcgacatgatctatctggccacgaacttcagcacgctgttcgatccgtcggccaccttcgatccgtccgacgcgttccagggcgtgaacaatcgcaccggcattgccgacgatgagctgtatcagctggctgtggacatgcgcaagaccgagccggccaacgtggcggaatactgccagaagtggatggccttccagcagcgcttcaccgaggtgctgcccatgatcccggtgtactccaacgtctactttgacttctacaccgacacgctgcaggactacaccgtcggcgaggacgtgacctgggcgcaggccatcgtcggcgcgcgcctgagcgacgcgatgcccgagacggatgaaacggtcattgcggactga

SEQ ID NO: 1377 - DNA, 1140 bp, Unknown
  Artificiall/Consensus sequence
gtggccactactacacgtaccatcgcgattccgcagcagcttgacccggtgaccgtgctcggaccggtcgacgaggtccttcgggaagtggaacgtgcgttccccgacttgaccattatcgtcagaggcaaccgcatcgcgatcatgtcacgttccagcaaatccgaatcccaagccgcacaggccgagcatgtgatcgaaaacatcatccaagccgcatatacggctccgatggacgccgatacggtgcgacgcatgctcgatcaaaacgtgttgaaaaatcctgtgcgtgctactcgcccgggccatggacgtgtagtggaggaactacggctggccgatcggcaacaggagcatacctccaatcgcgagaatcatgcggaccgacgcaaaccgcatgtgcccggagtgatcacctttgcgctcggcaagccggtgcgtgccaaaacggctggtcagatcacatatgtcaatgccatcgaatcacataccatcacatttgccatcggaccggcaggcaccggcaaaacataccttgcagtggcgaaagcggtacgcgcattccaagataggcaggtgcgccgcattatcctgaccagaccagccgtcgaggcgggagaaaaccttggttttcttcccggtacattgaacgaaaaagtcgatccatatctgcgtccgctatatgatgcgctttctgacatgctcggggcggaccagctcaagcgctacatggacgacggcaccatcgaagtcgcaccgctcgcatatatgcgtggacgcacgctcaacgatgcattcgtgatcctcgatgaagcgcagaacaccaccgaacaacaaatgaagatgttcctgacccgactaggcttcaatacgaaaatgattatcaccggcgacgtgacgcaggtcgatctgacagtaccgaaatccgggctcgccaccatcgaacgcatccttgacggcattgacgacatcgcattcgcccacctcaaaccggaagacgtagtgcgacacgcgcttgtcggcaaaatcgtcgcagcgtacgaccggcacgcggccattgccggcgaccacagcagacacgccacgggcaaaaccacatccaggcaaacaagcgagcaaatcgaaaggaacgctgaatga

SEQ ID NO: 1378 - DNA, 1305 bp, Unknown
  Artificiall/Consensus sequence
atgccgcccctaccggtcagcagggaaaaggaattccaaaatgtgctaaaaggctgttgtttttcgggcgggagggatagcatggcaaacatgactatggctgactggcagactctttccgaacgtattaaccgcgtggctccgagcgctactctggccgttgattccaaagcgaaagcgatgaaagctgaaggaatcgacgtcattggatttggtgcgggcgaaccgaactttccgactccggctgcgatcgtcgcggctgcggccgaagcggtgcaggatccgaagaactatcgttacactccgacggcaggtttgccggaattgcgcaaggcgatcgcagacaaaacgttgcgcgactcggggtatggagtcgatccgaatcaggtgatcgtaaccaatggcggcaagcaggccgtgtacgaatcctttcaaatcctgctcaatgatggcgacgaagtcatcattccgacgccgtattggacgagctatccggaagccgtgaaactggctggaggcgtgcctgtcgaagtgttcgcgggagctgaccgcaatttcgagccaagcttggaagacctggaagcggcacgtaccgaacgtacgaaggccatcatcgtgaatacgccgaacaatccgacgggtgccgtgtggaatccggaaaccgtcaaggcgatcggcgaatgggctgtggaacaccatgtgtgggtgatctccgacgaaatctacgagcatctgaactacgatggtgcaaaaaccacgtatatcggcgctgcagtgcctgaagtgcgtgatcagctgctggtgctcaacggcgtggccaaaacctacgctatgcccggctggcgtgtcggctggatgatcgctccgctcgacgtggcgaaggccgcatccaagctgcaggggcatatgacgtcgaacgtgaacaatatctcccagcgtgccgcgatcgcagccgtgtccggatctcttgacgccgtgtacgagatgcgtgaggcgttcgacaggcgccgtcagaccatcgtcgccgcgttgaacgatatcgaaggtgtgaactgcccgacgccgaccggcgcattctatgcgttcgccgacgtgagcgcactgctgaacaagccgctcggcaccagcaaaaccgcttatgcgagcacgtccgaactggctgcggcgctgcttgacgaaggtcatgtggcggccgttccaggcgaagcgttcggcgctcccggctacttgcgattctcgtacgcgcttgccgacgacgacctcgttgagggcatgaagcgtatgaagcagtgggtcgaggactga

SEQ ID NO: 1379 - DNA, 1566 bp, Unknown
  Artificiall/Consensus sequence
atggcgcaggaacctgaatccgagaggaacgcatcggggatcgctcgtacttcaaagcgcaagtgggggtatgattccgaacaggtggacgcttttcttgagcgtgcgcacatgctgtacgaaggtgagggagcgcaactcacccagcatgatattcagaatgtttctttcgatttggtcaaaggcggctatgtgatcgcccaagtggacgcggcccttgctcgtttggagcgcgccgtggtggacaagcagaccacatgggagatttcgcagcacggtcgtgtggcgtggaaagcgcagaccgaaagtctgttccgccagcttgacgcccattccaaacgtgagcacggcgaacgtttcaagccaggagaaggcaaggaaccgagctatgaccgcaagcaagtggatcgcatcgtcgatcagtgcctgacgaaggccgctggcgagctcggcgttgaggaagtgtcggaagacgatgccaagaaacttgtcgatctgaactcccagaccgtggcgaatgtgatcttcacccagcgcaagggcaagcgtggctatgacgagcgtcaggtggattattacctgaacgaatgcgtgcagctgctgaccagactcgaatcctatgctcgtgtggccgacttcgtgggcgagccctccgaaagcgcgatgaccgcagccaatccgtccgcaaccagtctggcatcccaagagacgcaggtggtctcgccgttattcgccgttccagccgtttccgcagaacctattgcgcagcccgctcaggttcaaaacagcactgactccttcgacgctttgaataaggcggaacgtgagattttcaccacgcctgcaacgtccccggtgagcattccggccactcaaaccgctgcgccgacgtatgctcccgtggttccgcctgtgttccagccaaccatcagcaccccgtcggctccggtaactccggcagctcctgtaacgccggaacctcaggccgctccggttgctccagcggctccggaacagtcgttggcacacctgttcaaagcgtccaatgcggttgccgaggagccatcttccgcaggaacggaaaccgaagcgttcaatccgctttctgatgatggcgcgctgagctatgacgctccggccgcgcctgcggctcctgtgattccagacacttcggtcgcacatcagccggaagaatctcacggcatcaacatcgctcccgattcttcgttggctgccttggcgcagatggcccagaacatcgacgctcccgatccggtcgaagacacgttcactccgcgcatgccaagcctgtcgacgccgaaccttccgcaggtcaataccgactcgattaatctcggaaccttgccgaccgtcccaccctccttcacgctggaaccagcaacctccgcagatcactcgacaacggcaactcccgttgaaccggcgaaaccggcagaggaagagaagaagaacgaaaccaagccggcaaccaatccgatgttcgaagcatccaacagcaatctggatgtcgatattcccgacctgtcgttcccctcttttgaatag

SEQ ID NO: 1380 - DNA, 1344 bp, Unknown
  Artificiall/Consensus sequence
atggcaggtacggcaaacaaaggggtgcgaatgggacgagtggtcagctacaacgatgaagtgtcacgatgcacgttctgcggcaaaaccgaaaatcaggtacgtaagctcgttaccggatcaggtgcggccatttgcgacgaatgcatcgaactgtgcgtcgacatcatttccgaagaacgtgtcaaagacgcccagctgaacacattgcagctgccgaaacccgcacagatcagcgcctatctcgacaactacgtggtcgggcaggaatccgctaaaagaacgctttccgtggccgtatacaaccattacaagcgcgtcaatatggaaatgcgcgaatccgcggcattgcgcgatcgtgcggcgcatgcgagcgacgatccactggccggcgtgcaggtgtccaaatcgaatatcctgctgctggggccgaccggcgtgggcaaaacgtatcttgcgcagacgctggcgaaggtcatgaatgtgccgttcgtcatcgccgacgccaccacactcactgaagcggggtatgtgggcgacgatgtggaaaccgtactgcaacggcttatacaggccgctgacggcgatgtggcgcgagcgcagcagggcatcgtctatattgacgaaatcgacaagatagcgcgtaagagcggcgagaacacgtctattacgcgagatgtgtccggtgagggcgtgcagcaggctctgctgaagattttggaaggtactgtggcatccgtgccggtggagggttcgcgtaagcatcgtgagatggagacggtgcagatcgacactcgtgacattctgtttatctgcggcggcgcgtttgtcgggcttgccgatattgtggcgcagcgtttgggcgctcgtgaaagcggatttggtgccgcgtggcatgatcatgaggtgccgaatcgtgagctgcttgcccaggcttcggccgacgatcttgccgatttcggtttattgcctgaattcatcggtagattgccggtggtgagcgtgcttgaggagcttacggaggatgatttggcgcgcattctggtcgcaccggagaacgcactggtcaagcagtatcagaagttgtttgcgattgacggggtgacgttgacgttcactgagggggcggtgcggcagatcgcggccacttcgattcgcaggggcacgggcgcccgaggccttcgatcgattatcgaaaaaaccttggaggacacgatgttccagctaccaagcgtgactggcgtatcggaggtggtggtggatgaggcgtccgtcaatggttccggcactccgaaactattgaaggtttccacggaggagattcctcgcagacgtgccgcgtag

SEQ ID NO: 1381 - DNA, 1626 bp, Unknown
  Artificiall/Consensus sequence
atggaaccaaccaaacttgaaaaacgcttaggaaaaggcagggccggcatggacgagaacgcgatccgccaatggtttatcgattgtttcggaccaattcaaggcgagatggcatggaaccagttttccaacatgccggaagagttgcgcgaccagttgatgagtcaggatgtgagcaagcttcccaagccggccgaggtcaggtcgatgatgcaggcgttcactgcgggcgggctcaacactttcggagacatccagcacatcaccgaggaaggtccaatcaacgtcaaactggcgaaatcattggcattgcagcaggccaatggcgaaggatcggaaaccagtgtgagcgcggagtacggcgagatggcccggcgagccatcagcgaggcgaatctgtggcttgacaccgcttgcgaattcaaccccgcgcaaggcgaaacgcaggtgcttacccgcgcaggctgggtggaaggatgcatcgattcctgggcgcagtttgcatccccgattgccgagtcgatgagcgacgctctggcttcgattttgtcacagcgtttcggcgattccgaattccatacggaaatttccggcattttcgccggtccggtgcagattccgattcccgatgatatgaaagatccggcaaaactcatgcgtttcgtcggcaatacgtcgttcgccatgcagctgggacgtgccgccggcgatttgtcgcatgaggtgcgcggcagtttcgaccaaagcatttcgttgctgaagaatccggctggaggcctgatcgtgcagaatgtcgtcgaatatgcgaaatccttggaaatcgacgtgaacgaagtaatgagctatcttgcactgcaagagctcgcccattcgcgcctgtacgcttccgtgccgtggctgatgccacgcttcgaggcgctgttgggcaagtatgcccgtggcaccagcatcgatttggacgccatggaggagcagatccgcgatgcgcagtccgtcgacccggattccatggccgacgcggtgaacatcaccaaggtggcgttccctgacacgcctgaacaacagcaggccatgaaatcgctggagaatctgctcgccttggtagagggttgggtagacaccgtagtgtggcgcgccggcatggctcatattccgcatatcgaacagcttcgtgagatgctccgccgcgagcgcgccatcggaggtcccgcggaacgcaccttcgaaagcctgatcggcttgcaattacgcccgaagcgcatgcgtgaagcggccgcattgtgggataacatctgcgctacggaaggcgcgcaggcacgagacgcgaaatggtcacatcccgatctactgccgcaactgccgaatgatgacgatgacaacacctcacagtcgcagaacaacggatcgccggaaaacacggaaaatacgacgttcgccgcttccaatgccaccgatatggcgtcgcagccccttggcgacgccgatggcatgaccatcgattgggatgccgaactcagcaagctgcttgacgaggaagagcacaagggcggcgaatccgataccaatggcagcgattctgacgattccgcagaatccggcagcaacaacgataccgacgccgagtaa

SEQ ID NO: 1382 - DNA, 681 bp, Unknown
  Artificiall/Consensus sequence
atatcatcgcgtaacagtaaggttgaagtcaaccgatttttggagaaggactcgtacatgactcaggctaacgacgagcgcgccgcgcgcaaacagtacattcgccgccgtcaaaaggtggtgttcaccatcaccggcaccattttgacgatcgcattggtgatttccctgctgttcttcttccatgttggaggattgggcaatgtcaagtcggccgcggtacagccgaattacggccagcaggccccttgcgcagcacaggaacaggacggcagcaaaggcaagtacgtggaaaaccgcaacatcaccgtgcgcgtgctcaacggcactgaattcgccggcttcgcgcaagccgtcagcagcgcgttgcagaaccgcgagttcaacacccaggcagccggcaactacaccagctccaaagtggaacgcacgatgatcatcttcggcaagaacgccatcaatcaggcgtacacggtgaacagcaacttcaccgacgcgacgatggtgatggacgatcgtgaggatatgctgatcgacgttgtggttggcgcgactttcgacaatctgcagaatcagaagaaggtgccgaccgccggcaaggagatcgacagcttcgagggatgcgttaccgtcgacaagatgaccgacgtacagaaggcccccgaacacgacgccgtgtga

SEQ ID NO: 1383 - DNA, 939 bp, Unknown
  Artificiall/Consensus sequence
atgactgctgttgaagcaacgcccataaccaaggaagaacaaagcaagccgttgacacttcgtgtcggagcggaacttgtgggaagcttcatcatttgcttcgcgatttatgcgatctgctcgcttggttccgcggtgtatggcattaacatggcgttcatcgccctgttgacgggcatcgtatacgccgccgtcaccgtaatcttcggttccatttccggagcacagttcaatccggccgtatccgtcgccgccatgctcactggcaaaacccacgtgcttgatggcattctgtacatcattgcccaagtgctcggcggtatcggcgcgggtgccgctatccggttccttctgccgacttccgagcaggtgacattcaagatctggatgacaccaacggtcaacggtttcgataagaattccgtctcctactccaccctcggcaattatggagtgaccctcggcatcactctggccatcgccgttgaagtcgtcgcaggtatcattatcgttgcctccgcactgcgcaccacggacggacacggcgagtccaaaacaaaccacgccgttgccatgggccttgcctacggcatcggcaccgctatcacctatccggtgaccggagccgcactgaatccggcacgtgccacgggcattgccattttcgcacagaatcaaggactgaatgaagagccgctgcaacagctgtgggtcttctggatttgccctgttcttgccgctgcagttgttgctctcgtcgtcatcgtcgccggcatgattggtacgaagaagaacgtgccggatactgtcgagacagtcgataaggtcgaaggcaataccgttcttggcgaagcgtcagttgccgacgggaacgatggtgagcaggatgaacagtcctacgcccaagccaatgccgatgaaagcgtcgaaagcaactga

SEQ ID NO: 1384 - DNA, 690 bp, Unknown
  Artificiall/Consensus sequence
gtgaacggtatggaaaagcaagaagaacgcaaatcatcgttgcttgacggctggaacgtgccgccgaaccttgtcaccttctctcgtatcattttggtcatcgtgtttttggcgctgtacgccaaagccggcgcgtggggcgtggacaacgtcaccatgcgttgggttgccgctgtcatcttcatcatcgcggcatgcaccgataagcttgacggttggatggcccgcaaatacaaccaagtcactgaacttggcaagctgatggacccgatcgccgacaagctgctcacctgcggcacactgatcgttgccgccatcttcaacgaatttggcaatccggtgctgggatgggtcgtgaccgccctgttcctgattcgtgagatcggcatcaccgtcatgcgcttctttgtgatcgacacgggcggcaaggtcatcgccgcatcccaggcaggcaaatacaagacgctctgccagtgcattggtctggccatgctcatgctgcctatgtggagcttggcgccggaaggggtcaacgacaccccgatgtggatgaccgtctactacaccatcacgtatgcgctgatttattttgcgctgattctctgcctgtattccggtggcgagtatctggtcaatacgttcggcggccgtaagaagtccgcgggcaagtccggaaaagaaaccaagtaa

SEQ ID NO: 1385 - DNA, 675 bp, Unknown
  Artificiall/Consensus sequence
atgcttgaacaagaatcgccaaacattgcgcccactcccaccctttcccagcctggactgctggtgatggatgtggattccacgctgatcgatgaggaagtcatcgatcagctgggcgccgccgctggaattggcgagcagatcgcgtcgattaccgcacgtgcgatgaatggcgaacttgattttcgcgaggcgttgcaggctcgtgttgcgctgcttaaggatctgccgacttcggtgttcgatgatgtgtatcgtcgcgtgcatttcacacagggggcgcttgatttgattgacgctttgcatgcgcatggttggaaggtcggcgtggtttccggcggtttccatgaagtcgtggaccgtcttgccgccgacgcgcatcttgatttttggattgcgaatcgtttggaagccgctgatggttgtttaaccggccatgtgcttggcgatatcgttacgaaagatgtgaaattgcagtcactgcgtgattgggcttcgcgcatgggcatcagcatgggtcagactgttgcggttggcgatggagccaatgatctgccgatgattcatgccgccggacttggcgtggcgttctgcgccaagcctgcggttcaggcggatgctccgcatcgtgtgaacgaacgtgatttgacccggattcttgattttcttcgttga

SEQ ID NO: 1386 - DNA, 1911 bp, Unknown
  Artificiall/Consensus sequence
ttgcgtcgaatatttcaagaggaggatggcgtgggccagcagcataaccagcccggtttcaccgatcagtcgttgattcgcaatttctgcatcatcgcgcatatcgatcacggcaagtccacggtggcagaccgtattctgcagctcagcggcatcgtgcccgaacgtgagatgcgtgatcgtttcctggatcgtatggatattgagcaggagcgtggcatcaccatcaaatcgcaggctgtgcgcgtgccgtggacgttcgacggcactgaatataccctcggcatgatcgacactccaggccacgtcgatttcacttatgaggtttcccgcgctctcgccgcatgcgaaggcgcagtgctgcttgtcgacgcgacgcagggcatcgaagcgcagaccctgtcgaacctgtatatggccatcgaccatgatctggccatcattcctgtactgaacaaaatcgatcttcccagcgcggaaccagacaagcatgccgaggaaatcgcaggtctgattggttgcgatccttccgaagtgctgcgcgtgtccggtaaaaccggtgaaggcgtgaccgaactgctcgaccgcattgttgccgacgttcctgcaccaaccggcgatccggaagctcccgcgcgtgcgctgatcttcgactccgtctacgactcctaccgcggcatcgtcacctacattcgtatggtcgatggcgagttgcgttcccgtgagaaactgcacatgatgggtatcggcatgacccatgatccgattgaaatcggcgtgatcagcccagacatgatgcctacgaaggcgcttggtgcgggtgaggtcggttatgttatcaccggcgcgaaagacgtcagccagtccaaggtgggcgacaccatcacttccgcgctcaagcctgcggccgatccgctcgaaggctatcgtgacccgcagcccatggtctacgctggcctgttcccaatcgacaacgcgcagtatccggaacttcgtgaggcgctcgacaagctcaagctcaacgacgcggctttgatctacgagccggaaacgtccgtggcgttgggtttcggtttccgctgcggcttccttggcctgctgcatatggaaatcgtgaccgaacgactgagccgcgaattcgatctcgacttgatctccaccgcaccgaacgtgccatacgaggtcaccgcggaagacaattccgtgcatcgtgtgaccaatccgagcgaattccccgacggcaagatcaagcagatcgtcgaaccggtggttgccgccgacatcatcactccgaaggaattcatcggcgcggttatggacttgtgccaggaccatcgtggacagatgggcactatggaatatatttccgccgaccgtgtggaaatgcattatcgcattccgttggccgaaatcgtgttcgacttcttcgaccagttgaagagccgcaccaagggctatgcgtcgctcgactaccatgaggacggcgaacagtccgccgatctggtgaaggtcgatattctcatccagggtgagaaggtcgatgcgttcagcgccatcgtgcataaggataaggcgtattcctacggcgtgatgatgacgaagaagttgcgtgagctcattcctcgccagcagttcgaaattccgattcaggccgccatcggctcccgcattatcgcacgtgagaacattcgcgcactgcgcaaggacgtgctcgccaagtgttatggcggcgatatttcccgtaagcgcaagctgctcgaaaagcagaaggccggcaagaagcgtatgaagatgctcggccatgtcgaggtgccgcaggaggcgttcatcgccgcattgtcgaccggagacgcaggcaacgaccgcgacaccaaagacaagattcgcgccgcccagaaaaccgaaggctga

SEQ ID NO: 1387 - DNA, 843 bp, Unknown
  Artificiall/Consensus sequence
atgagtgagttcaacaatgctccgattcccaacggcggcccggcagcgccgaacggtatgagacccgcgccgatcatgccgtccccggctccgcaaggcacgacggtatgtggcatcgtgggagtggtgttcggcgcgctcggcttggtgctgagcttcattccaatcatcaacaacatcgctgcgatcttcggactcgtcggcgcggtattggcgatcgtggccatcgtgggcacgttccgaggcaaaaagcgtggcaaagccctgtccatagtcgcggcggtgctgtcggtgttggccatcgtcatcaccttggccatgcaatcggccgccagcaaggcgcttgacgacatcacgggcacaagcacgtcgcaatcctcgtcggcggacgccgataaggacgccaaaaccgatgattccaccaaaaccgatgattccaccaaaaccgacaccaaggtgaaaggcgagcaagacatggaaggcgatctcaccgatatgcacgtcaaaatcgtatccgcagtgcgttccggcaacgactacaacaatcagccgaccgtgctcgtcacctacgagtggaccaacactaccgataagaacaactccttcgccatgctggctaatccgaaagtgttccaaaacggtcaggaactcgacaccgccatgtacttggacaatccggaaggctacgattccggctcctatctgtctgaactgcagccaggagcaaccggcacggtaaccctcggatatgtgcttaaagacgattccgaaatcaccgtcgacgtgacgaaccttctcgatttcagcgacaccgccaaagtgacgtacaagttcgccatctga

SEQ ID NO: 1388 - DNA, 1350 bp, Unknown
  Artificiall/Consensus sequence
atgacacgactgattcttgatgtggacaccggtatcgacgatgcactggcgttggcataccttgcgacgttcgacactgttgacgtgcttggcgtgatcggcacgtacggcaatgtttccgtcgacactgcggttcgcaatacttcgtatgtgctggaacggttggggcttcggcacattccggtgatacgtggatcgtcacatccttcatgggctcggtgtttcattccggatgcaggttgtgcgcagtttcacggcacggacggattgggaggattcggcccggcttgcgatagttcgtcttcggatactgctttttcagatattttttcggataattccggttctgatactgttttttctcgtgattatcgtagtctgatttccgttggcggatatgcgttggatgatgttcatgcgaatcctgcggttgattcgtttgaattgtcgcttactacggattcggcttcttttattcatgttgatgattcttccgccgactcggtttccgaaggcgtgcagttcattattgatcaggttcgcgcttatggtttcgacgtcactgtggttgcgaccggtccgctgaccgatattgatgctgcgatcgcggccgcaccggatattgccagcaaactcaaactggtgatgatgggcggcacgttgacgcaggaaggcaactgttgggatctgactgcggaaacgaacatcattcaggatccggaagccgcagatcgcgtgttccattccggtgccgacatcaccatggtcggcttggacgtaacgcatcaatgcctgatgggttccgatgcgacccgtgcttggcgcgaagcagcgaatgctgacacacttaccagctcgaccgcatcccaagtcgctgattcacttgatggttcagctggtagttcaaatgcagcttcagctcgaacctcgagtgtggctgcaagcccatctgcttccgatgtgcgcgtattcctcgccgacatggctgatttttccattgccgcaaacctcaaggccgacgcgcgactgttttcacagggcatgccattgcatgatccgctggccgccgccgttgccgtggacccgtcgctggtgacctgtatcgacctaccaatgaaagtcgaactcgaaaccggcgatttccacggcacccgaggccgaaccatcggcgatcccgccggactgatcgactccaacgcaccccgcatccacgtagccttccacgtcgactcctcccgtttcgtccccaccttcaccacccgaatcagcacgttgcaacaaacaaaacggggagaacattatgctctccccgcagttaacctaatcaactcagcaaaaactactttttga

SEQ ID NO: 1389 - DNA, 798 bp, Unknown
  Artificiall/Consensus sequence
atggcatatgcgttgataacgggggcttcgagcggtattgggcgcgaaatgacggcattgtttgcggccgacggacatgatctcatcattacggcacgcagtcaagacaaacttgatgacgtgaagcgcacgctggaacatcgctatggcgtgcatgtggagacggttgcgcttgatctaagcgagtctgacgcaccgcaacagttgcatgattacacagtttcgcaaggttttgaagtggatcgtctcgtcaacaacgccggttttgcggattggacgggttttctcgacgctgactggcatcgtcagcatgagatgatgcagctcaatatggccgctttggctgaacttacgtaccgttatggtcgtgatatgcgcgagcagggtcacggacgcatattgaacatctcttctgttgcttcaatgatggctggcccatatatggcgatgtatttcgcgtcgaaagcgttcgtacgatcgctttcggaagcagtgtcgcacgaattgcgagataccggtgtgagtgtgacttgcgtatgtcccgggccgacatccacagggttcgccaaggccgcgaacatgcatggcatgaatttcttcacgctgaccaaaccggccaccgcctaccagcttgccacctacgcgtatcggaagatgaagcaggggcgcacgcttgcctaccacggctacctcaccaaagccggagccgcagcggaacgactactcccccgcgctctgacgcgacgggtcgccgcaatcatgaatggcggcaaccctcgcaaccagcatcgcaagtaa

SEQ ID NO: 1390 - DNA, 942 bp, Unknown
  Artificiall/Consensus sequence
atgtccaagaaaatcatccttgattgcgatccgggacatgatgacgccgtcgccatcctgcttgccgtgggcaatcccaatatcgatctgctgggcgtcaccacggtaggtggcaatcagagccttgacaaggtgacctacaacgcccgtgcagtgctggaaaaggcgcatgccaccgacgtgccggtgcatgccggatgtgaccgtccgctggtgcgcaagcaggaagtggcagcttccattcacggcgaaaccggtcttgacggcgttgaactgcctgaacccagccgtccgctggaagccggacatgccgtcaactggattatcgacatcattatgagcaacgagccaggcaccatcactctggtgccgaccggaccgctgaccaacattgccatggctgcccgcatggagccgcgcattgttgaacgtgtcaaggaagtcgtgcttatgggcggcggataccatgtgggcaactggagtgccgtggccgagttcaacatcaaggtcgatccggaagccgctcacatcgtgttcaatgaagcctggccgatcaccatggtcggattggatctgacgcatcaggcattgtgcacgcccgaagtgcagcagcgtatcgaaggcgttggcactgatctcgccaagttcgtgtctggtctgatggacttcttccgcaagacctatcaagacaatcaagatttcatcgatcctccggtccatgatccgtgcacggtggcatacctcattgatccgagcgtcatgaccacccgtcgttgcccggttgatgtcgaaatccatggagatctcacacttggcatgaccgtcgccgacctgcgaggtccagagccgagcgccgaagaatgccacacccaggttgcagtcaagcttgatttcaacaaattctgggatttggtaaccgacgcaatcaagaccatcggctga

SEQ ID NO: 1391 - DNA, 1566 bp, Unknown
  Artificiall/Consensus sequence
atgggcacggaaacggaatacgcggtttccgctctcggaatggagcattacaatccggtgaagctatcgttcgatgtggtcggtgccgcggcgaacgaacaaaccaagcatattcgctgggactatcggcaggaggatccggtcaacgacgcccgcggcaccaggctggaacgtgcatccgcgcatcctgatctgttgacggacgcgccgcagctcaacatcaccaatgtgattgcagtcaatggcggccgtgtgtatgtggatcatgcgcatcctgaatattccgcgcccgaaaccgatgatcccttcgatgccgtgctctacgaccatgccggcgatctcatcatgcgtgagtgcgcgcgcaaagccagcgaacagaccggtatcgcaatcgcgctgcaccgtaataatgtcgacggcaaaggtgcaagctggggcacccacgaaaattatatgatgctgcgttcggtgccgtttgaccaagttgcgaaactcatgacggcacattttgtagcgagacagatttttaccggatcaggtcgcgtcggtatcggcgaacgaagcgaaaccgccggataccagctcagccagcgcgccgactattttcatatgaaagtcggtttgcagaccacattcgacaggccgatcatcaatactcgagacgaatcgcacagcacggatgcataccgtcgattgcatgtgattgtcggggacgccaatcgtatggatgtgccgcaggcgctgaaactcggcaccaccagcatgctgctgtggctgcttgagcatgccgaagaggcgggattgaacatagacgaagcgttggggccaatcatgctcgccgatccggtgagcgccatgcacgaggtgtctcatgatttgacattaggtgccatgttgccgctggaatatggcggcgagacctcggcatggcagattgaggtcaccctgcgtggcttggtgtatgctgccgctgccgtgatctatggaaccgacacgtccggtgaaccggcatggtctgaccgttcgacccgtaacatcatggcgatgtgggggcaggcgctcgccgatgtggctgccatcaggcatgccgatgatgatgcgcgtttgacgatgcgcgagcaagctggccgcattgaatggctattgaaatggcagttgttggagaagctgcgtcgtaaaattggctccggttgggatgatgcgcgtattgcggccgtcgatttaaagtgggctgcgattgatcccgctgactcgattttcgatcggttgcgtgcccaaacggaacgcctggtcacggacgagcagttggaacaggcttcggtggaagcgccttccgatacccgtgcttggttgcgtgccgaaatgattcgtcgttttccagaacaggttgtggccgcatcgtggtcgcatcttacggtgcgccatcgaacgattggtgataataccgtggagaatccgatggtctcattggatatgtcagaccctctgaaatatagcaaatctcaatgttcccgctattgtgagcgtgtccaagatgcggcgtcgattttggaaatgttacggtga

SEQ ID NO: 1392 - DNA, 663 bp, Unknown
  Artificiall/Consensus sequence
atggttggaatcatgattacgcccgcagaccttgcacgcatgcttgcccatgctgcggacgaccatgcccaaaatccgatggaaccggacaaactgctgtacacatcgcagtccgtttccttgcggcaagagaccatcatcacgcccaacgcacccaccccggcaataatgccgcagcggcgcgccacggacggtccgaccacgttcgcctcgctcgacgcgcaggaactgccggtagtgcgcgaatattcggcgggaggtctcgtattcgacgacaagggccgtgtggcgatcatcgcacgccactcgcgtagcggacatttggaatggtgcctgccgaaaggtcatatcgaaaaaggcgaaacaccgcagcaaaccgccgttcgcgaagttcacgaggaaacaggaatcctaggtgaagtggtcgattccatcgccaccatcgactactggttcaccggaaccagccagcgtgtgcacaagctggtgcatcatttcgcattgcgtcagatcggcggcgagttgacggtggaaggcgacccggatcatgaggcggaagacgcgatttgggtggattttgctgatttggacgacgttctcagctacccgaacgaacgaaagatagcatggttgtacgcaaggaaactcaacagacaggcgtga

SEQ ID NO: 1393 - DNA, 1245 bp, Unknown
  Artificiall/Consensus sequence
atgtgggcgtgcgaacggtggaatgcgtgcgcccactttttctgcctgaaaaccaatgatccgatcaacgtatctgcaatatccgcaatatcagcaatcaaacaatattgcagaagattgcagatagaaaaatataaagaaagaacgacagtgataaacatacttgttgacgacatcgtgccaattattgtcattatggcattagggtatatttgtggaaaattcagttattttgatgacgatcagcggcagggacttaataaacttgtgttgaatatcgcgcttcctgcggcgttatttgtgtccatcatcaaatcgacccgtgcaatgcttgcgaaagacgcaacattgaccgccatcagtttcatcggcgtcatcgtcatgtttatggtgagctattatctgtgccggttgctgttccaccgcagcattcaggaggcggccgtctgtgctctgatcgcaggatctccgacgattggtttccttggattcgctgtgcttgatccgatttacggcaacaccgtcagcacgaatctcgtcatagccattatttccatcgtggtcaacgtggtgaccattccgatcggcatgtatctgatcaacctcggccaggccaaagaccgagcgaagtttagcgtgcaggccgaaaacgcggtcaatgcaaaggccaatgcaaaaggcgatatcacgcttgacccggcgcgagatgccgcaaccgacaaaaccgccgaacttatggtgcatggcacgtcgaatacgggaaagaaccgcaatggcaatctgcaggcgttgctcgacgcactgaagcaaccgatctgctgggcgtcgttattggccattttcctagtgttggtgggcattcatgtgccaagccaggtggcgccgaccttcgatctgatcgccaaagcgaattccggtgtggccgtgctttccgcgggcctcgcgctttccacggtgaaattctcgctcggttgggaaaccatctggaacacgttcttccgcctgattctgacgcctgcagtgttccttggcgtggcgctgttgtgtggcatgggcggtgacatgaacaagatttcgatgctggtgatggcggtcgcgttgccgccggcgttctcaggcatcattatttccagccgttacaacatttatgtaaaagaaggcgcctcgaccacggccgtcgccacggtggcattcgcggccacctgtctgctgtggatctggctcgtccccttctgcgtgggctga

SEQ ID NO: 1394 - DNA, 837 bp, Unknown
  Artificiall/Consensus sequence
atgggaatcaggaaggtccgcatggcgaagcacaccggcaagcacaccggcaagcacaccgcgaaacggtcgaaagcggccggagtggcggcattccttgtgctcatgttctccggattcctgctcgccacgaacttgcgcgtgaaccgttccgtcgtggtgaccaacgacaccgccgaactcgtggaacaacgcgtgaaaaaagtcaactccctgcagacggaagtcgacgtgctcagctcccgcgtgaacgatctgagcaaaaccctgaacagccaggacgacgccgaccagcaagacagcgaaagcgccggcaacggcaccatgctgccagcggtggaaggccccggactcgtggtgacgctcgacgattcaccactctgggaaaacatggtcgattccagcggctccacctccaacatcaacgattacgtggtgcaccagcaagacgtcgaagccgtggtgaacgcgctttgggcgggcggcgcggaatccatgatgatcatggaccagcgtgtgctgttcaattccgcagtgcgctgttccggcaacgtgctgcttttgcagggcaaaaagtattcgccgccattcaccatttccgcgatcggcccggtcgagacaatgaaaaaggcgctcgacaattcgcaggaagtgaccatataccggcagtacgtcagcgcgttcggcttgggatggcaggtcgacgaaaaagaaaaactccatttcgacgcgaccgacgcattgcaacagccgctgcaatacgcgcaggcgatgaacaacgaaacagacggatcgcagcaaacggacgaaacgcaggaatcgcaagaggggaagtaa

SEQ ID NO: 1395 - DNA, 2049 bp, Unknown
  Artificiall/Consensus sequence
atgttgagagaatttgtaccggaacctgcgtatagcactacggatgaggataccgttttcgcactgctctccagacgcgctaaacgtgatccagatgatctcatcgcccaatggcaggacgacgagactcgtcgatggcatgacgttacggcgggggagatgcttgagcgtgtgcgcgcggttgcgaaaggtcttcttggcctaggggtcaaggccggaagcatggtagtcatctattcgcctacctgctacgaatggggagtcatcgattttgcctgcgccgcaatcggcgcggtaagcgtgcccgtgtatgaaaccgattccgccaggcaggccgcgtccatcatcgaagaggtggatccgatcatcgcctttgccggtgatttcgcgcatacacaaacgcttgaacagattcgcgatgagcacagcagcctgcgctacgtcttcaacttcaaggcggatggtcttgatgccgttgctgattttggagaaggtgtcggcgaggacacgctcgatcaggtgatttccagggtcaaggccgatgacatgctcaccattgtgtacacgtctggttccactggcaagcccaagggagcgatgctgtctcaccggaatttcacgcatatcgtgctgaacggctacatcattctcgatgaaatgctatatcagccgaatcgtctgatgttgttcctgccgttggcgcactgcttcgctcgctatattcagtatgttgcgattggcgggcagggggtggtcggctatctgcccggagccaagcatctgcttgccgatctgcgtagcttcaagccgacctatctgctgggagttccccgtgtgttcgagaaagtgtataacgcggcttcgcaaaaggccggagcgggtattcgtggaagagtgttcgccaaggctttcgatcattttgtgcaatggtcgaaggacgagcaggaaaccggacgccattccattgtggctcgtgccgaacattcgttctttatgtctgtcgtaggcaaatccattcgttctgctttgggtccgaacatgagatatctggcttgtggcggcgctcctttgaacgtcgatctcgcccatttcttcaacggtatggatggcattaccttcattcagggctatggcatgacggaaaccgccgctcccatgattgtcaactggcaggacgccaaccgcgtcggttccgtaggcaagcccgggccgggcatgggcgtgcgcaccgatgacgacggcgaactgcaggtgatgggccccaacgtgttccttggctactacaagaagccggagctgacagccgatgtcaagatggctgatggctggctgaagaccggcgatttgggaaccatcgacgacgacggattcgtgtacattacgggtcgcaagaaggatatcatcattacggccggcggtaagaacgtcagtccggcacctatggaagatgtcatcaacacttgcccgatcgtgtcgcatggtgtggtggtcggtgatggcaagccgttcatcggagctttgattgagcttgatcaggagatggttcgttcctggcttgcacagcagggacttgatagcaacatgcccatggagcagatcgcgaagaacgatgccgtgcgcgcattcattcagcagtatgtcgaaaaggcgaatgcgaatgtctctcgtgctgaatccgttcgcaagttcgaaatcctcgacgaggagttcagccaggagaagggcactctgacggcgagcctgaaagttgtcaggccgaaggtgcttaagcggtacgaaaatgtcatcgacaatgtgctgtatgcgccgaagccatccaacaaaccgctgccaaagacggtgcagatccttgaccgcactacggaaacggtcaagcaggcatccgaatccatgcggcaggcatccgaatccgtaagcccgagggttcggcaggcatttgataccatgcaggataaaatcaagaagcagtccgaagaaaatgacggcgagtcgtcgatgcctgtgggcccatcggaaactgaggaaacaactatgattgaggagagatag

SEQ ID NO: 1396 - DNA, 1140 bp, Unknown
  Artificiall/Consensus sequence
atggcgtcggttacgcgttcgaaccgccagaagtccaagactaatgcgctaaaattcggtggtatgcgtactaccgatacaaaaccagggcgttcggtgaatccattggaaaccgaacgtcctattggtttgttctcatcgctcaaaattgaattgagcgttctgatcaccatctccaccgccattgcgttcatcatggcgtggttcctgctcaaagtagggctcagcgtatggatcgccatgcccattaccctcgccgtggctttaggaatcacatatttcttctccagaggactcacctctcccctgcgccaaatgcgcgacgccgccgaagcgatggcggaaggcgattacaccgtgcgcgtccatgtcgactccaatagtcgcgatgaagtcggccagctcgccctcaccttcaacgaaatggcggaagagcttcagcatgccgaccagatgcgccgggacatggtagccaacgtaagccacgaattacgcacgcccgtatcagcgcttcaagccatggtcgaaaacatggcggatggcgtgatcgaccctacgccatcaaatctggaaagcatcctcaatcagacgcaccgcctgtccgatctgatcgcgttccttcttgatctttcccgcatggaagccggcgcggcaagcctgcaaatcgaaatgttcaatttcgccgattttcttgacgaaaccgtggaacctttggaaatcgccgatgccgggcatgcgcatgacatcgaaatgcatgtgcccgacgatatcgagatggcaggcgatcaggaccgcctgcgccaactgttcaccaatatcatcgcgaacgcgctcaagcattccgcggacaataccacggtgcttatcgaagcacacgaaaacaaggatttcggcaccatcgtcaccaatgtcgtcaatttcggatcgcagattccgcaagaggcgcgttccgacattttccgccgtttcgtcaaaggaaaaacaggtccgggcaccgaatcgggcggaaccggcttgggattgtccatcgcacgttgggccgcccagttgcacggtggttcggtgagggtcgtcgatgacccgcgtggagccgattttgaaatcattctgccgaaataccatgttacggatgacgaatag

SEQ ID NO: 1397 - DNA, 792 bp, Unknown
  Artificiall/Consensus sequence
atgagcgacgatcgaaataacgatttcgacgatttccaaggattcgatggatcaaacgatttcggtgacctcaacgccgacggcatgcatttcagcgaagaggaactggaagcggccatggccggcttcgagcaggaattcaaggatgccgaagcgtccaagcatgagcgggcggacaatccgccatctgaagctttcgattcctccgaagcttccgataacgcggaatcctccgaatcctccgaatcctccgaatcctcggaagtcgacgatatgctcaacgcggctgaggattcgttgaaattcgaagacgagctgcagggactgcttggcaatcgcgcgaaagtggcggtgatcatcaccagactgacctcgccacgattgctgtcggcattctgtgaattgtccgacatttccgcgcaatgcatcggatcggcgcaaggtgctgtcgcggtgctgcgcaatctcgacggagacggtccggaagcggcggtcaaagacatgacgatcgtcgttgccggcatgcccgcgattcttgccgtcaaccgtgcggacaagctcgaagcgacgatgtacgtggaaggcagagcgggcaaaaccttcgctccgccggtgctattcacctccaccgcgccgttcgttgaggatctcatgctgggcatcaccgatatgaacgcgctggaacaggcggatatgaccattttcgattccgctgaccttgatcgggatgcggcgatgagcattatcgccgagcatacgcggttcggacgcggcacatcaagcatcagttaa

SEQ ID NO: 1398 - DNA, 1038 bp, Unknown
  Artificiall/Consensus sequence
atggctttgaggaggattcacatggccactatcagagagatagcgaaacgggtaggtttctcccaagccactgtttccagggttttgaaggacgatcccactttttcggtgaaggattccacccgcgagaagattctaaacgccagtctggaaatgggatacaagaacgtaccgcaataccagcgcatcaccattccgcaggatgttgcgattctcgacaatgtcgtacccgacaagggcttgcaggacgcgtatttcgacgagctgcgcgaagtgctcgtcaagcatgccgaagagcagcgcatgaacgtgaccatgcacgaggacgtggattcgctgatcgccgatgccgataaatacgcgggatttatttcgatcggcccgtccccactagatcacaagacgcttcaccgcttgcataagaagcttccccacggcgtattcatcgacatcaatcctgcgccgacattgttcgattcggtacagccggatttggaacaaaccatattggatgcgatcgacgcgcttatggggtcgggttgctctcggatcggcttcattggcggcttgggcaacattatgggcaagcatgaatatccggaagatattcgtacgttcgcattccgcaattgggcgttgcgcttgggattggatgcgcaaggattggtgtatgcggacggcccgttcactgtggaaaacggccgtttgcaggggcgtcagttggtgcaggatcatgcggacgatctgcccgacgcagtgatcatcgcagccgatccgttggcggctggcgtactgcaggcatttgccaccgaaaatgtgatggtgccgcgagatatcaaagtaatcagcatcaacaatcaggagatcgcaaaatacacgtctcccgcattgtcgtcgtacgacattagccaggacgagcttgcgaaagccgcggtgcttatgcttgccgaagcgctgaccgccgaccgcaaaatcagccagcatatgcggatctccaccagtctcgtcgcacgcgacagcttcaccccgcaagactaa

SEQ ID NO: 1399 - DNA, 984 bp, Unknown
  Artificiall/Consensus sequence
atggctgaaacaccacttttttttgaaatcgccacgttcgcggtgcttgccgtcttcttcgtggttgacttgtttatcatcggacgtaagccccatgtgccctccaccaaggaatgcgtgcagcatatcgcgttctttgtagtcatggcgttgatcttcggcggacttatgtggttcttcgcaggttcgaagccggccatcgaattttattcgggctggcttacggaatattcgctgagtattgacaatctattcgtcttcgtcatcattatgtcgaattttgcggtgccaaaacagctgcagaaattcgtgctgtccatcggcatcacgatcgcattggtgttgcgtggcgtgttcatcctcatcggcgcggccattatctcccgcttcacctgggtgttcttcctgttcggcgcatttcttatcgtcaccgccatcaagttggtcactgggggagacgaagatgaggaatatcatgagaatggcttgattcgtgcattgcgcaaggtgatcaagatcaccgatgagtatgacggagaaaagttgcgtaccgtcaaaaacggtgccaagtattggactccgatgctgatcgtctttctgaccatcggcaccaccgatgtgatgtttgcctttgactccattcctgcgattttcggtttgacgaaggatccgttcattgtgttcacgtccaatgtgttcgcgttgctcggtttgcagcagctgtacttcctgcttggcgagctgctcgacaagctggtgtatctgccgcttggactttccgtggtgctcggctttatcggcgtcaagctcatcatggaggcattgcacggcaattcgctgccgttcctcaatggtgggcagccgatttcctgggtgccggaagttcccacatggctatctcttgccgttatcgtccttgcgattggtggcgcggctttggcaagtgttcttaagatgcgcaccatgaaagcgaacgaaaagtga

SEQ ID NO: 1400 - DNA, 1683 bp, Unknown
  Artificiall/Consensus sequence
atgagcttgaacgatatggattctccggaaagcggcaacggtaagttcgccttcccgaacatgggcgatgaaccaaaagtcatctcgcaggtgagcttggattcgtttgccgaaacggccgattccattgatgatggtgcagcgttgactgtgaatgccagcaagaagcgccacctgttgtggctgtggattgttcttgcggtgatgcttcttctcggtgccgtggccggcggcggatactggttcttccagtcacatgcgttgccaggtgtcacgctctggggcaagtccatgacaggacaatcccgagatcatatcatccaagagatttccgatacggcggaatcattaacggttcccgtttcctatgagggaacgagcaagaaagtcacgttgaaggatcttggcgtcgccattgacgcggaatccatcgccgaaaatgtgatgaacgcgaaacgtgacgattccttctttcagaagtatgcattctggacccgtgaggatgtcgacgtcgagtctttcgatgattctcgagtcagcgcccagacggtaggtgacatgttgggagtgcagtccgtgtccgccaccaacccgtcgctacagctcaacgcggatggtaccgctttcgatgtgacgccaggtcagcaggggactggtatcgatgtgacggatatcgtcaaagaagccaagaacgtgcttgagtcctttggcaagcagaccgctcaaatggtgactcttaaaaataaggttactgatcccgccatcacggatgaccaagccaacgaggccaaggcttctgctgacgcgtggatagcgaagccggtggctatcaagatcggcgaccataaagtggcggaattcggtgcgcagtccattgcatcggccatcacgcttggaccggatagtgagaagctcggcgataatcaaacccgaaatggctctttgattatcgatggtgacaaattgcagcaatactataacgattccatcaaatcgaacttccatgctgatcgagttgacggtgatgtcatcgttaatagtgtcggtgatgtgctgcaaaccaatgtagctgggcatgatggtataaccgttactgatggtagcgacaccaatgttggccgtgatgccgctgaggcgtttgccaagggttctgattcagtaagtattcaaggcacttgcgacccacagaatgagaaaaaaaccacgcgtaccgtggtagtcagcttgtcttcgcataccgttacagccattgaaaatgggcagaccgtccgtgtcatgcatatgtctgccggtcagggcaatgattatcagacgggccagtgccagccgagcggcgacttgtgcacgccaacctactgcgatccgaactcctacgacaactgcacgcctgacggtgacttcaaagtgtggctcaagtaccagtcccaagatatgagcggcacccttaccctatcggatggaaacaccgagaagtgggatgtcaaggatgttggattcgtcaactatttctcgaaaacaggttgcgcgattcatcgcatcgccactcaaagtgcgtttaacgacagcagtattcaggctatggggaagaacacgtcccatggttgcgtcggcgtcggctgggatcaggctgaatggttctacaattggtgcctgatgggaacgacggttcacgttcaggcctga

SEQ ID NO: 1401 - DNA, 2265 bp, Unknown
  Artificiall/Consensus sequence
agttcgaaaaccgtgatatttcgcggcggactttcagtggcggaaatttccgtatctctttttacagctgttgcaggcgtgtgcttgcgaaagctaggggaaaggcaaaaaccagtggcaaccagcccgaatcttgaagacatgaaactgcctgagctcaaggagctcgccaagcagatgggccttcgtggcacctccaccatgcgtaagccggaacttatcgcgacgcttcaggccgctcgttccggcggtgaagcgcctgccggtgtgaccgtgcgagctccgaagtccgctgcaccggccgctccggtggctcctgctgaagcccaaaccgcagacgctgaggtcgcggcgaacacggctgaggaatccggcaagtccaacgaggctgccgaaagcaaagccaacgaggctgagcagtccgaaaagcagacggccaaaaccgttaggaagacccttgccggacgtgctgatagcgctgagcgtgcggagcgctccgaacagacggaacgtgccgagcgcaccgagcgtgttgaccgtcgcaagcaggctgaggctccgacgagcgaggaggcggccgatgtcatggccgcggtgaacgccctggacagcatcgatgaggctccgaagcgccgtcgccgccgtgatgcggacgctgccaccgatctgctggccgaactgggattggacgatgcttcgccgaagcaggatgatcgtcgtcgccatcgtaaggatgatgcgtccgacgttgagccgcgccgtcgccgtcgtgcggtggaagggccgaaggatgaggacgttgtgcgcgatcttgatgacattctcgccacgttgccttcgcagggcagtgatgatgacgaacgtcgtgacgaggctgaagacggtgatttcgcgcgtcgtggtcgcggtcgcgccagcgataggggtgaccgcgtggatcgtcgtggccgtcgcctgcgtggccgtgaccgcgattatgacgagcgtgacgagcgtcgtggccgtaccggcgaccgcaacaatgatcgcaacgagcgtaacgatcgcgtcgagcgcaacgagcgcacggatcgcaatgttgaacgcgaacagcgtcacgaggagccgaaagaggatctcgtgcctgtcgcgggcatcgtcgacgtgctcgattcctacgctttcgtgcgtacctccggctatttgccgggtccgaacgacgtgtacgtttccatgggccaggtcaagaagtatgggctgcgcaagggtgatgccgtgcacggttccatccgtaccccgcgtgagggcgaccgccgcaaccagcgtcagaagttcgtgccgctgcagtccatcgactccatcaacggcatgaccgtggaggccgcacagaaccgtccgcagttcaacaagctcactccgctgtatccgcaggagcgtctgaagcaggaaaccgcgccgaacaagctcaccggccgtctcatcgacatcgtggcgccgatcggcaagggccagcgtggcctgatcgtgtctccgccgaaggccggcaagaccatcaccctgcagaacatcgccaacgcgatcgccaccaacaatccggaagtccacctgatggtcgtgctcgtggacgaacgtccggaagaggtcaccgatatggaacgtacggtgcagggcgaggtcatttcctccaccttcgaccgtccggcctccgaccacaccaccgtcgccgaactcgccatcgaacgcgcgaagcgtctcgtggagcttggccaggacgtggtggtgctgcttgattccatgacccgtctggcccgtgcctacaacatcgccgctccggcttccggccgtattctttccggtggtgtggatgcccaggcgctgtacccaccgaagaagttcttcggtgccgctcgtaacatcgaaaacggcggctctctgaccatcatctcctccgcactggtggaaaccggctccaagatggacgaggtgattttcgaggagttcaagggcaccggcaacatggagctgcgcctgagccgcgaactggcagacaagcgcctgttcccggccatcgacgtgaacgcttccggcacccgtcgcgaggaactcatcaccgatccgcaggagctgccgatcatctaccgtctgcgtcgtctgcttggcggtctggagcctgagcaggcttaccagacgcttgtgccgcgtctgaagaagaccgcgaccaaccgtgatttcatggcgtcgctgatccagcagagcggcaataccgcgaataacggcaacagctaa

SEQ ID NO: 1402 - DNA, 474 bp, Unknown
  Artificiall/Consensus sequence
atggttgaggattcaggcagaaatataggcgatttcgaatacacgcgccgttttttctgccgtgccctgccgacgcagttggatgataacgacagtccgacgctgatcatacaaagttattacgtgcatcaggataattacgcgctgcgcgtgcgattgaaaacaaagtccgtccgcattgccatgactccggacctcgacccgctggctgtgctcgaaaagtatcgcgacgaattccggcttggatcagtcaccgtgaaagggccgtccgtgggaggcacgcgatatgaggcgagccgcgatttggattcgcgcatcgcaggggagctcatcaaacgcggcggacacgtgaccatcaaaaaccgtttcaccgactggatcgatgaggacggctggaacatcgacgtgttcggaggcaccaacgctcccctgatcattgcggaagcggaacgtatcgggccggtcaccaatctg

SEQ ID NO: 1403 - DNA, 1014 bp, Unknown
  Artificiall/Consensus sequence
gtgtgccatccggcgaagggctttgtcgtgaaagtcctgagccacccaatattgtcaaccggcatacaaccaattcgcgtcatgttcgcgacgacctgtgtcggtcggccgacgccgcaaggctttggctgcacgcaggaacgcatgaccaggcaagaaccgacagaaagaggtagtaataccatggctcagatcaatatgagcgacatgctgaaggcaggcctgcacttcggccaccagacccgtcgttggaatccgaagatgaagcagttcatcctcacccagcgcaacggcatccacatcatcaacctgttcaagtcgctcgacatgatcgacaaggcctacgacttcatcaaggctaccgtcgctcacaacggcaccgtgctgttcgtcggcaccaagaagcaggctcaggaagccgtttccaatcaggctgtccgcgtgaacatgccgtacgtttccgagcgttggctcggcggtatgctgaccaacttccagaccgtgtccaagcgcgtctcccgtctcaaggaactcgaagagatggacttcaccgacgtgcgtggttccggtctgaccaagaaggaactgctgcttctcgagcgcgagaaggacaagctgactaagcagctgggcggtatccgcaacatgaaccgtactccgtccgccatgttcgtggttgacgttaacaaggaagctttggccgttgaggaagctcacaagctgggcattccggtcgttgccatcgtcgacaccaacgctgatccggagtccgtcgagtacccgatcgcagccaacgatgacgccatccgcggcatcgaactgctgaccagcctcatggctgacgcagtggccgaaggcctgctggagcgttccggcaaggccgctaaggctgagggcgagaccgagcagccgatggccgcttgggagaaggagctcctcactgagggcgctccggccgccgatgcaccggctgaagccgaagccgaagctgaaggcgaagccaaggctgagtga

SEQ ID NO: 1404 - DNA, 1065 bp, Unknown
  Artificiall/Consensus sequence
atgtgggccggcttccgaatgaactttgcccagctcgcggacattgtctgcacgcgattgcattctttggtaaatttttgcttgggtttggcaatggttgcagaacctacggaaagccgtcaatcaacaggctttcgagagaaaaccaaagaagggagtaatgtcatgccgttccttattacgctccttgtcattgcacttatcgtcgcgttcctgttcctgtccacgttgtttatcgtgccgcagcagcaggcctatattattgagcgtttcggcaaattcaacaaggtgcagttcgccggcattcatattcgaatcccgttcgtggaccgtatcgccatgaaaaccaacatgcgcgtcaatcagcttaatgtgcagttggagaccaagacgcttgacaatgtgttcgtcacggtggtggcgtccactcagttccgtgttgacccgagcaatgtggccaccgcatactatgagctgcgtgatccggctggtcagctgcgttcctacatggaggatgcgctgcgttccgccattcctgcattgtctttggacgatgccttctcccgtaaggacgatgtggcctttgacgtacagaagaccgtcggcaacgaaatgtcccgcttcggtttcactgtggtcaagacgctgatcactgccatcgatccgagtccgcaggtcaagaacgccatggattcaatcaacgctgcccagcgcgagaaggaggccacccgtcagcgcgccgaagcccagcgtattcagatcgagacccaagcggcagccgaggctgagaagacccgtcttcagggtgaaggccaggccaactatcgtcgtgagatcgccaatggtatcgtcgaccagatcaagagtctgcaggcagtcggcatgaacgtgaacgacgtgaacaatgtggtgttgttcaaccagtatctcgacaccatgcgtaatctcgcctcgtcgcagaatgcgaagacggtggtgttgccggcttcgacgcctggcggtttcaacgagatgcgcgaccagatcacccaggccatgatgtccgcggacgaagctgcgaaatag

SEQ ID NO: 1405 - DNA, 867 bp, Unknown
  Artificiall/Consensus sequence
atgcagttcatccatcttgattccattgacgacgagcgcgtgtcggcatacacgaatctcacggaaatccagcttcgcaacaagcttgaacccagcaagggcctgttcatcgcggaatcgccgaaagtcatcgatcgcgcgctgaccgccgaccgggaaccgatttccctgcttgtcgaagaaccgtggatcggaggcatgtcggaaaccttcgcacgcatcgaccaacgttggggcaccgacattcccgtgtacgtggcatcccctgaacagctcaagcagctgaccggctaccgcttgcatcgtggcgccctggccgcgatgaaacgctggccactgcccagcgtcgaggaggtgtgtcgcggcgcacgacgcatcgcggtcatggaaaacatcgttgaccacaccaatgtcggagccctcatgcgatcagccgccgcgttgaacgtcgatgcagtgttggtgacgccctcctgcggcgatccgttgtatcgacgcgccgcccgcgtgtcgatgggcacggtgtttcagattccgtggactcgtattggcggagatgataaacactactggccattcaccggcatgcaggaattgcgcgatcttgggttcaccaccgttgcgatggcccttgaagacgattccatttcgctggaggagcttgttcgtcgtttgaacaacgacaacggcgaaaaggaccatatcgacaaattggcgctgattttcggcaccgaaggcgacggtctgtcgcatcacaccatctcccgcgccgacctgacggtcaagattcccatgagccacggagtggacagtcttaacgtcgccgcatcgagcgccgtggccttctattcaacagctgttcactga

SEQ ID NO: 1406 - DNA, 1305 bp, Unknown
  Artificiall/Consensus sequence
gtgacgcacgaagtgaatgcgagtggggaacaagagcaagaatcgtctgaatggaatgtgcgcgagctgagcagtagtgagtttgatgagctttccgcagcgagcagatacggcggattccagcagacttccgaaatggcggcattggctcagtccgacggcatgcagacgcaatacgttggattggtggattcgcacgatgctccggtggctggcgcgttggtggctttttcgcaagggcgtttcggcgtggaaggctcgttatggcttggcccgttgtgcaatgggaataacagagagcggatgaccgcgttgaccgaaggtttgcgcgaggctgccgaacgggttcacgccatcagcctgacgtgctggccgaaccaggtgtattgcgttcgcgattcgcaaggcaaggccatggccgaacccaatgatgagatggtgcgggagtacgagcggctgggttggaagcatgccggtttcactcgtgggtatggttccctaatgaaccgttggaattacgtcaaggacttgagagagttctcgaacgccggcgagctgctcgcttcgtatgcgaagaacacgcgtcgtaacgtcaagatcgcgcggaacagcggcgtggaggttcgacgcctgaatcgcagtgagctgaacgtgttccacgatatttgcgagctgagtagcgaacgccagcatttcgccaaccgtagccttgattacttcgaacgcgtatatgatgcgtttggagacaaggccgagttcatggtggcggaagtgcatcttgaccgctatttgcgatcctgggaggaaaagctggcgaagttctcgaaagacgtggaacgcttggagcgttcgcttgagcatacgaagtacccggatgatgtgcgcaagaagctcgatacggctcagaagaatgtggagtccgcacgccgccgcattgaggatgcgaacgagcgcatcgctcgtgatggcgaggtggtgccggtcgccgtaggtctgttcatgtggcatgaacgcgagctggtgtatttctccagcggatctgacgatcgttacgccaagttctacgcgcccaccgccttgcagcatgagatgatgtcgcgttgtttggaacgcggagtgacgcggtacaacttctatggcatttcgggtgtattcgacgatccggaagacgaaggacgtggcgtgttggagtttaagcagggcttcaacggctatgtggaggagttgccgggcgaattcacgcttcctgtgagcaagctgcgctacggcgtgaacgatttggcccacaaactcctgcgccgctag

SEQ ID NO: 1407 - DNA, 669 bp, Unknown
  Artificiall/Consensus sequence
aaacgcaaggaagcggaaaggcgtgcagaacccctctctcgcaacccatttctccgactgcgcgttgctttcgcaccttcatcggtgctttccgcggcccctttattaccaatgcgacagaaagggccgatcatggcacaacagcaagctctcatcaccatcaccggatatgtgggcgccaatcccacgcaattcaacaaggatggcatgccccatgccagttcgttcagaatggcgagcaccagacggtatttcgacaatcgcacacagcaatggaaggatcttcccaccacatggatcacggtgaaagcgtaccggaacctatccgagaacatctgccaatctctgaagaaaggcgagccggttatcgtgatgggcgcgctcgccacggaaacgtgggccgatcagaacggcaaaccgcagtcacgcatagtgctggaagccagcgccgcagggcacgaccttaaccggggagtcaccacgttgcgtaagttcgtcaagccgaacgaccagcaccagccggaagcgaaaggaacggaaccgcgtgtgggagccgatccgttcgtcaggcagggcagtgtggcgccggtcgaaatcgtggttcccgaagatgacgaagccgccgaattctcgggagataccggggaattcgacggcgacatatattag

SEQ ID NO: 1408 - DNA, 1746 bp, Unknown
  Artificiall/Consensus sequence
gtggattatcaccaagtcatcgccgaatcatcatcgaattctcgcgaatcgcaatatcatttctgcatatctgctcgtacagtggaacgcatgtcatgtaccacgattcttgtaggcaagaaagccagctacgacggctccaccatcatcgcacgcgacgatgattccggttccggccgttacgaccccaagaaattcattgcggtcgcaccgcaagaccaaccgcggcattaccgcagtgtgctcagtcatgtcgaaatcgaccttcccgacaatccatgccgatacagcattgtgccgaacgtgctgccgaaccgcggaattctcgcggaagcgggcgtcaacgagcgcaatgtggcgatgagcgccactgaaaccatcgcagtcaacgagcgcgtgctagccgctgatccactcgttgaactgcaaccggcgaacgaagccgctgatacccctgaaattccgggcggaatcggagaggaagacatcatcacccttgtgctgccttacgtaaccacggcgcgcgaaggcgtcgcacgtctcgccgaactgcttgaaacatacggcacctacgaatcgaacggcatcatcatttccgacgtaaacgaaatctggtacgtcgaaacgatcggcgggcaccattggatcgcccgccgcgtgccggacgactgctatgcgaccatccccaaccagctcggcatcgacgatttcgacttcgacgacgccttcagcacccaacgcgagttcatgtgcagtgccgatctgcgcgaattcatggacgcgcaccaccttgaccgcactatgagcgcgggtgcgagtagcggcttcggattccagccgacgagcgttttcggaaacgccagcatgaacggcggtggcaatagcagtagcggcgcggcgctgggtcacaaccatttcaatccgcgcacggctttcggcaccgccaccaccaaagaccgcatctacaacacgccacgtgcctggtatatgcagcgccacctcaatccaagcgaggactgggattcgccggccgcccgctacacgcccgcatccgacgatattccgtggtgtcgtgtgcctgagaacgctgtgacgctcgaagacgtcgacttcctgatgagtgcacacttcgaggggaccccttacgatccgtacggtacgctcgggacgccggaaagccgccatcgctaccgtccgatcggcatcaaccgcaccgggcatatggtggccatgcagattcgtccgtacgcgccggaggcaagccgttcgatcatgtggatctcatacggttccggccccttcaccgcggccacgccgttctacgcgaacgtcgacgatacgcccgcctacctgcgtgacaccacgccggaagtctcgaccggcaacctgtactgggcgaaccgtttgatcgccgcgctcgccgacgcgcatttctacgaaaccagcaatgcgatcgaaggatttgcggaatcggcccgcgcttacggccatcgtctggtggaacgtactgatgccgaattgcgtgagatgtccgcgcaaacgagcgtgtccgaatcgcaggagcgtgcaggggccgcggagattacggaaaacgcaagtattgcaaccatcgccagactgcagcagtccaacgaagaaatggcggaatatttgcgcactcacgttacgaaactgctcaacgacgtgctctacacgtccagcaatctcatgcataacagtttcgccatgtccgaccgctggaactaa

SEQ ID NO: 1409 - DNA, 1419 bp, Unknown
  Artificiall/Consensus sequence
atgtggtatacgcttcgaggcaggatcaataggaggataagtttggccaccaaggaaacgacggcaagcatggaacaggctgatctgaccgaaaagaccacctccacgaagaaagccgccacgcgcaaggcctccacgaagaagagtgcggcgaagaaaaccaccgcaacgaagacccctcgcaagactaccgcgaagaagagcgcccctgccaagaaggaggagccgctcgaggatgatgcacttgacgatgaggacgctcaggtagacgacgccgatcttgacgatttcgacgccgatctcgatgacgtcgattcggatgacgaggatgacctcgacgacgacgaggaatccgaacctgaagatgatgacgacgaggatgaggaagaacgcaaaaagccggaagagcctaaggaaaagggcgctttcgtggtgcgtgatgacgatgatgatgagaatctgaccccatccggcaatccgaagcgtcgtgtgattgcggcgggtgcgactgctgatccggtcaaggattacctgaagcagatcggtcgtgtgagcctgctgaatgcggaacaggaagtcgatctgtccgagcgtatcgaagccggtctgtatgcccagcacctgctggacaccgaatccgaccagatggacttcaaacgcaagcgtgagctcaagtgggctgcgaacgatggcaggcgggccaaggaccacctgctggaagccaatctgcgacttgtggtttcgttggctaagcgttacaccggccgtggcatgctgttcttggatttgattcaggaaggcaacctcggtttgattcgcgccgtcgagaagttcgactggaagaagggctttaagttctccacctatgccacgtggtggattcgtcaggccatcacccgagccatggctgaccaggcgcgtaccattcgcgtgccggtgcacatggtcgaagtgatcaacaagctgtctcgtgtgcagcgtcagatgctgcaggatcttggccgcgaacccacgccggatgagcttgcacgcgagctcgacatgcctgtcgagaaggtgcaggaagtgcagaagtacggccgtgagccgatttccttgcatacgccgttgggtgaggatggcgattccgagttcggcgatctgatcgaagacaccgacgccatcgcgccgtccgacgcggttgccttctcgctgttgcaggagcagttcaggcaggtgcttgaaacgttgtctccgcgtgaggctggcgtgatcaagatgcgttatggcttggaagatggccagcccaagacgctcgacgacattggccgcgtgtatggcgttacccgtgagcgtattcgccagatcgagtcgaagaccatgtcgaagttgcgtcacccgtctcgctcgcagacgctgcgtgacttccttgatcagtga

SEQ ID NO: 1410 - DNA, 1413 bp, Unknown
  Artificiall/Consensus sequence
gtgaatgacggcataacacaacatcggcacacaaccgaggtgccgcgcggcagcggcacaaacaaagagaaacagagaaacaacaacatggcaagtacaactcgatctgcatggaagaatccttcctacctgcagagctccttcggcatcttcatgttcttctgctcgtggggcatctggtggtccttcttctcccgctggcttaccgacccggcccacggtctgggcatgacctccgccgagcagggccagatctactccatcaactccctggcaaccctggtcatcatgttcgtctacggcgccatccaggaccagctgggcatcaagcgtaagctcgtgatcttcgtctccgccatcgcagcgctcgtcggcccgttcgtgcagttcgtgtatgccccgatgctgacagccggcggcaccacccgtttcatcggcgtgctcatcggctccatcgtgctgtccgcaggtttcatggccggctgctccctgttcgaggcactcaccgaacgctactcccgcaagttcggcttcgaatacggccagtcccgagcttggggctcattcggctacgccatcgtggcgctgtgtgcaggcttcctgttcaatatcaacccgctgctgaacttctgggtcggctccatctgcggcctcggcatgctgtgcatctacgctttctgggttccggccgagcagaaggaagagctcaagaaggaagctgatccgaacgcggctccgaccaacccgtccttcaaggaaatgatttccgttctgaagatgccgaccctgtgggtgctcatcgttttcatgctgttcaccaacaccttctacaccgtgttcgatcagcagatgttcccgaactactacgcttccctcttctccaccactgaaatcggcaacgccacctacggcaccctgaactccttccaggtgttcctcgagtccgccatgatgggtgtcgttccgatcatcatgaagaagatcggcgtgcgcaactccctgctgctcggtgcaaccgtgatgttcctgcgcatcggcctgtgcggcgtgttccacgatccggtcagcgtctccatcgtcaagctgttccactccatcgaggttccgctgttctgcctgccggcattccgctacttcaccctgcacttcgacaccaagctgtcggcaaccctgtacatggtgggcttccagatcgcttcccagatcggccaggtgatcttctccaccccgatgggcgccctgcatgacgccatgggcgatcgcccgaccttcttcaccatctccggcatcgtgctggcagccctgatctacggcttcttcgtgatcaagaaggacgaccaggaagtcggcggtgatccgttctacaccgacaagcagctcaaggcccaggccgctgcagaagcgaatgcctga

SEQ ID NO: 1411 - DNA, 1164 bp, Unknown
  Artificiall/Consensus sequence
atgagaatctatctgttcattgctgcgattgctggcggcgtcacctatttgatcacgccgttgattcgccatatcgccattgagatcggcgccgtcggcgaagtgcgtgcgcgagacgtgcataccattccgacaccgcgactgggtggtttgggcatgctgatcggtttcaccgtgtcgatgctgttcgcatcccgcattccgttcattcaaggattgttcgcgcaatcgcaacaggcgtgggtgattctcgccggcgccattatgatcagtctgcttggcatggccgacgacttgtgggatcttgattggatgctcaagcttgccggtcagctgttgatttccgtgttcgtggcatggggcggtctgcagatcatttcgcttccgcttggctcgttggtgacggcgtcgccgagcctgtcgatggccatcaccgcgtttttgatcgtcgcgtccatcaatgcggtcaatttcgtggatgggttggacggtctgtcgtcgggcattgtggcgatcggcggcatcgcattcgccatttattcatacatcatcgcccgcaactcgccttcgtacgcttcgatggcgacattgatcgacattgccatggtcggcatgtgcgtgggctttttgatgcacaactggcatccggcgaagctgttcatgggagactccggttccatgctgctcggctatttgatcacgtgcgcgtcgattgtgatgacgggccgccttgacccggccagtattcatgccagcatttacttgccggtgttcatgccgattctgctgccgattctggtattgttcctgccgattctcgacatgtgtcttgcgattgtgcgccgcttgcgcaagggacagtctccgatgcatccggaccgcatgcacttgcatcatcgcatgctgcgcatcggccattccgtgcagggggctgtgctgattctgtggggttgggcggcactgatcgccttcggctcgattatgacgctgtttttcaaggcccaatacgtgcttgttggattcctgattgcggccgtggtgctgaccgtcgccaccatgtatccgtatgtgaagcataggattcccgagatgctggaggaggacgctgcggatggcggcagacatgcgtcggtgcggtcgtcgaagcgtcggaaaactgattaa

SEQ ID NO: 1412 - DNA, 1023 bp, Unknown
  Artificiall/Consensus sequence
atgaaaagccgttattcgcaaaggagcgcgaacatgaaagctgtatatgccaacggaacgaattatgatgatccgttgtctatgctcgaagtgggcgatatgcccgaacctgaaaccaagccattctggtccaccattcgtgtgaactcggcgagcgtgaaccatcatgacgtgtggagtctgcaaggtgtggggcttgccgacgatcagacgccgatgatcctcggcacggacgcggctggcgtgttggaagaagacattcccgtacgaaagggacttaaggccggttccgaagtggtcttgtataccttcgttggtaccgatggcgccggtgtgatgccgggggagagacgctcgatcctgtccgaacggtatgcgggaaccatggccgaatacacacaggtgcccagcgccaacgtgttcgccaagcccgcgaatctgaatcttgatgaggctgccgcattgggtaccagctggcttaccgcatattccctgctgttcgcatcggcgaatgtgaagccgggagacacggtgcttattcaaggcgccggaggcggcgtgtcgaccgcggcgattcagcttgctcacgcggccggattggaagtgttcgtcacgtcacgaagcgaagacaagcgtgcgcgagtgttgcagctcggtgccgatgcggcttttgaaacgggtgcgcgactgccacgcaaggcggatgccgtcattgaatccgtcggcgcggccacatggagtcattccgtcaaatccgtacgtccgggaggaaccatcgccatttgcggcgcgactactggcgaccagccgggtgcagagcttacgagaatcttcttccaggatattcgagtgcagggcaataccatgggctcccgtgaggatttcgcacgtttgctgaaattcgtggaacatgccgatctgcatccggtcatcgattccgcatatgcgatcgacgacgcgcatcttgcgttctccaagatcgtgaatggcgacgttttcgggaaaatcgtgctgcacatctag

SEQ ID NO: 1413 - DNA, 1047 bp, Unknown
  Artificiall/Consensus sequence
atgccgttcgacactgaacagacctctgagaaaacagacaaaacaggagacgccgatcctgccatgcagcgcaaggtcgtatccattgtcggaccaaccgcatccggcaaaaccgggttgggcattgccgtcgccaaagcgttggcgcgcaaaggcgaacaggcggaaatcatcaacgccgacgcataccagatgtatcggggcatggatatcggcacggccaaggcaagccttgaggagcaggcgcaggtcaggcatcatctcatcgatatcatcgaaccggacgacgccatgtccgtggcgaggttccaagagctcgcccgcgagaaaatagccgaactacaggccaggggagtgcgtccgatcctcgtcggaggctctggcctgtacgcacgggccgccatcgacgacatctccttccccggcaccgatccgcaagtacgcaaggcgcttgaggaacgggaaaaaaccgaaggcgcgggcgcgttgttcgacgagctgaaagccaaggatcccgaagcggcggcgcgcatggacccgcacaatccgagacgaaccatccgcgcgctggaagtcatcgaagtgacgggacgaccctattcggcaagccttccgcactaccggtacgtcatccccaccgtgcaaatcggtctcgatctgccgcgtgaggaactggaccgtcgtatcgatattcgcaccaagcagatgctcgaaggcggattcatcgaagaagtggaacgtatccgtcccaagctgggcatcaccgcagccaaagcgctcggttaccagcaggtcgtcgactatttggacgggttgcgtgacctgaacgacacgttcatggacattgcgcagaaaacgaagcgtctggcacgcaagcagatgggatggttcggtcgtgacccgcgcatccactggctccaagcgctcaatccggcgctgctagacaacgcgatggccatcatcgaacatgccgatgcaggtgcctatgacgtcatagacgcacaggcggacgcctacacccagcatcatctcggagacctcgcctga

SEQ ID NO: 1414 - DNA, 831 bp, Unknown
  Artificiall/Consensus sequence
atggaactgaggcaaatcgccctcgaagtcgcacgtatcctgcaggacgcaggcaagcatgcgttgaacgaccagatgaatccgcacgacatgagaaaactggaagtgtccgaagactgcttccacttcacttcagacaccgacaagcgcctgcagcagttcatcagcaaccgcctgacctatgtcaacgtgttcgacggcttctggcagcttcgccctgaacagtgctatcccggccagcgatactggtgtgtgggtggcatcgacggcgtgatcaatttcgcgcgaagcatgccggaatgggccatcaccgtgacattgttcgaattcaacgaccagtgctccgcacagccgatcctttcgattgtgcacgctccggcgctgggattgacgtatcttgcggtgcgtggatccggcgcgattcgtattcgcaagactccgttgggagacaaacgcgagaaaatcattccttccaccacgtcgtccctcgatggttcggtggtgagtttcggcatgtctccggtatcgtccgaatcgcagcgtgcgctcgatgtggtggcgaagattgccggacgtcctgccgatattaaacgtgtcggcccggcgtcccttgatttgtgcaaggtggccgacggtacgtacgatgcgtatttcgaaccgcacttgcatgagtgggacgtacctgccgtgtctgctggtgctgtggtgatttgggaggcgcaaggccatctgacccagtggaacggcgaaagcgttcactggcgccaggagaacgatgtgatggccaccaatggtctgatcaccaatgatctgagccagtatttggcatag

SEQ ID NO: 1415 - DNA, 1188 bp, Unknown
  Artificiall/Consensus sequence
gtgacgtcatttgatctgagaagaccgatagggcgctggtttcttgcaaagagcgaggaatcagcgccctattgcgtgaaagaagtcagacaaaacgtcagaaaagcgggatgcggcgattgggtgcggcgattgggtgcggcgatgccacggttcaatcgccgcatcgtctatcataggggacaagcgaggaggcttgacatgtcagacaaagacaaggatgcgaagacgtcgtccattgcgaagacgttgaacaaggttgaggacaggcttgagaagggggagaactgcagttccgttgccgaagggcttgcgaatgttgccaaggccagcgagttgctcagttccgtgtggacgcttccgcccagtcagttattgcgattccatcatgatacgagggtcgctgcaatcgatggcgattccacgccgggcttcgacggcaacaaagatgatgcggaacgattcattgcgatcagttcttctgaaatcgcacgatatcagcggcttatgtatgccaatggagtgaaaggttcccgccgtcgtctgttgattattctgcagggcatggatgcttccggcaaaggcggcatcgtgcgtcacgtattcagccagggcgatccgatgggcatgcattatcacggtttcggtgctcccaaaggcgaggaaaaggaccacgattatttgtggcgcatcaaacgggaactgccgcagaatggttggatctccattttcgatagatcgcactatgaagatatcgtcatgccgcgcatttacaaaacctatccggaagaggtatggcaggcgcgatatgacgaaatcaaccgattcgaatcgcaattggtcgcggacggatgctccatcatcaaaatattccttgtggtgagcaaagaggagcagaaggagcatttcctcggcaggctggaggatccgaccaaatattggaagttcgaccccagcgaccttgaagcgcgtgcccgttggaacgactacatggccgcatggcaggacgtgttcgcgcgtacgagcaccgagcaggcgccctggtacctggtgcctgccgacaatcgttggtattcaagggcggttgtgtctgaactgctccgtaacgtattgaagaacatgaacatgatctggccgcccctggaagtcgacgccgacgagatgcgacgtcagttggaaacgctgtag

SEQ ID NO: 1416 - DNA, 975 bp, Unknown
  Artificiall/Consensus sequence
atgagcaagattgaagatgtgagcgaggccatcgccgacgaaaccgaaatcgcagcaatcgaagaggccggcatcattgcgcaatcgcaatcggcggaagatgacggcaatcctgctgaccgcaggctgccgctgattgcacgtatttacggcatcgtcatgttgatcgaaggcgtggtgacgttgccgatcatcgtgatttcctgcctgtatgcagtccacgccgcgctttccggcaaactggcgtttggcgcgctgaatctcaccactattctgtcggttattcatgctgcagtgctgctggtctccaccgcatgccttgcgattttcggcatgctgctgattctcaacaagcgtcggcatatcgcgcaatggacgtatctgatgattccgctcacgcttgcggaaggcctattgtcgttgtcgttgcagggtttgggtgtgaatctgatcagtccgaccgtgcagctgcttgtattggttgcgttgcatatcacggctgatccgtcgctgcgcgaggagcgacgtttgcagttcgcacttcgtcgtttggatgcgcgcagcgagtatgagacggctgtttcgaagggtatggccggccgtgatctgaccggcaagggctatatttcgcttgatttcttcaacctgttttggctgtttgtggtcggatgcgtgttcggtttggtagtggagacgctataccactatgtgctgttcggcgaatggcaggatcgcgccggatttttgtgggggccgttctcgccgatctacggctttggcgcggtgatcctgacggtattgctcaaccacttgtggcggtcgaattggatgctgatcttctgcgccagcgcggtgattggcggcgcgttcgaatatttcaccagctggttcatggaggttgcgttcggtattcgcgcgtgggattacacgggtcaatggctgtcgattgatgggcgcacatccggcaaatacatg

SEQ ID NO: 1417 - DNA, 1806 bp, Unknown
  Artificiall/Consensus sequence
atgccgtatgacaggcacataagcgcgcatgcggtgcaggaggtcattatgagcgacgccggttcgggaggccgtttccccttcctcaggcgaaacaaaaacagcgacacgccgaacgctttcccgcaaagtatggatccgatcgcgccgacaaccggcgagatccatcaggtgttcacgccgagcacaccacgccatgcggcaatgacaagcgacgtcaccggagattttcccgccatgccaacgtccaccgaaggcatggacgaacagaccgaacgccaatatgccatggcgttggcgcaaggcatgagcctgccgttcgtggacctcaacgaataccagatcgacaaagaagtcatcagcatggttcccgacgatctgtgccgacgcaaccagcttctgccgctttccatcgtcaacgggcgcatcgccgtagccatggcgaatccgaaaaacttcgccgcggtagacgatgtttccgcaacaaccggcatgcccgtcatcgccatggtcgccatgccatcgcaggtacgcgactgcatcaaccggttcctgcgcgccaatgcggagttgaccgaactatcgcacgagatcgccgcgaccgcgaaaaaagaagtcgaccttgaacaagacgacagcgaagacgcctcccccgtggcacgcttcgtaagtctgctcatcaaccaggccatcgacgaccactgctccgatatccatatcgaaccgcaggaagacggtctgctcgtacgctaccgcatcgacggcgtgctgcatatcttccaaaaagcgccacgcgccatgacccaaggtgtgatcagccgcattaaggtcatggccgaaatggatatcggcgagcgccgcaagccgcaggatggccgtattaccgtacgtcacaacggtcagaaggttgatcttcgcgtggcggcattgcctacggtgtggggcgagaaaatcgtcatgcgtattttgagcacgccttcgggcaatctcaaagtggaggatctgaatttcagcgaacgcaatttcgatgtgttttccaaagcgtacaaccgcccgtacggcatggtgttggtgactggtccgaccggttcgggtaagtcgaccacgttgtatgcgacgttgggcgatgtggcccgcccggaaatcaacatcatcacggttgaagaccctgtggaattccgcatggagggcatcaatcaggtgcaggtgaacaataaggcgggtatgacctttgccgccgcgttgcgttcgattcttcgtgccgaccctgatgtggtgctgatcggtgagattcgagacgaggagacggcgaccattgcgatcgaggcttcgctgacgggccatttggtgctgtccacgttgcacaccaatgatgctccgagtgcggtgacgcgtttgacggaaatgggcgtggaaccgtttttggtgagctcgtcgctggctgcggtgatggcgcagcgtctggcgaggcgcctgtgcaagaaatgccggaaggccgatacggccactcccgtggagttgaagatgatgggtgtgccatatacgcccggctctccgttgccgaccgtgtaccgtgcgatgggttgccgtgaatgttccaacaccggatatcacgggcgtgtggccattcagcaggtaatgggcgtggacacgcagatggaggatttgatcgcgcgtggcgccacgtcgctggaaatcgagcaagcggccaagtcgaaaggcatgacatcgcttcgtgaggatggctggcagaaggttctgcaaggcattacttccgtggatgaagtgcttcgcgtgaccgtgtag

SEQ ID NO: 1418 - DNA, 999 bp, Unknown
  Artificiall/Consensus sequence
atgagcgagcgtatggaaaggcaaacaggtgagagctccagcagcgcggtcaaggtgtcgaagctggtcaaacggtatggggatatgctggcgcttgactatttcgatcttgacgtgcatcaaggtgagattttcggtttgcttggaccgaacggttccggcaagaccacggcgattaactgcattctcgcattgttgacgttcgatgagggcacggtacgtgtgtttgacgaaccgattggcccgaccagttatgcgctgaaacgccgcatcggcatcgtaccgcagaatgtggctgtgttcaatgaattgacggttgaggagaatatcgattatttctgctcgctgtatgtgcctgacagggcacgccgtcatgcgctggttgaggatgcgctggattttgtgggcttgcgcgattaccgcaggttccgtccgtcgaaattgtcgggaggtttgcttcgtcgattgaacatcgcatgcggtgtggcgcataagccggatctgattttcttcgatgagccgaccgtcgccgtcgatccgcaaagccgcaatgcgattctggagggcattcagcgccttaaccacgaaggcgcgacggtgatttacacgagccattacatggaggaggtcgagcagatctgcgaccgcattctcatcatggatcatggcaggcatttggccttgggcaccgccgacgagttgaaggcgatgatcgacaccggcgaacgcatcagtgtggaaaccgacgatctgggtggcttgcatcatgaggcgggaacgcagcaggcattggaacagttacgtgcgctgccatgtgtgatgagcgccgattatgacggtcatgagttgacggtacgttgccgtaggggcgatcacaatcttcttgacgtgttgacgttgctgaaatccaatggcacgaatatcgggcatctttcctcccggcaaccgacgctgaacgatgtgttccttgaactgaccggcacggcgttgcgtgactga

SEQ ID NO: 1419 - DNA, 981 bp, Unknown
  Artificiall/Consensus sequence
atgagatttgtagtcaaacggctgggactgttcgtcgtggccctgttcggtctgtcgcttctggtgttcgtgctgttgcgcatgctgccgggcgatgtggctgcggtgatcgcaggaacgaacgcagcccctgaacgtatcgcgtcgcttcgtaccgaacttggcttggacaaattgtacgtggcacaatacggcgattggatgctgggcttgctgcatggcgatcttggtgtgtccaccatcggaggcaaagcggtgtcggcacaggttgcgtctcgtgcttcggtaacgtttccactgatcatcgtgagtttgctgatcgcattggcgatcggcctgccgcttggttgcgctgctgtgctgacccgtaatgcccgcttgcgtgggctttgtcacggtattgcgattgttgccggcgccattcccgcattatggggcgggttgctgttgattctgctgttctcacgcggttcaggactgttgggattgctgcctgctcaaggttttcccgataatggctggggcgcgcccttgcaggcgttggcttctttgatacttccggcgctcgccaccggcgttaccgcaggcgcgtccattatgcgttacacgcgtgccgccgtgggggacaaggcctcgtctcaggcggtcgacatggccatggcatgcggcatgacccgcaaacaggcggtattgcgcgtcgctttgcgtcttgccacaccgcaattggtgtcggtgatcggtttgacgttcgcccagatggtcaccggtgtaatggtggttgagaatctgttcgcgcttccggggcttggcaccatgctggtcaccgatgttggcaatcgagatctgattgcagtgcagagcgaattgttcctgttggctacgttcttcctcttgcttggattagtggttgatgtggtgcatcgtgcgcttgatccgcgtctgaaagatgccggattggtgtcgggggaggtgcttgcatga

SEQ ID NO: 1420 - DNA, 1011 bp, Unknown
  Artificiall/Consensus sequence
atggcgacgattaaagagattgcgcaacgtaccgggttttctcaggctacggtgtctcgacttctgaacggggatcccaccctatcggtgcgtgaagagactcgtcgcaagatcattcaggcgagcgaggacctcggctatagcgtgcagaccaagcgcatcgtcatccctcatgaggttgcattgcttgacaatgaaaagtccgacgaggcgttgcgggactcctatttcaccgatttgcgttcagcgctcgaatgcaatgcggaacagcaacgcatggaaatgacggtgttccacaatctcgacgatatgatcgctcgcagttccaaattcgacgggttcatggcgataggcgccgaccagatcagcgaggaagacttggagcggctgcatagggccatgccgtatggcgtgttcattgacgtgaatccggcgccgaatctgttcgattccgtgcagcctgatttgcagcagaccatgcatgatgcggtcgcggcctgtgctgccaagggcatgaagcgcgttggattcatcggaggcaagggctgcctgatgaacttttatgaggtcgatgaggagaatcgcgccacatatttccgtcgtgaggcaaggcgtttcggtattcaatccgacggattggtgtattccgacggcttgttcaccgtgagcaacggccgtgcgttgggggagcaattcgtgcgcgaccataatggcgtgctgcctgatgccgtgatcgtagctgccgatgtgattgcggttggcgtgctgcaggcgttcaatgcggttggcgtgctggtaccgcgcgatatcagcgtgatcagcattaacaatcaaacgatttcgcagttgacctcgccgccgttgagcacattctccatcgatcagaacgagcttgcgcgtgtggcgacgctgatgttgggtgatgccatttccggcaaacgcacgattcgtcagcatgcgtacctgtcgacgtcgctggtggtgcgcgatagttttgtgccggcaaaatag

SEQ ID NO: 1421 - DNA, 1098 bp, Unknown
  Artificiall/Consensus sequence
atggccgcaaccgatcgcgaacagcagattttggcgtggattaagcagaatcctttgatcagccaaaacgagcttgcggaactgtgcggcatcacccgttcaggggtggccgcgcacatctccaacctgatgaaaaaagggtacatccaaggcaaagggtatatcgtcactccgcccagctatgtggctgttgttggcgccatcaatatagaccattacggtgtcgccatgcaggatgtggttggggaaagttccaacatggggcgcattgtgtcatccgtgggcggcattggttacaatatcgcctacaatctgaaccggcttggcgtgccgaattatttgatttccgtctatggtgatgatgagaacggcgaacgcgtcaagcaggacgcgtatgccaacggcattgacatcacgcatgccaagcagatttcccatatgcctacttccaccttcttgtcggttgtttccgcgcaggggcgtcagattgtgggtcttgatgatatgcagatcagtgcggaaatcaccccggaatttctagcgcaacgagagcagaccatcgtcaatgcggaaatggtggcgattgattcgagcttgccgtctgatgccatagcatgggtttgcgaaaaaacaagtcgaccgattttcgtgcgcgtggtttccgttaataaagcggcgcgaatcacgccggtgctcgatcgcatcgacactatggtgcttaattccgccgaagccaaattcgtgtcggggattgaggtgcatgacgaggccagtgccagagattgcgccgaacatttgctgcggtccggtgtgcgtaatgtgtttctttttgtggatgattcggacatgctgtactgctgcgaacatgaaagctttttctggtctttgacgggaagggcggaggaacgtcgatataccaatggtggtgcgtcggcggcgttgagtgcgctggtgtgggcgcgtcgtgagcataaaacacagcgggaatgcgctagatatgcgtctgcggcggctgcgatgaatatgtctcaggtgcagtcgatttgcgctgatttttctgaagaagctgtgcggcgcaaagctgatttgctgcagtaa

SEQ ID NO: 1422 - DNA, 1800 bp, Unknown
  Artificiall/Consensus sequence
atgagccagacggcttatagaacacatcatgcaaccgaagtgaccgaggaactcgtcggtcagaaggtgacgctctccggttgggtcgatcgtcgtcgtgaccacggtggcgtggccttcatcgatcttcgtgacaacaccggtcttgtgcaggtagttatctacgacgaagacatggcacgtccgctgcgctccgagtttgtgattcaggtggtgggcgaggtccgcctgcgtccggacggtaacgagaatgatcatctggccaccggcaagatcgaggttgtggcggaaaacatcgaggtgctcgccaagtctgacgcgctgccgttccaggtgtccaccgcgttggaaaacgagtccgagaacaagctgccgggcgaggaagttcgcctcaagtaccgttatctcgacctgcgccgcccgtccatgcagcgcaatctgaagctgcgttcccagatgtcgaaggctgctcgccacgctctggaagagatgggcttcgaagaggtcgaaaccccgaccatgatcaagtccactccggaaggcgctcgcgattttgtggtgccggcccgcttggtgccaggttcttggtacgcgttgccgcagtccccgcagcttctcaagcagctgctgatggtttccggcgtggaacgctactaccagctggcccgctgctaccgtgacgaggatttccgtgcagatcgtcagccggagttcacccagctcgatatggaaatggcgttcgtggatcaggaagacgtgatggccatggccgaaaaggtcatcgccgccatctggaagtccgcaggctatgagatccagctgccgattcagcgcatcacttggcaggaagccatggataagtacggctccgacaagccggatctgcgtttcggcaacccgctgatcgagctgaccgactacttcaagaacactccgttccgcgtgttccaggctccgtacgttggtgcggtgctcttcaagggtggcgcggccacgcctcgccgccagttcgacgcttggcaggattgggccaagcagcgtggcgccaagggcctcgcctacgtggtgttcgctgagaacggcgagctcaagggacctgttgccaagaacctgtctgaagaggagcgcgctggcctgaaggaagccgttggggcagaagacggcgatgccgtgttcttcgcagcaggccgtcgcacctccgctcaggagctgctgggtgccgtgcgtgtggaactggccgatcgcgccggtctgctcaagccggacgacttcgctttcacttgggttgtggacttcccgctgttcaagcccactgacgatccggatgacgacgatgtggcagtcggccactccaagtggacctccatgcaccatccgttcaccatgccgtccaaggattggatcgacaccttcgacaaggatccggagcacgccatgtctgattcctacgacatcgtgtgcaacggtaacgaaatgggcggcggttccgtgcgtatccaccgtgatgacattcaggatcgtgtgctcgatgtgctcggcatcactcctgaagaggctgccgacaagttcggcttcctgcttgaagccttcaagtacggcgctccgccgcacgctggcatcgctctcggttgggatcgtaccgccgccatcctggctggcgccgactccatccgcgacgtcatcgccttcccgaaggctggcggcggtcgtgatccgctgaccggcgccccggctccgatttccgacgaacagcgtgcggaaaccggcgttgattatgatccggaagaagacgaagactga

SEQ ID NO: 1423 - DNA, 1269 bp, Unknown
  Artificiall/Consensus sequence
atgcgagcattttctctggttacgttgagtccggaggcgtttgacgatttttccgcacatcacgcggacggcaacttccagcagacctctgccgcaggccgtctgcgtgccggccaagggatcgaagtggaataccttggcgttcaagaaaacggcacaatcgttgcgggagcattattcgaaacgcatcgcagccgcctttccaccttcagtgtggtgcacgacggccccttgtgtgactatcgcgatcgcgaattgaccgaatatttcatgacccaactcaagcagcacgcgaaggcgaaaggttccgcacagatggaaatcgtgccggaaatgccatactgcctgcatgactcgcgtggcggcgaactgccagccgaccaaggtggtgctcctgctgatgatgccgtggaaacgttgaaaaacctcggcttcatgcatgacggcttcaccatcggctacactgcggtgccgcgctggcgttacctgaaagacctgactggcattaccgacgaaaagtcactgctcaagtcgtatgacaagcgcacgcagtggagcgtgaaacgtgccgcatccatgggcgtgcatgtgcgcgagctaggcgaagacgagctgcaggtgtttgccgacatcgagcaggccaccgccgaacgccgtaatttcgaatatcgcggtgaagcctacttccgcaagttcaagcaagcttacggcagcaaagcccacttcatggtggcgcagattcacatcggcgaatacattgccgacatggaatccaagcgcgacgccttgcggaagaaggtcgatacgctgcagaccaaatacgacgagcatccgaccaccaaaacggaacgccagctaggggaggagtcccgaaacttggcggcggcggaaaaacgtttgaccgaggcggccgagtacgccaaagacggtgacgtgcttccggcggcagcatccctattcgtggaacacgctcgtgaaacggtgtatctgttctcaggcagtgtggaaaagtacaagccgttctacgcttccgcgctcattcagcatgatgccatgctgcatttgtgtgtggaacgcggtgtgacccgctacaacttctacggcatcaacggcgtgttcgacgatccggaagatgagggtcgtggcgtactcgaattcaagcaaggcttcaacgggtacgtcgaggaactcatgggctcattcgtgcttcccgtacgcccgctgaccttcaaactcaagaccgccctccgcaaactcctgcgccactag

SEQ ID NO: 1424 - DNA, 1152 bp, Unknown
  Artificiall/Consensus sequence
atgagcgaaacgtcatgtgtgaatgcgaccgttgccgttgtcggcaatccgacgtcgaacaaaggcaagggtgccgaggtcggcaagcaggtggttgagctgctgcaagaggccgggcgccagcatggcttcaacgtgatcgacgtgaccggcgagagcttcgacgattccttggcgaatgccaggaatcgcaggaacgaatacgactacctggtggcggtcggcggcgacggcatgattgcgcttggagccaatgccgtgggctgttccggtaaaccgttgggcattgtggcgacgggttccggcaatgatttcgcccgcggtcttgagctgccggtcaatcgcgtggaaaccgctgtcgacggcatcgtcggcgcgattgtgcgcggcacgcatattgacgttgatatgggtttggccacgtcgttgcagggcgggtatgccgtcgattccagtaccggcgatgatctggtcggcgattcggacgtgccattgcgcccggcggtcaaccgcttctacgcgggcatgctgtcgtgtggtttggatgcgagtatcaacgaccgtgccaaccattcccgcttgcccaacggttcggtgcgctatttcgtggcggcgattgtggaattgacgcatatgaagcggtacggataccacatcaaagccacgttggccgatggaacggtggaagaaagagacattatttcaccgttgcttacggtggctaattcacggcatattggcggtggcattgagatttcgccatattcacgattctcggatgggctgcttgacctggtatggctcgaccacgtgcccaatgtcgccgaatgcgtggatgcggtgtctcacgcgtatagcggcaagatcctcgggtgcaaggtgtttgggtggaagcgtgtgcgcgatatcgaaatcacccgcgcgcaagagggtgatgagccgccggtcttgatggcggacggtgaatatgttggtcgcctgcctgtcaaggtcgtagttcaagaccgtgctttgcgtgtgctggtgccgccggccgtggtggaaagccaagccgccaacactgaagagaaagtgctggaagccatcaagcgtgatcaccgtgatccggttaccggtaaaaccgacacctactacgcgaagcgctcgcggtag

SEQ ID NO: 1425 - DNA, 1413 bp, Unknown
  Artificiall/Consensus sequence
atgaagaaaacgcgaacgtacagacagattcagcagaagaaagcaggtgacatgatgagtgccagtgcaacaatcgcaaccgccaacagggcttccgtgtctgaacagtccgaagagcagaagatggtcaagaaagtggccgtctcgtctttcctcggcaacttcattgaatggttcgactacgcttcctattcctacttcgcgaccaccatcgctttggtgtttttcccgtccggcaatcacacggtcgccatgctgcagacgttcggcgtgtttgcactgtcattcgtgcttcgtccgatcggtgcactgttttggggtaacttcggcgataagaagggacgcaagggcgctcttgcgatttccatcatgttcatgtcgggtgcatcgttcctgattggctgcctgccgtcatatgctgcgatcggcattttcgctccggcactgttgctgctgcttcgcatggtgcagggcttctccgcttccggtgaatatgccggcgccgcaaccttccttggcgaatacgcgccgaccaagaagcgtggcatctactgctcgctgattccggcatccaccgccatcggtctgctcgcaggctccacgctcgccaccgtgatgaccgcttcgctgagctctgatgcactgacctcttggggatggcgtattccgttcctcatggccggcccgcttggtctgatcgtgcatttcatccgtaccaagctcgctgattcgccggtgtatgcttccatgaccgaagctttggacgacaagcagcagttcgcttccaccactaagagcgtctccccgctgcgcgagctgttccagaaccacttcaagactttggtcatcagcttcggtgcctgcgtgctcaacgcggtcggcttctacacggtgctcacctacctgccgacctatctgagcgacacggttggcatggctgccgcacagtcgtccaccatcaccaccatctgcctggtactgtatgtggctttggtgttcggcatgggtcacatctccgacatgttcggacgcaagaaggtgctgattggtgcatgcgtggccttcatcgtgctcaccgttccggccttcatggcgctgaacaccgcacagttctggccggtgctgatcgttgagctcgccatgtgcgccaccctgaccgccaacgacggtacgctttcgagctacctgactgaaaccttcccgacatcggttcgtttcaccggctttgcattcagcttcaaccttgccaacgccatcttcggtggaaccgcgccgttcatcgcaacctggctgatctacaccaccggttcgagcatcgctccggcctggtacatggtggcggtggccgccgtggcactggtcgccatgatcctctctcacgaaaacacggataaggatctgagccgcatctga

SEQ ID NO: 1426 - DNA, 1182 bp, Unknown
  Artificiall/Consensus sequence
atgtccgataccacaatggatcccaaggcgatcgcccaggcggtggccatcgaagtcgccgatgaggatggccaagtcggtgacttcgtcgaagccatcgacttgggagacaacgttactgattttcgttttgaaacctgcatacgtgggtatgagggatggcagtggtcggtgacgttgtatcgcgatgctgagttggaccattggacggtcaatgagtcatcgctggtgcctaccgacaaggcgttgcgcccaccggaatggattccatggaaggatcgtcttgaaccgaccgatttggcggtgaccgattcgatcggcaccgatcccgatgatccacgtatggaagaggggttccgcagaactgagcccgttgagtctgccgaaagcgtttccgacgatgtgcagaccgtcgaagcggcggacggcggcgacaatgccggagcggacgctgacgtggttgacggttcgcaagacgagaatgccgtagcatcggtgacctccgaagaggacatcgacgaggcggttgaggaattcgatctgtcccgcaggcacgtgctcacgcctttgggccgttcccagaccgcgaaacgctggtatgagggaccgcgcggaccgaaatcgttgtccaccaaaacatcggatggcaatccatgctcgacgtgcggattcttcattcctctgaaaggcgaactgaatcttctgttcggcgtgtgcgctaacaagtggagtcctgatgacggtcgtgttgtatccatcgaccatggctgtggcgaacattccgaaatcgagccgccggaaccgtctcacttgtgggtgcagtcgaaacctgcatttgacgacctgcatatcgatatcatcgcgcaggcgccgcgtgatgaacgcggttccgtcgaactgatcgagcagctgtcggtgaatgaagacggcaatccgaacgatgaggaagaagcctccgaagccgatatcgaagccaataccgtggatgatgatgcgaatcaggaggaagtgctcgaacatacggcccagcaggatgagccggaggtggaatccaccgttgatttgagcgatgacgaagagccggttatcgtcgaatccgaagaggatgaagcgacggatgcggaacccaccgaagccgaggaaacggacactgcagaggaaaacgctccggaagctgagtaa

SEQ ID NO: 1427 - DNA, 1743 bp, Unknown
  Artificiall/Consensus sequence
atgaagaaggagttttcaataagtaatgataaagttttgatgaatttttcagctagatattgtactaattttgaaagcttattagaaagtgaaggttttagaagagttttaaatgtttatttaaaaaaatcagaaaaaaagaggtcattagcatacaggtatttagttaattcattagaaactacagatttaccaacaataagaggagatttaactttggtatttaagtggttaacaataatgaatgctaaagaagtttgtgaatttaatcctaaatatgaaaacttattacgcaataaagaagattttactaaagtaattgaagatttttatttattttggagaagattagaaagatatacagttattcaaaatgataaaattagtcaaggcttagcagctatgaattttactgaagcaaattcatcttttgaaaaattaatattaagattttataggaaaattgaacaaaatgtattaggaagaaatccaaaagtgtttagagaaattacagctggtggaaattgtagtataatgattagtaaactattatggcctataccaaagggatatgaaatattagaagatgtaaattttatagattgcattttattagaacctccatttattacttatccaaagaaaaatactagaaatggaatgtttactgaagtaaaggaaaatccattaaactataaacatattaataaagatcattggttttgttatccagctaaagttggagaactaatagcttatgtttattttcatagggattatatgaatcatggaattactttatgtaatttatttgaaatggctacaaaagaagaatgtaggggtagatgtccagatattatttttgtatttggaataaatgatggagaagaattaaaaactattttttatgatgataaagaaaatagtattatgttaggatatattaattattcagaagaaatagattactttggatatatgaaaaaaatgattttaacattgcataatttaataatgataaaaagaggaaatttacctattcatggtgcaatggtaaatattcaaatgaaaaatggaaaaaatgcaaatgttgtaattatgggagatagtggagcaggaaaatcagaaagtcttgaggcttttagaacaatgagcgaagaatatataagtaatatgaatgttatttttgatgatatgggtacattcaaaaatattgatggcaaaatttatgcatatggtactgaaataggtgcttttgtaaggttagatgatttagcacaaggatatgcttttagagaaatagatagaagtatatttatgaatccagataaaattaatgcaaggcttgtaatgcctatttctccctataatgaaataataaagggatataaggttgatttatttttgtatgcaaataactttactgatattttagatggagaaagagcaatagattattttgaaactccagaagaagcaattaaattgtttaaagcaggactaagagttgcaaagggaacaactacagaagagggacttgtaaaaagctattttgcaaatccgtttggaccagctcaaaagcaagaagaatgtaataagttaattgaaaaatattttaatgatatgtttgatggaaatgtaaaagttgggcaaataaaaacttgtttagctataaaaggaaaagaacaacaaggaccaaaggtggcagcacttgatttatttgaaataataaaagaattataa

SEQ ID NO: 1428 - DNA, 1380 bp, Unknown
  Artificiall/Consensus sequence
gtggaagataggagggagagtatggagttaaatttatttgtaaaagaattattttcaaaggcacaagaagaaggattttctgaatatgaagtatattatgttgatagggaaagtttaagtataagtgtttataaggaagaagttgaaaagtataatttaaataattctgcaggtttatcatttagaggaaaatttggcgatagaattggatattcttatactgaaatattagatgaagatgctatagaaatgcttgttaaaaaggctaaggaaaatgtattagcaattgaaaataatgatattcaatttatatatgagggagataaggaatataaggaaataagtacttatcatgaagagttagaagatataccagcagataagttaatcaatattgcaataagtatggaaaaggaagctaaaaaatattgcaataaggtagaaagttttagtggatgttcagtttcatatagttctggaaaatatggaataataaattctaagggactaaacttaagtaataaatctaatttattaacagcttatgttgtaccaatagtaaaagatttggataaaatgtatgatggctgtggatatgtagtagcaaaatcattaaatgatgttaagccagataaaattgctaaaatgggagtagatgaagcattaagtaaaattggaggaacatcaattgcatcaggaaattataaagtaataataaataatgaagcaatggtatcgcttttatcaacttttgcaggaatctttagtggggatgcagtgcaaaagggattaagtttattaaaagataaagaaggagaaataatagctgcagatattgttaatttagtagatgatcctcacttagaagatggtttagcatcagtttcatttgatgatgaaggtgttgcaacattaaaaacttatttaattaagaatggtaagttaaatagccttcttcataatttaaaaacagctaataaggctggagtaaaatcaactggtaatggatttaaatcatcatatgcatcaccaatatcagtatcaccaacaaatttttatatagaacctggtattaattcattagaagaaatgactaagaaaatcaataaaggattaataataactgattttgctggattacattcaggagcaaactcaataacaggagatttttctttagctgctaaggggttttatatagaagatggtataaaaactcacccagtagaacaaataacagttgcaggtaacttctttactttattaaataatatagaagaaataggctctgatttaaaattccctatgagtagtgttggtagtccaagtattgtaataaaagaactttcaattgctggtgagggagcaaagaatgaataa

SEQ ID NO: 1429 - DNA, 1290 bp, Unknown
  Artificiall/Consensus sequence
atggatagttggaaaaataaacaaaaagtcatagttcaattagtatgtattttattatcattatgtttgtggatttatgttacaaatattaaaaatcctattaaatcttatgaattaaaaaatgtaccagtagaaatattaaattcaaatagcttacaagattcaggattagctttagttccaaatcaaaatttttatgtaaacttaaaaatagaaggtaatactcaagatttatttaatgttgataaagatagctttaaaataatagtagatttaagtgaatatgtgcttaaaaaaggtgaaaacaaagttgcagtaaatattaaagaatcgccaagttcaataacaattaaaaatagcaatggcttaacaataagtgttaatacagaagaatatgcaacaaatgaagtgcctgtaaaatcagagataaatataacttcaaaatcaagttattatgttgcaacaccagtatttagtcccaaaacagtagtagtttcaggacctaaatcattagttaagaaagtaactaaagtagtagcacaaggtgaagaaagtaatgcatcaaaaactattgttaaagattttataatatcaccagtagatgaaaatgataatgaagttataggtgtaaaattatcagaaaaatgggtagaaggaactattgaaatcaatgaaggaaaagtagtgcctataaaaataaatacaacaggaacattaaaagatggattaacattaaaatcaatatctggagatatcacagaagttggaataacaggaccagaagatgtattaagaaatatatctgaaattggaacagaagaaattaatttatcagaaataaaagattctacaaatattgaagtagctttaggaataccagataaaatatcaatttataatggaaaaagttcaataaatgttaatatatcaatagataaagccaaaacaaaagattttacaattgcttattctattgtaggagcagcagatggactaactattactccagattcaaataaagttacaataacagtttcagctaattctgatgttttagatagtcttacagaagaaaactttaatgcacaattagatgtatcacaatatactgaagcaggggaatataataaagcaccagaggttacaatagttaatactgataatattactataaataatgttagtgaagtaaaattaacagtaacaaaaaattcagaagataataataatggtagcatagaaacagataaagaaaataatgctgatggaaaagaacaagcaaaagaataa

SEQ ID NO: 1430 - DNA, 2184 bp, Unknown
  Artificiall/Consensus sequence
ttgaaaaaagtaataatagcagaaaaaccatcagttgctaaaaatatagcagatgcatataaaataaaaactagaagagatggattttatgaaggcgacgattatttagtaacttgggcatttggtcatttgcttcaattatatgatgcaaaggattatgatgaaaatatgaagggatggagaatggaaaagtttccatttattccagaagattttaagtacaaaataaaatgtgatagtagcaatagagaagttgttgataagggtgcagaaaagcaaataaatattattaagagcttaattgatagagatgatgttgatggggttatttctgcaactgactttgacagggaaggtcaagttatttcagatgagttatttattcattatgatataaagaagcctatttacaggcttcttcttaatgaatggactgaggatgaagtaaaaaagggaatggctaatttaaaaccaaatagtgatatgaagccacttcaagatgcaggaataggaagacaattggcagattggactataggtattaatttaacatcagttgcaactttaaggtatggagcaagtgaaaaaaagactattaacataggacgggttttattgccaactttaaagataatttatgatagagataaagaaattgaaaactttaaagaatcatcatattttaaattattaattaatttaaagtctaaagataatatagaatttgaaagcctttattatgaaaatggatctgaaaagtttgagaaaaaagattatttagataatttaactaaaatattaaaagaaaaacaagctgtagtaatagataaagaaattgaaaagaagagggaatatccacaaagtctatttaatctttctaatttacaaggatatataacgagtaaatataaagggtggacttctgataaggtattaaaggttgctcaaggactatatgaaaagaagcttataacatatcctagaactgcaagtagtgttttagaagaaagtttagtagataaggcccaaaaagttttagaaactcataaaaaggggttaccttatgaagaagaaataaaatttattaaatctaaaagagtatttgataattcaaaggttgaaagtcacagtgcaattactcctacatatgtaatcccaaaaggattaagtacagaagaacaatatgtttataatgctataaaaaatagatttataatgcaatttatgccagttgctgaatttgaagaaactaaaatcacattaaaggttaatgatgaacatttaaaaggtgaatttatttctaagggaaaggtagaaattgttaagggatggagagttgttgaaaaaatagaaactaaagatactatattacctttgattgaaaaaggagaaaatttagatatagtagatagtaaagtcaataaggtaactaaaaaaccacctaaatatcatactgaaaaaactcttttaagagtcatggagacttgtggaaaatcatttaaaaatgataaagatgaagaagaaaatgatgaaaaaaatactgaagaaatgatgcaagcaattttaagcggatttagtataggcacaccagcaactagagcagaaacaataaagaagcttaaagatataggatatattaaaacaaagggaaaaagtttaacaacaacagaattaggtagaactattgtggagatatttccagccagggaattattggatttagaatatacaggaaggttagaaaaaacattagctgatattgaaaagggaaagtttaaaaaagaagattttttaaatttaatttatgattttacaagacaatctgtagaaaaaattaaaaatgataattctatgcttcataagtttaaggttgaaaaaccagaaggggcagaagaaataggaaaatgtcctgtatgtggcaattcaataattgaaggtgaaaagggatttggatgcattaattggaaaaatggatgcacatatactatttggaaaaatgataagttcattgagtcgttaggtaaaatggtaactaaggaaatggttgaattgcttcttaaaaatggaaaggttggatttagaaatttaagaagtaaaaagggaactttattttctgcatatttaagatatgaaaaagatgaaaagacaggatattatagttggaaatttgaatttataaattag

SEQ ID NO: 1431 - DNA, 2307 bp, Unknown
  Artificiall/Consensus sequence
atgaaaagagagttaactccatcagaaataaaatttaatatatcattaacagaatgcaagagtgatgaaaatacaaaaggaatcaaagaatttaatgaagcttataaaaaaatagaaagggcaataactatagataaggaaggatataacctttacttaatagataccttttctaaagataaattaaaagatttaacttcttttattgaggatacgtataaggatttagaagcacctaaggatatatgttatgtaaccttagaggaagttaacaggccagaggcaatttttgttgcaaatggaaaaggaaaaaagttaaaagaaactgtagataatattaaaaattcttatttagaagtagtagatgatttttatggagattctagcaatgatgaaaaagcttatttagttgaagacatacaaaatagaagaaataattacctagatgaattaaccaaaatggcaaaggctgaaggatttgaagtaaaagctacaagtaagggatttgcttttatacctttaagtggtgaagaagcaatgagtgaaaaagaatatgataatttagaaacagaaaataaaaatgtaatagtagcaaaggctacaaatttaaaaagaaaagcagaaactattttagaagaacttaaagatattgaaatcaagtctattaaaaagttaaaaaagatttattctaagttcttatcaactcaaatggaagaagataaagatgaagcattattagaatttattacagatgatgattcatatgaatatctagaaagattatttacttgtatagaagaagatttaattgagtgttatacaatgaatatagaagatgatgaaagtgagatttatgaagttttaaataagtatgatgttaaagtaatagtagataacaccaataacacatcaccaccagtaatttacgaagaagatcctaatttaaataatttaattggattaatagaatatgaaaatcacaatggaatgtatacaactaatatttcattaataactgcaggttctattttgaaggctaatggaggctgcttaattataagattaaattctctagcagtaaataatttaagttattattatttaaagaaaattttaatttcaaataaagtttcttttgatacaaataagagttatttagagtttattaatattaatggattaaagccaaaatcaataccagttaaattaaaagttattttaattggtgattatgaaacttatgatattttatataactcagatgaagattttaaaaagctatttccattaagagctgaattttcatcagtggtaaaagtaaatgaaaattcaattgttggtataaagaaaattatagaaaaaaagattagaaaaaatgagctttttaatgtaaataatgaagcaatgagtgagatttttaagtatttatgtaagaagagtagcagtaaaaagagaatatttagtgatgaagatgacattgataaattattagtactatctaataatcatgccaaagaagaaaagagaatggaaatattaaaggaagatataagagcagttgcttatgaagaggaattaattgaatcagagtttattagtatgtatgaagaaaagaaaatattgattgaaataaatgatagaaaaattggagcaattaatggacttgctgtcattgataatggatattgtacatttggaaaacctatgaggattacttgtgtagcctataagggagcaggaagaatatttgatatacaaaaggaaagtaatttaagtggaaaaattcatgaaaaatctataagtatattaaaaggattacttactaatattttaaatccctatgaaagtataccagttgattttcatttgagctttgaacaaacttatggaattgtagaaggagatagtgcatctgtagctgaaattatatgtattttatcagcattgagcaaaaaaggaattaaacaaaatatagcagttactggttctataaatcaatttggtgaagttcaaccaattggtggggtaaatgataaaattgaaggcttttttaaagtatgtagtattttagaaagttttgaaggtaaaggagtcttaattccagaagcaaataaagatgaaataatattgaaatctgaagttgaagaagcaattattaatggaaaattttgtgtttatactatgaatagtttaaatgatgcaattgaagcattattattagaagaagatgaaactattgaagagttttatgaaaaattacaagaggaagttgataaatataaagataaagataaaaatcataaataa

SEQ ID NO: 1432 - DNA, 1905 bp, Unknown
  Artificiall/Consensus sequence
atggattttataaaagtaggatctgcatgtcctaaaactaaagttgcagatgttatttttaatgttgaaaatatatgctcatgtattgatgatgcttataataaagatgttaaatttttagtttttcctgaactatctattacttcttatacttgtgctgatttatttttaacttctacattaataaataaatctatagaaggaataaaattagtttgtgaaaatagcattaacaaagatatgctaattgctattggatgtccacttatccataacaatgttctttataatacagcctttataatatttgaaggaaaaattcttggaatagttccaaaatcatatattccaaactatagcgaattttatgaaaaaagatggtttacagctgctacaatgttaactgatgaacttgtagctcttccattccaagaaaatataccatttggaacaaatcttatatttgctgccggtgattataaatttggtatagaaatttgcgaagacctttgggtaacaattcctccaagctcttacttatctcttttaggagctaatattataggtaatctttctgcttcaaatgaattagtaagcaaaaaggattatagactttcattaattgctaaccaaagtgcaagatgtatgtcatcttacatttattcttctgctggagtacatgaatctacaactgatttattatttagcggtcatttagtaataagtgaaaatggtactatattaaaagaaaataatagattccaaagagaaaatgaagttataacatcttgtatagatgtatttaaacttaatgctgaaagattaaaaaatttaagttatagagattcttctaaaatagtgccatttaaacctaaaaatattaactttaattttaaaaatacaaaaataaataattttgatagatatatagacaaacatccctttgttccatctaatgaacatgaaagagaagaaagatgcaaagaaatatttaacatacaatcttcagcacttgcaaaacgtttagaacatactaatttaaagaaagctgtaattggaatttctggtggccttgattcaactttagccttattagttatagttaaaacatttaagcttttaggaatagataatagtaacattataactattacgatgcctggattcggtaccactgatagaacatataataatgcattaacactttgtagagaattaaatacagatttaagagaaataaatatcgttgaagcttctcttcaacactttaaggatattggtcatgataaagatatacatgatgtaacttatgaaaatgttcaagcaagagaaagaactcaaatattaatggatttagctaataaagaaggtggattattaataggtactggtgacctttctgaacttgcacttggatggtgtacttacaatggagatcatatgagtatgtatgctgttaatccatcaattcccaaaacacttgttagatatttagttaaatatgtagcagaaaaggaatctacaaaagaagttgctcatactttattagatattttagatactcctgttagtcctgaacttttacctaaaggtgaaaaaggtgacatagttcaaaaaactgaagatattgttggtccatatgaacttcatgatttcttcttatatcactttattaaacatggttcttctaaagaaagaattgaatttcttgctaaggaagcatttaaagatgattattctgaggaagaaattgataaatggcttgataaattcatttacagattcttcactcaacaatttaaaagaagtgctttacctgatggacctaaagttggttctatttctcttagccctcgtggggactggagaatgccatcagatgcttcatttaattgctttaagtaa

SEQ ID NO: 1433 - DNA, 1284 bp, Unknown
  Artificiall/Consensus sequence
atgaattatgatgttttaatagttggtacaggaattgcaggcctttatactgcacttaatttaagagatgatattaggatattaatgattactaaaaatagctttaaagattgtaatagttatcttgctcaaggtggtatttctacttctcttggcttttttgatgaagaaaattattttaatgatactatgaaggctggaaattataacaataatcctgaagctgttaagttattaataaaaaattcaattgaaaatattaataatttagttaaacttggagttccttttgataaaacaaatgataaattaaattatactcgtgaaggtggacatggcgaatttagaataatacatgttaaagatgaaacaggaaaagcggttactgaaaccttattagataaggtaggtcaaaaaaacaatataaccatgcttgaaaatacaactttaatagatttaatttgtgaagataatatttgttatggaggaattttaaaaaattcttctaaaacttatagtataaatagtaagtttactattttagcaactggtggtattggaggcatatttacatcaactactaatgttgaatatctaactggagatggattaaatataagtttaaaaaataatatttctattaaagatatggaatatttacaactacatcctactgttttatatgaacctaaagttaaaggaaagaaactacttttatctgaatctcttcgtggtgaaggtggaataattttaaaccaaaataaagaacaatttattgactctttgcttcctagggatattgtatcatctgcaatattaaaagaaatagaatctactcctaataaaccttatgtttatcttgatatgacaaaaaaatcaaaagattttttaatagatagatttccttttttatacaatgaatgtttaaaaagagggtatgaaatggataaagatttattaccaatagcccctgctcatcattattgtatgggtgggattaaggtagatttattttcaaaaacatctatgaataacctttatgctgttggtgaagttagctgtacaggtgtccatggaagtaatagacttgcaagtaattcattgcttgaagcattagtatttggaaaacaagcagctgaaaatattaattcaaaaattaatgaaatttcatttaaagaaattattaaagaaccaaaatcatatgccttagattcatatgaagaattaataaaatttttgaaagaaaaggtggataacagatatgctaaactatttaattgttga

SEQ ID NO: 1434 - DNA, 1665 bp, Unknown
  Artificiall/Consensus sequence
atggaaagcaagaagaagataaaggtcataccattaggtggacttggggaagttggtaaaaatataatggtaatagaatatggtgatgagataattgtaatagattgtgggatgacttttcctgacacagaaatgtatgggatagatatagtaattcctgatgtaagttatttagttgaaaacattgatagagtaaaaggattttttataacacatggacatgaggaccatataggggcaataccatatattttaaagcaagttaatgttcctatatttgcaactcaattaacagcaggattaattgaaagtaaattagaagaacataaaatgcttgataaggtaagtataaatattgtaaagcaaggagatatagtaaaattagataaattaaaggtagaatttataaggactaaccatagtatagccgacagttgtgcattagcaattcatacacctattggaatagttgttcatactggagattttaaggtggattttactccagttgatggaaaggtaatagatttacaaagatttgctaagcttggtaagcagggtgttttattacttatggcagatagtactaatgcttgtcatccaggatatactatgtcagaaaaaagtgttggagaaaaattagataatttattttctaaaggtaagggaaggataatagttgctacatttgcatcaaatattcataggttacaacaaataattaattcatcaattaaatatggtagaaaaattgcttttagtggaagaagtatggagaaaatttcagaagttgcatctaaacttggttatttagatatgccagaaggattattaattgatttaaaagatttaaagctttataacaataatcaaataacaattgtaactacgggaagtcaaggagagccaatgtctgctcttactagaattgcatcatctactcataagagtatacaaattgaaaaagatgatatgattattatttctgcaagtccaataccgggtaatgaaaaggctgtatcaaaagttataaatgaattaactcataagggagcagaagttatttataagtcaattgaggaaatacatgtttctggtcatgcttgtgaacaagaattgaagcttatacattctatgttaaaaccaaaatattttgttccaattcatggtgaatataagcatttaagaaagcatattttaatagctgaagaagtaggattagaaaaaggaaaatcatttatattagaaaatggtgatgttttaagtttaaatagaaaatcagcagctattattaataaagttcaagcgggcaatgtattagtagatggtagtggaattggtgatgttggaaatatagtattaaaagatagaaggaatttatctaaagatggtataataaatgttattgttgcaattgaaagagaaagtcatacaattgttggtggacctgatataataactagagggtttgtatatgtaagagaatcagaagcattagtgaatgaaataaaagaaatttcatatgaaagtatacaaaaatctatagataataatatatttaagtggtctgaaataaaaaataatataagaaatgatataggctcatttatatatagcaaaacaaaaagaaagcctgtaatagtaccaataataatggaagtttaa

SEQ ID NO: 1435 - DNA, 1026 bp, Unknown
  Artificiall/Consensus sequence
gtgagggaaaagaaagtgagaaagataaagaacatagtagctattgcaactgttgctgttatggcattttcaatggcaggatgtaaaatgatagaaaagactccagcagctatacaaaaaactgtattagctaaggttggaaatgaaaaaattactatggcagatgttaatagtgaattaaaaagtgatatagattatttaatccaaacgtatggtaaagattatgaaaattctatggatgatacaatgaaagaaaaattaaaaagtgcaagaaaatctgttcttgaacaattagtaaatgataaggtattaataactaaaggtacagaacttggatatgtattatcaggtgatgaattaaatgctgctatagaaaaagaaagacaaaactttgttgaagcatatggtggagaagataaattacaagaagcaataaagtattatggaatggatgatgataagtttaataaatttcttgaaaatttagtaaagactaacgaagttactgaagctataacaaaagatgttactgtaacagatgaagatgttgaaaaatattacaatgaaaatatagataaatataaaaagaaagcaggagcaaatgctaagcatatattatttgaaagtgaagatgaagcattagctgctaaagctaaaatagattcaggagaaactacttttgatgctttatttgagcaatataaaggaaatgcctcaggaaaattcccaaaagcagaagatttaggttatgttgaaaatgataaagaaaactttgatactgacttcttagctggatttaagcaattaaaagagggagaaatttctgcaccagttaaaagctcatttggatatcatataattaaagttgaaggagttcaagcagaagatacaacaactccacttgatgaagttaaggattctataaagtcaactttagaaactgataaaaagaaagaagtttataattcaacattagaacaatggaaaaaagatttaaaagttaaaacatacgaaaatagactttaa

SEQ ID NO: 1436 - DNA, 1806 bp, Unknown
  Artificiall/Consensus sequence
atgcaaagtaatagacaatcaaagattagaaacttttcaatagtagcacatatagatcatggtaagtcaaccctagcggacagattattagaaattacagggactcttactaaaagagaaatggaagaacaagttcttgataatatggaaattgaaagagaaagagggattacaataaaatctcaagcagcaagacttgtttatagacgtgaagatggtgaagagtatatattaaatttaattgatactccagggcacgtagacttcacatatgaggtttcaagaagtttagcagcttgtgagggggcacttcttgtagttgatgcaacacaaggtattgaagctcaaactttagcaaattgttatcttgcattagataatgatttagaaattgcacctattattaataagatagatttaccatctgctagaccagatgaagtaaaggaagaaattgaagatgttattggtattgaagcagaagatgcaccaatgatttctgcaaaaacaggtttaaatgttgaagatgtacttgaaactataattgaaaagatacctgcaccaaatggagatgaagaagctccacttaaagctttaatatttgactcatattatgacagttataaaggtgttgtatgttatgtaagaatattagatggtaaagttaaagcaggaactaaaataaagcttatgaatacaaataaggtttatgatgtagttgaagtaggggtgtttactccaaaactattctcaacagctgaacttatggctgggggtgttggatatataacagcatctataaaaaatgttgctgatgctagagttggggatactattacagaatcagaaagaccaacagaacatgcattaccaggatataaaaaagcagtaccaatggtttattcaggtatttatccagttgatggagctaagtatgatgaattaagagaagcattagaaaaattacaaataaatgatgctgcattagattttgaaccagaaacatctattgcattaggatttgggtttagatgtggattccttggattacttcatatggaaataattcaagaaagaatagaaagagaatttaacttagatattataacaacagctccatctgttatatataaagttactaaaacaaatggtgaaactatagatttaacaaatccaactaatttaccagaaccaacagaaatagattctatggaagagccaattgttaaggcatctgtaattgcaccaactgaatatgttggagctataatggacttatgtcaagaaagaagaggagtttatatagatatgcaatacttagaagaaacaagagtatgcataaactatgatattccattaaatgaaattgtttatgacttctttgatactttaaaatcaagaacaagaggttatgcttcatttgattatgaatttaaaggatatactaaaacagagcttgttaagcttgatatacttttaaatggagatgtagttgatgctttatcaatgattgttccaaaggaaagagcataccataagggaagaggaattgcagaaaaacttaaggaaattattccaagacaaatgtttgaagttccaattcaagctgcagtaggatctaaggttatagctagggaaactgttaaagctatgagaaaagacgtacttgctaaatgttatggtggagatatttcaagaaagaagaaacttcttgaaaagcaaaaagaaggtaaaaagagaatgagacaagtgggatctgtagaggtaccacaagaagcatttatggctgttcttaaagttgattaa

SEQ ID NO: 1437 - DNA, 1680 bp, Unknown
  Artificiall/Consensus sequence
atgaagaaaaagattataactttagtagttattactgtaatttttgcattggtaattgtaacgagttgttttataggattagttaatataagtaccattaaagatgcaaaagaaacattagcaatatataatgagtgtgtggtaagagaagattataaagattcaaaattattatcactatataagtttaaagataatttagttagatttactgtgattaataaagagggagaggtaatttttgataatgaaattactaagttagataatcataataatagacaagaaattatagatgcatttaaaaatggttctggaagcagtgtaagatatagtgagagcttatcaaccagcatggtttatgttgcaactaaaattgatgacaatactgttataaggagttcagttccagtaaatagtattagagtatttacttcagggactttaaaatactatattgcaattatattattagtgtttgttttatcattatttcttgcagtaaagcttgttaaaataattgtttatccaataaatgaacttcaaaaggttacttctaaaatcgaaaatggagatttaaataaaagagctattatttataattatgatgaaataggctttttagcacaaacatttaataatatagcagatcaacttgaaataagaataatagattctttagataagaaaaataagcttgaagcaattcttgaaagtatggaaagtggagtaattgcaattgataataatgaaaatataattttaattaattcttattcacaaaaattatttgatttaaaggaagataatataggtaaaaaaatatctgattgcataatagattatgacttaattaattttattagagaaattccagaaataggaacaaaggaaattaaattatttcatccaattgaaagagagcttagggttaaaaaatcaccaattataaattatttaaataattcaattggaattgtaattacggttcaagatataactgatattaaaaggcttgaaaatatgagaagtgaatttgttgctaatgtttctcatgaattaaagactccattaacatctattaaaggattttcagaaactttaagatatgtagatgatagtgaaactaaaaataagtttttagatattattgataaagaatcagaaaggttaactaatttaataaatgatattttaattttatctaatattgaaaatattcataaaatggaaagtgaatattttaatccaggtgatgttatagaaaatgttttagatatggtaaaaagtcaggcttataaaaaatcaattattattaaatataatgattgttttaatagtgaaattttaggaagcaaggataaatttcatcaattagctgttaatttaattgaaaatgcaattaaatattctaatgaaaatggagttgttaaaattgatttaactttggaagagcaatactttgtttttaaagttaaagataatggaataggtattcctaaaaatgatattccaaggatatttgaaaggttttatagagttgataaatcaagatcaactaggggaactggacttggattagctattgttaaacatattgtgaagttatttaatggagaaataagtgtaaaatcaaaagtaggaagaggtagtacctttactgttaaaataaaaaagtaa

SEQ ID NO: 1438 - DNA, 2013 bp, Unknown
  Artificiall/Consensus sequence
atgaaaaaaattagtcatggatgtactttagattgtgcagattgttgtaaatttaatgtgtatgtaaaaaatgatgatattataaaaatagaaggtgataaggagcatccttatacaaaaggatttatatgcaaaaagggattagctcacttaaaaagattaaatcatagtaaaagaatttataagccattaataaaaattaatgataagtggaaagaaattgagtttgatgaagctataaatataatggttaaaaaattaagttattataaaagtaaatttggaagcaaatcaattttatattatgagcaatatggaaatggtacagtattaaaaagtattggagaaaagttttttaatttttatgggggagttagtttatcaaaaggggggccttgctggagtgcaggaattgcagcacaaaagttggattttggtgattctagaagtcattcattagaagatatgttaaatagtaaaaatatatttgtatgggggaaaaatcctgctaatacaacaatacatactatgcaaatgataaaaatggctaaggaaaaaggaagtaaaattattgtaatagatccaatagaaactgcaactgctaaattagcagataagtatattaaaattaaagcaaatggtgataaagcattagccttagcaatggcacaaataataattaaaaataaattatatgatgaaaaatatataaagctatatgttaatggatttgaagaatataagagttatatattatcattaaatattaaagacttaagcaaggaatgtggagtagaaatttctacaatagaggaacttgtaaaattatattgtcaaaagtattctactattttattaggctttggaatgcaaaaatataaaaatggtgggatgactataagattaatagatgctttaggtgcaattacaggacaaattggatttagtggtggtggagtaaattatgcaaataaagtatatcctaaaatattaaatactgatccttatgatagtgaaaagttttcaagtaatagatattatcatacaaatgaaataagtgaatttatagaaaaatgtaatttaggaaatacctattataaaaatgatatatttataaatcatgaagataataaaggtgattatgaattaaacattccaataaaaatggctattataactaaaagtaatttattaaatcaacttgctaatataaataatttaaaaagagctttatctaaggtagaatttaaagtatgctttgatatgtttattacagatacagttaaggaatgtgatttgtttataccagtaactagtcagcttgaaagtgaagacttattatttagttcaatgatgaatccatatttagtttataatgaaaaaatattagaaccacaagaaaaattaatggatgaatattatttctttatggaagttgctaaaaggttaaaaatgagtaattatccaattgtaacaaagaaagaatatttagaaaaagtaatatatccattaaaaaatattaatagtgatataagtttagaatatttaaaaaataattattttaccttacataaggatgttgcatggagtgacaagaattttgtaaatgagagtggtaagtttgaaataataaactgtgaagaaattaaaaaatttgaggctaataaatataaggatataagcaaattaagattattaactaatcatgggagggatagtttatctagtcagcattttatggatgatgatggaatagctattgcatatattaatgaaaaagaagcaaaaagatttaatataaataataatgaaattatatatttaaaatctgaaaatggacaaataaaggtaaagataaatatagataaatccattggagataatatagtaatgatgtttgttggatggtgggaaagacatggaaatcctaatttcttaactaatagtgggatatctgatattggtggacaaattacttataatgaaacttttgtagaaataataaaaaggtaa

SEQ ID NO: 1439 - DNA, 1107 bp, Unknown
  Artificiall/Consensus sequence
atgaataactgtattggtataattaatttagatgaaaatgaaaaaaaaacaacggagttaacaagacataggccattagcatctttacctatagctggtagatatagagtggttgatttcattttatcaaatatgactaactcaggtatagaagcaataggaatttttacaaagaataattcaagatcattaatggaccatttaacaaatggaaaaccttgggatatatatcgtaagaaagatggattaaaggtatttaactttagtgatgaacctccagtacatgatgatgttcataattttttagataacattgattattttgatcgtagcaaaaaagagtatacgttaatctgttcttcatatatgatttgtaatatagattataatgacttaattaagtatcatattgaacaaggaaatgatgtaagtgttgtttataagaatgttaagcatgtagaagaaaactttatagattgccaagtattgaatttagatgaaaattcaagagttattggtgttggagaaaatgttggattaaaaaatagtgctaatattaatatggaaatgtatataatgaaaacagatctttttattgatatgatatatgaatgtattagaggtggaagatataaaaagattaaaaattatattaatggaaatatagataaattaaaagttggagcatatgaatttgaagggtatctagcttgtataaattctataaatgcatattttgatgcaaatatggattttttaaatgagaaagtaaataaagagttattctatagtaagttcccaatatacacaaaaccaaaggatgcttgcccaactcaatatactgtaacaagtaatgttataaattctataattgctaatggttcctatattgaaggagaagttaagaattgtgttataggaagaaatgtttatattggaagaggtagtgtaattgaaaattgtgttatattacaaaatactgttataggaaataatgtaatgatgaatcatgcaattactgataagggaacattagtagatgataatgaagaagtaaagggattaatagacaatcctgttgttattcctaaaaagagagttgtttaa

SEQ ID NO: 1440 - DNA, 1059 bp, Unknown
  Artificiall/Consensus sequence
ttgaatcaaaacataatagaaatacaaggtgtatctaaggtttatggtgataatactgttttagataatctttcattaaatataagaaaaaatgaattcttaactttacttggtcctagtggatgtggtaaaactacaactcttaaaattatagctggttttgaaactgccgatagtggaaaagttatatttaatggaagtgatatttcaaacatacctccatacaaaagacaattaaatacagtattccaaaagtacgctttatttcctcatatgaatatttatgaaaatattgcttttggattaaaaataaaaaaattaccaaaggatgaaattgataaaaaagttcgtgaaatgttaaaaatggtatcacttgaaggctttgaaaaaagatctgttgattcacttagtggtggtcaacaacaaagagttgctattgctagagctttagttaatgaacctaaggtacttttattagatgaaccacttggagcattagacttaaaacttagaaaagaaatgcaacttgaattaaagaaaatacaaaaaagacttggaattacatttatttttgtaactcatgatcaagaagaagctcttactatgtctgatactatagttgtaatgaataaaggtaaaattcaacaaatgggttctcctgaagatatttataatgaacctgctaatgcttttgttgctgattttattggtgaaagtaatattttaaatggaattatgcttgaagattataaagtaaaatttgcaaataatactttcacatgtgttgatggcggatttaacaaaaatgaagatattgatgttgtaattagacctgaagatatagaaataactactcctgataaaggaatgttaactggaaaagttaattctgttatttttaaaggcgttcattatgaaatggaagttattactgaagatactacatggattgttcataacattaaacatgcagaagctggaaaaatagttggcctaataatagacccagaatctatacatataatgagaaaggtgaaaggttatgaaaaagaaaagtaa

SEQ ID NO: 1441 - DNA, 2334 bp, Unknown
  Artificiall/Consensus sequence
atgaatagtgaatcaattttattaccagtaataccgttaagagggattactatttttcccaatatgattatacattttgatattggaagagaaaaatcagttgcatctcttgaacaagctatgttgaaagatggaaatatatttttagtaactcaaaaagatccaaatcttgaacttcctgaagataaaaatgatatatatagtataggtactatatgtaaaataaaacaaatacttaagcttccaaaaggaggagctacaagagtattagtagaaggaatagaaagagctgaagttatagactttatagttaatgaaacttttcttgaatgtaatgttaaaaagatattagataaggaatctgatgttgaagataaggaagatacagcttttaaaaatcaattaataaaggcatttgatgaatatatatatgctacagaatgtgatgaaagtaaagtatcaagcttaattgatcaagaaaataatttaagtaagatatcagatttagtagctgcttacatgcaattaagtgatgaaaaaaagcaaattatattagaaactatagatgttcatgaaagaatagaaaaactattaatatttatagaagaagaaattcaaatagttcaaatagaaaaagaaataagtaataaggttaaaacaaaaatagataaaagtaataaagagtattttttaagagaacaaattaaagctattcaacaagaacttggcgaagatgaacaagctagagaagtcagtaaatatgtaagttatcttagaaaatctaaattatctaaacaagtaaaagaaaaagcacagtatgaaatagatagattattaaaggctaattctggagatgctaattatattagaaattaccttgattggttaatagctttaccatggggaaaagctacaaaagattcttttgatatagataaggtttcaaaggtattagatgatgaacattatggattacaagaagtaaaggaaagaattttagagtatttagctgttaagcaatatacaaaatcactaaagggaccaatcctttgtttagtagggcctccaggtgtaggtaagagttctatagctgaatcaattgcagattcattaaatagaaagtttgttagaatttcattaggtggaattaaggatgaagctgaaataagaggtcatagaagaacttatattggtgctatgccaggaagaataatttatgcattaaaggaagctaaagtaaataatccattaatcttattagatgaaattgataaattaagcaatgattataaaggaaatccagcagatgcgttactagaagttttagatccaaatcaaaataaaacatttagggatagctttatggaagttgatattgatttatcaaatattttatttgttactacagcaaattctctagaaactattccaagagcacttttagacagaatggaaataatagaggtttcaggatatacttatgaagaaaagtttaatattgcaaagaagcatttattaaaaagagtaatgaaagaatgcaatgttgatgaaagtaagattaaaatatctgataatgcaattaaagaaattattaatggttatactagagaatctggagtaagatcattagaaagagaaattaacaaagttattagaaaaagtataattgagttaattaagtctaaaaaggaaagtattaaaatttcttcaaataatttagaaaaatatctaggacctataatttatgaatttgaaaataaagaaaaagaagataaagttggagttgttacaggattagcatggacagcatatggtggagatactttaccagtagaagttgcagttatgaagggaaatgggaaacttgaattaacaggtcaattaggagatgttatgcaagaatccgctaaaacagcttatagctatgtaagagcaaatagtgataaatataatatatcagaagagttttataagaaatatgatattcatattcatgttccagaaggtgctgttcctaaagatggtccatctgctggagttactatggttacagcattagtatctgcattatctaataaaaaggtaaagggtaatgttgcaatgactggtgaggtaacattaacaggaagagtattacctataggtggtgttaaagaaaagtgtttggcagcacatagaataggaatagatacaataattttaccaaaagaaaataaaaaaaatgtaaatgaaataccaccttcaattaagagcaaattaaatttaatatttgcagataaagtagaagaggtattacaaaatgcattaatcggagttgatattagtgataattaa

SEQ ID NO: 1442 - DNA, 1419 bp, Unknown
  Artificiall/Consensus sequence
atgcaaaaaacaaaaatgatttttactattggcccatcaagtgatagcgaagaggttttaacacaatttattcaaattggcatgaatgtggctagattaaatttttctcatggaacacaagaaactcataaagaaaaaataaacttaataaaaaaaattagaactaaacttaatactccaacagcaataatgttagatattaaaggtcctaaaataagaactcataattttataaatgatggagttgaattaaaggaagggcaaaacttcatctttaaatgcaataaagaaattttaggaaataataaagaatgttctatttcttattcagagctttataaagatgttcatataggtggaacaatactagttgatgatggattaattgcttttaagattatagatataaatcgtagtgatataatttgtaaagtattaaatgatggaattattaaaaatcataagggggtaaatgtacctaatgtaagtatcaatcttccttctgtaactgataaagataaatgtgatttaatatttggatgtaaaatgggtgtagattttgttgctgcatcatttattagaaaatcatcagatataaaagaagtaagagaaattctcaattcccataatggtaataacatccaaataatagctaaaatcgaaaatcaagaaggtgtaaataatattgattccattttacaagaagctgatggaataatggttgctagaggtgatatgggtgttgaaattcctattgaaaaagtgcctattattcaaaagaaaataataagaaaatgtaatgaatctggaaaaattgtaattacagcaactcaaatgcttgattccatgataagaaattcattacctacaagagccgaagcttgcgatatttgtaatgctatttttgatggtactgatgcaattatgttaagtggtgaaagtgccagtgggcaatatccaatagaagcagccaaaactatgtctaaaatagctaaagaaactgagcttcacttagattataattatttaaatcaatgcttaaaagaacctgcaatgtatgattttgcagaagctattagttattctacatgtagaacctctaatgtacttaatgccaaagcaattgttgctgcaactaattctggttctacagccaaacttgtttctaagtataaacctaaatgtcctattgtagcaataacaccacatgaagaagtattgcgtggattaagcttaaattttggtgtttatcctgtattatgccaagaatttgcaaatactgatgatattttaaacgaatcaaaaaaaatcgttacaaaaatgaacttagcaaataaaggcgatgatattattgttgctgctggaatgccaacaaattatactggtggaacaaatatgcttaaaatagaaaaaatttaa

SEQ ID NO: 1443 - DNA, 2232 bp, Unknown
  Artificiall/Consensus sequence
atggagatattagatggcttagttgaagctgtaatatttaaaagtgaggatactggttatgtagtagctaaaattacagctaataaagaagtaaatacaattgtaggaacaatgccattaataaaagaagggcagcaaattgaggttaagggtgaatggattaaacataagcaatttggaagacaatttaatgtagaagaatataaagaagttttaccaacatcaacaaaagaaattgaaaaatacttaagcacaggaataattcatggaataggaccagtaacagctaaaaaaatagtaaaagcttttggagaagaaacattaaatatattagataataatattgaaaggttaaaagaagtagaaggtattgggaagaaaaaatataatattatttatcaatcatatttagaaactagggaactcaaagatataataatgttttttcaaaaacatggggtaactataaatcaatgtttaaaaatttataaaaaatttggtggagatgcacaaaatattgtatctgaaaatccatatattttaagtgatgaaatttcaggaattggttttttaacatctgatagaatagcaaaaagcttaggaattgaacctatatcagattttagaatacaaagtggaataaaatatgtattaaatagtttttcagggcttggaaatacatatatgccaaaggataaacttataaatgaagctcaaagggttttaagtgtagataaagagttaatagaagttaatatatataatagtgtcttagaaggaaaaataaagatagaaaagataaatgaaattgaagctgtatactcattaccatattatttttgtgaattaggagtaactaataagataattaccttaagcattgaaaactttcaaactataaactctgatattacttttgaaatatcaagttttgaaagaaaaaataatatagtatttgcagattctcaaaaagaagcaatattaggtgcctttgaaaatggaattgaaataattactggtggtccaggtactggaaagacaacaataattaaatgtataatagaaatatatgaaaataatggaatgaaggttcttttggcagcaccaacgggaagagcagctaagaggatgacagaatcaactggtagagaagcaaaaactatacatagattattagaaatgggagtgagtgataatgaaaattcattctttggaagaggtgaaggagagccactagaaggtgatgtaataatagtagatgaagcatcaatgattgatataatgcttatgaatagtttacttaaggcaattaaacttggaacaagactaataatagttggagatgcagatcaattgccgtcagtaggtccaggaaatgttttaagggatttaatagatagtgaatttattaaggtagttagattaaaggatatatttagacagggaaaagaaagcatgattataacaaatgcgcatagaataaataatggtgaactaccttatttaaataaaaagggtggagatttcttttttgataatagagaaagtaatgaagaaattttagaaactattttagatttagtaaatagaagattgcctcttttcaactctaagtggagtaagataagggattttcaggtactttcacctactagaaaaggaattttaggggtagataatttaaataatgaacttcaatctatattaaatcctcctagtaaagataaaaaggaaagaaagtttaaggatagtgtttttagagaaggcgataaggtaatgcaaactaaaaataattattcattaaaatggaatagaataaatggatatggtgataatgaaggtgtaggtatttttaatggagatatggggtttattgagtcaattagtgaagaaaatagaacagtaacagttgtatttgatgatgaaagaagaatagtatatgacaacctatatgttgaagaattagaattagcatatgcaattactattcataaaagtcaaggaagtgaatttaaagtaataataacaccagcatttatgggttcagcatttttgatgaatagaaatatattatatacaggaataacaagagcaaaagaattagttgtagtagttggaaatcaaagggcattaaagtatatggtagataatacaaatagtatggagagatattcatcattaaaagaaagaattttagatattatatctgatgataagataaaggaagaataa

SEQ ID NO: 1444 - DNA, 1617 bp, Unknown
  Artificiall/Consensus sequence
atgacgaatttaaaatttactgatttaggcttaaaggagactttagtaaaagccattgacgacttaggttttattacaccatctccaattcaagctgaagcaattccagttgcacttgaaggtattgatataatcggtcaagcacaaactggtactggtaaaactgctgcatttggtttacctttaatcaataacttaactgtaaaaaatgcaattgggtcaataattcttgctccaacaagagaattagctatacaagtacatgatgaattagtaaaattaactaagtacgaaaaattaaatatagttgctgtatatggtggtgcaccaattcacattcaagcaagagatttaaaaaaagctaacattgtagtaggaactccaggtagagtcttagaccatattagaagaggcaatttacctttatcttgtgtagaatttttagttttagatgaagctgatgaaatgttaaacatgggattcattgatgatatggaagaaataatgaagagcattcctgaagaaagacaaactatgctattctcagcaacaatgccaccacaaataaagaaattatctaaaaaatatttaaaagaagatgctaaacatgttgctattgcaagaaaagaattaactggttctacaattactcaaaattattttgaagttaatggttctcaaagattagaagctctttgcagattaatagatcttgataatccatctgctggtattatcttctgcagaactaaaaagggcgttgatgaattagttgcttcaatgcaagctaaaggttatatggttgaaggaatgcatggagacatgtctcaaattcaaagaataaaaactttaaataagtttaaaaatggttctttaaaattcttagttgctacagacgttgctgctagaggaattgacgttgatggtgttactcacgtatttaactatgaattacctcaagatattgaatcatatgttcatagaattggtagaactggtagagctggacgtgaaggaactgcttacagcataataactcctaaagaatttggattccttaagcaaattaaaaatgttactaagagtaatattgaaagaaagcaagtacctacagttcaagaaatttataatgctaaatttaaaataatgacagaagaagtttcttcaataattgaagctgaagattattctaaatttgtagatatagcaacagaattaacacaaactcatgattctgttaaggttatagcttctttacttcaaagccaatttaaaaatcaattatcttttgattattcttctgacaaattagaatcacctgctaaggttaagggagatgatgttagattattcttctcagctggtagaagagatggcttaactattaaaacattaattagctacattaagaataatgcaaaagtaggagcatctcaaataagagatattgatataatggagaactttgcatttgttaatgttgataactctattcatagacaagtacttgaaaaatgtactggtggaaaaattaataagagaagagttaatgttgaagtttctactaataacaaaaagaaaagcagaaatagaaatagaaaatctaaaaataattaa

SEQ ID NO: 1445 - DNA, 2244 bp, Unknown
  Artificiall/Consensus sequence
atgcttaaattattaaaatacttgaaaccttttattggttcaatgataattgcaatagcatttttatttgttcaagctgtatgtgatttatcattaccagactatatgtctaatatagttaatgtaggaatacaacaaggtggagtagaaaatgctgttcctaaggttattaaatcatcagaaatggaaaagcttttaatttttatgaatgataaagaaaaagatttaataaataataattatactttgttagataagaacagtcttaattttgaggattataataaaaatttaaaaaagtatcctgaattagaaaatgaaggtatttacaaattaaatacaaaaaataaagaaaaattaaaacaattaaataaggtatttggaaaagcaatgattgttgtttcaatgttagaagcacaagggataaatggtataccaggaattgcacaagcattacctccaggaactgatatatcatctataaatacttttgatgttttgaaaatgatgccacaagagcgaattgatggtatattaaaacaagtagatgaaaaattagctgaaatgccagaaagtatgataacacaagcagctacaagctatgtaaaatcacaatataaagctgctggaattaatacagataagcttcaatctaattatgtaattcttgctgggttaaaaatggtgggaatagctttaattagtatggttgcaaccgtaattgtgagttttatagcatcaagagtaggtgcagcattaggtagaaatttaagaaaagatgtatttaataaagttgtagatttttcaaatacagaatttgataaattttcaacagcatctcttattacaagaacaacaaatgatatacagcaaattattatgcttattataatgggcttaagaattgtattttatgcaccgatattaggtattggtggtgttattaaagttattaacactggagcatctatgggatgggtaattggagttgcagtaatttcaatattacttttaattatagtattattttcttttgctatgccaaaatttaaaagtgtacaaaagcttgttgatagattaaatcttgtaacaagagaaagtttaactggaatgttagttattcgtgcatttagtacacaaaaatatgaagaagataaatttgaagttgcaaataaaaatttaacaagaactaatttgtttgttaatagaattatgacaactatgatgcctttaatgatgtttattatgaatgcaattacattattaatagtatgggttggggctcatagaattaatgatggtattatacaagttggtacaatgatggcatttatgcaatatactatgcaaataattatggtatttttaatgatatctatggtttcagttattttaccaagagcaatggtttcagctcaacgtgtatctgaagttttaaatgttgatatagcaataaaggattcagataatttacaaacatttaatcatgatgaaaaaggaactattgaatttaaaaatgtttcatttagatatccaggtgctgatgaagatgtaataagcaatattagttttaaagctctttcaggaaaaactactgcatttattggtagtacaggaagtggtaaatctacattaattaatttaattccacgtttttacgatgcaacaaaaggggaaatattaattgatggtgtaaatattaaaaatgtatctcaacatgatttaagagaaaaaataggatttattcctcaaaaggggcttttattttcaggtacaattgaaagtaacttaaaatatggtggagattatataacagatgaagatatttttaaggcttcagaaattgcccaagcaatggaatttataagtaataaagaagaaatgtttaatgcagaaattgctcaaggtggtacaaatgtatctggtggacaaaaacaaagattagcaatagctcgtgcaatagctaaaaagccagaaatatttatatttgatgatagtttttcagcattagattttaaaacagatgctaaattaagaaaagcaataaatactgaattaaaggaaagtacactgttaattgttgctcaaagaataagcactataatgaatgcagatcagattatagtacttgacgaaggtaagattgtaggtaaaggaactcataaagagcttatgaacaactgtgaggtttatcagcaaatagctctatcacaactttcaaaggaggagcttgaaaatgagtaa

SEQ ID NO: 1446 - DNA, 1902 bp, Unknown
  Artificiall/Consensus sequence
atgattgataatttactttatactataccaaaggaaaatcatacaaaagaccagataatagaaatattatctaatcatccagaaattaaatttgtttcatttgttggtattgatctttctggaaatgatacagatgaaaaaattcctgtaaacttatttttagaggatattgactctttccttcatggagttgcagttcaaacagatggatcatcagttgtacttcctggaattgcaacattaaataatgctaaagttgatatgataactgatttagatagtaaatggtttgttgactataactacgattttatagattctataacaaataaacctattggtacattaagaataccttgtttcttatatcacgataataaacctgttgattcaagaaatatattacgtaatgcagttaatacttttaaagaaactttatggaatatctttgatacaaatccagaaatattaagcaactataatataaaaaaagatgatataaaagaaataatcattacatcagctacagaattagagttttgggttaaaacaccaaatagtgatgctgaaatagaagaattatctacttcccaagttcttcatgaacaatattggacaagaactaaaggaaaagttcgtacagccctagaagaaacattactattaatggaggcctatggatttgaacctgaaatgggtcataaagaagttggtggagttaaagctaaattagatgcttctggtaactttaatcatgtaatggaacaaatagaagttgactggaaatattctgatgctattcaagctgctgataatgaactatttataaaaatattagttcaagaaacttatagaaggcacggtttagatgttacatttatggctaaaccacttgatggtgttgctggttctggtatgcacgttcatttaggaattagcttaaagcttaaaaacggtaaaagaataaacctcttccatacaaataaagaacatttcttaagtatcttaggatatggttctcttatgggattacttaaaaactatgaagttatgaatccatttatatcttcaactaataactcattaaaaagattaaagcctggatttgaagcacctgtttgtatagttacttctcttggattatcacctagtaatccatcaagaaatagatctatattagttggtttaattagagacttatcaaatccccttgctacaagatttgaacttcgttcaccaaatccacattcaaatgcatatataactattgcagtatgttatatggcaatgcttgatggtattctttatgcagttaataataaaaaaacagaagatgaacttttagcagaactatctaaagaatatggtgaagatgcagattatctagaaaagaatagaaaatatagagctgaagaagatgtatttgaagatttcactgaagaagaaagaaataaatattttagcaaggcacctgcaacaatatatgaaaatattactgctttagatagatatcctgaaaaggtagaagtcttaaaaagaaatggagtattgactgatcagcttattaatagttttagaatagcaactattactagatggaaaatggaaatttctcatagaatagttaataaattcacttctgaaataagatcttgtaaatgccttcatgatgcaaataaagcactagatttagatttaactaattggatgaaaattcatgaattaagattatatataatgaaggataccaattctacaaagtctcttttcacaagacttaaagatgcaattacagaaaacaacttagaattagcttcagatttatatttagaattagaatataaaatgagtttattaagaaatatgtattcttcttataaaaagaatcttttagacatataa

SEQ ID NO: 1447 - DNA, 2016 bp, Unknown
  Artificiall/Consensus sequence
atgtgggaggctcaggaaaggatggttttaatggataaaaaagctcgtgtagaggaattagttgaacttttaaataaatattcttatgaatattattctttagataatccatcagttacagataaggaatatgatgttaaatatgatgagctaaagttattagaagatgaaacaggttatgtgcttccatattctccaacacaaagagttggtgatgtggttttacaaggattttctaaatatactcataaggcaagactttggagtttggataaggcacaaagtattaaggaaatagaagattggcataatagaaatattaaatttgtaaatgaaatgaattctagggaagaaaatttacctccattaagatatgtaattacaaagaaatttgatggattgactattaacttaacatataatgaagatggaataatggaggttgcagctactagaggaaatggtgaaacaggggaagtagtaacagcacaagttaaaacaataaaatcaattcctttaaaaacttcaaaaggagatatatttgaagttcatggtgaagcaataatgactacagaagcatttgaaaagtacaatgaaacagcagaaacacctcttaaaaatttaagaaatggagcagctggtgcacttagaaacttaaatgttaaggaaactgctagaagagggttatcagcatttttctatgatgttggatataaagaaggtactggttttacaagctatgaggaaatgttaaactttataaaagaaaaaggtcttcctatagattcttatataaaatatgcaaataatttaaatgaagttgaaaagtatataaatgaaataaaggatatgagatttgatttaaattatgatattgatggagtagttattgcaattgatgatataagaactagagaattattaggatatacagttaaattccctaaatgggctattgcatttaaatttgaagctcaagaagcaacaactaagttattagatgttgaatggaatgttggaagaagcggaagagttggccctacagctatacttgaaccaattgaacttgcaggagtaactgtgaaaagagcaacattaaataatatggatgatattaaaagaaaaggtgtaatgattggagcagaggtatttgttagaagatcaaatgatgttataccagaaattatgggggttgtagaatcttcattagaaaatgctatagaaataaacccgcctaaggtttgtcctgcatgtggaagtcacttagttttagatggagctcattatttttgtgaaaatacattatcttgtaagccacaattagtaaagagtatagttcattttgcttgtagagatgccatgaatatagagggattttcagaaaaaacagcagagcaattatttgaaaaattagatattagatcaatagcagatttatataaacttaattatgaggagctattaacattagataaatttgggccaaagaaagctcaaaatcttcttggtgcaatagaaagaagtaaaacacctgaattatatagatttatatattcacttggaattccaaatgtaggagttaaaacggctaaagatttagtaaataagtttaaatcaattgagggattaaaaaatgcaacctttgaagaattaattttagttcaagatgttggagatatagttgctaaatgtgttttagaattctttaatgaagaaaaggtgttaaatacaatagaagaattatttaatttaggtgtaaatccatcatatgaagaagctgtgataatagaaagttcatttagtggaaagatagtagttgtaactggaagcttacaaaaatattctagaagtgaaataaaagcaaagcttgaaagtttaggagctaaggtttctggaagcgtaagtaaaaaaacagattatgttattgctggtgatgaagctggttctaaacttacgaaggctcaagatttaggaattacaattttaacagaagatgaatttgaaaagataatttaa

SEQ ID NO: 1448 - DNA, 1380 bp, Unknown
  Artificiall/Consensus sequence
atgttatctcgtgaagttgcacaaaaggtgcttggaagatgtttaataactggtggagattttgctgaaatatttgaagaagatagtttaaataattcaattagtatattaaatggaaaagttgaaaattctataggaggaagatcttatggaattggaattagaatatttaagggattaaagagtgtatatgcatatacaaataataatagtttaacatcgcttttaaatgttgctcaaaaagcagcactagctttaggggatttaaaagaagaaaaaatgatagttttaaatgaaagagaaaatattaatataaatccaataatacttacaccatcatctatagatcttaataaaaaaataggggtaatgaaggttgcatatgattcagctaaaaattatcatagtgaaattgctcaagttggagttggatatgcagataaagaacagcatattttaattgcaaatacagaagggttatatacagaagataagagaataagaacaagattaactataaatgctatagcatctattaatggtgaaaatcaaacaggttttgaggggccaggaagacatatgggatttgaaatgtttaatgaaattgacccagagtattatggaaaatcagctgcaagacaggcatatacaatgttacatgcaagaaattgtccagcaggaagaatgacagttgctattgataatggttttggtggagttatattccatgaagcttgtggacattcattagaagctacatccgttgctaaaggaaattcagtatttactggaatgcttggaaagcaaatagcatctacaaaggtaactgcaatagatgatggaactatacctaatgcatggggatctttaaatatagatgatgaaggcaataaaacgcaaaagaatattcttattgaagatggaatattaaaatcttatatgatagataagttaaatggaagaagaatgggaatgaatccaactggaagtggaagaagacaaagttataagtatgcgccaacatcaagaatgactaatacttatattgctaatggtgatgacaatccagaagatataattaaatctataagtgatgggttatatgctaaaaaaatgggaggtggatctgttaatcctgttactggtgaatttaattttgctgtttcagaaggatatattgttaaaaatggtgttatacaagaacctgttaggggagctagcttaattggtaaaggaagcgaaattttaatgaatatagatatggttggaaataacatgactcaaggtcagggaatgtgtggctcttcatctggaagtatagcaactaatgttggtcaaccaatgataagagtaaaagaaataactgttggtggaagatag

SEQ ID NO: 1449 - DNA, 2436 bp, Unknown
  Artificiall/Consensus sequence
atgctatcaatagataagaattcatttaaaagagattataacaataaattcgttcaattacatggtaaggaattaaaagaaggaagtaatcaacaaaaatatgaagcattaggcagtttggttagagattatgtaattagtacttggatggatactaataagcgatataatcaaactggacaaaagcaagtatactatttctcaatggaattcttattaggaaggttattaggtgattttcttttaaatttaggaataagagatatttgtagagaagcattaagtgaactaggaattgagcttgaagaaattgagagcttagaacatgatcaaggcttaggtaatggaggtcttggtagattagcagcatgttttttagattcaatggcatcattaaatattgcagggcatgggtgtggaataagatataaatatggattttttgaacaaaaaatagttgactgtcaacaagttgaggcatctgataattggctaagagaaggtaatgtgtgggagattaaaaagcaggacaaggccgaaatagtaaaattcgggggaagtataatttcagattatgttaatggaaaacttacatttacacatgtgaattatgagcctgtattagctgttccatatgacacccctatagttggatatgaaaatgaggcggtaaatacattaagattatggagtgcagaacctgtatcaaatgaatttgatttttcatcatttagtagaggagaatttttaaaggctatatcttataaaaattctgtagaagcaatttctttggttttatatccagaagattctttttatgagggaaaaatgttaaggttaaaacaacaatacttttttgtatcagcaggaatacaaagtattgtaaggcattataagaagcataatggagatataaatttattagatgaaaaaatagcaattcatattaatgatacacatccaacattggctatacctgagttaatgagaatattattagatgaagaagggttatcttgggaaactgcatggagaataactcaaaatacaatttcatatactaatcatacaattttggcagaagccttagagaaatggcccattgatatgtttaagggattgctaccaagaatttatatgattattgaagaaataaatagaagatattgtgaagaactttggaataaatatttaggacaatgggataagatatctaggatgtctattataggggatggatatgtaagaatggctaatttggctatagtaggaagccatagtgttaatggagttgctaaacttcatacagaaattttaaagaaaagagaaatgtctgatttttattatttatatccatctaagtttaacaataagactaatggaatcactcataggagatggttaattagatctaatcctaaattaacaaatcttctaatagatacaattggagatagctttataaaacatccaacagatttagaaaattttaaaaatcacttagatgattcaggggtattacaaaaacttgctcaaataaagaaagataataaagaaagattagcgaaagaaatatataaaactaatggaataattattgatactaattcaatttttgatgttcaaataaaaagaatacatgcttataagagacaaactttaaattgtttaagaataatggatctttataataaattaattgaaaatccaaatttagatatattacctagaacctttatatttgcaggaaaagcagctccaggatattatttagctaaaaatataattgaattaatatgtagggtagcagaaaccgtaaataatgatcctagagtaaatgataaaattaaggttgtaatgcttgaaaattatcaagtatctttagcagaaaagataattcctgcagctgatttaagtgaacaaatatcaactacaactaaagaagcatctggtacatctaatatgaagtttatgatgaatggtgcaattacaatagcaactttagatggtgctaatatagaaataaaagatgaggttggagaggataatattattatttttggattaaatgcagaagaagttcttagttatcataaacatggtgggtattctgcatgggaagtttgtaataatgatcctaagctaaaaagagtaactgatgacttgattaatggtaagtattgtagtgataaagatagatttagaagcatatatgaaaatttattaacttataatgatgaattttttgtactaaaggattttgaatcttatttaaaagctcaaaatagagttaatgaactttataagaaccaaaacaaatggcaaaaaatatgtggaattaatatagctcattcaggtatattttcatcagatagaactattaaggaatatgcaactggaatttggggatctacagtaatatataagaatttatag

SEQ ID NO: 1450 - DNA, 1209 bp, Unknown
  Artificiall/Consensus sequence
atggcgatattaaattgtattataggtataattttcgtatttttagtagcatttttaatttcgaataataagaaaaaaataaattggaaaacagtaattattggatttttaattcaatttatatttgcatttgctgcattaaagtggagtgttggaaaatatatattgagtagaatttcattaggtgtacaatctgtaattgattatgcaaaagaaggaatttcttttatatttggttcattatctaatgatggtagcatatttgcagttaatgttttaggagtaattatattcatttcagcattagtatcagtgttgtattacttaggagttatgcagtttgttataaagcttatagggggtggattatcaaagcttttaggcacttctaagcttgaaactatatcatcagctgcaaatatatttttagggcaaactgaagcaccattattaattaagccatatgttgaaaagttaacagaatcagaattatttacagttatggttgggggacttgcttcagtttcaggatcaatattagttgggtattcattattaggaattcctattgagtatttagtatcagctagttttatgtcagctccagcaggacttataatttctaaaataataattccagaaataagggaagcaaaagttaatgaagaaattgaaatggtaaaagatgattcatctaatattgttgatgcagcttccaaaggtgctattgatggtttaggattagttcttaatatagctgcaatattattagcatttgtagcattaattgcacttgtaaatggaattattggattaattggtggattatttggaatagataacttaagtttacaatcaattttaggatatatttttgcaccaattgcaactattataggagtgcctatgaaagaatctgtaattgcaggatcattaatagggcaaaaaataatattaaatgagtttgtagcatttacaagtctttctgaaataatatctacattatctccaaaaacaatagctatagttacattttctttatgtggatttgctaatatttcatctatagcaatattaataggtggcataggcggaatggcacctagtaggaaacatgatatagcacgtttaggttggaaggctgtattaggagggacattagctaatcttttaagtgccacaatagcaggatttttattaacaatttaa

SEQ ID NO: 1451 - DNA, 1128 bp, Unknown
  Artificiall/Consensus sequence
ttaatggaagataagaataaacttcaagaggaaataataaaggcggatttaagaaatgatgaaaaaatgtggaaaagtctagatgaagcttgcacattaaattcatttttagaaaaaatgactaaagatgaattagttaaaatagctaaaaaatattcagtaaaaggtattacaacattaaaaaaagcagcagctgttgaaaaaatcaaagatgttgttttaactaaggccaatattgcattagaatcaatggaagaaaatactttaaaatttgttgaagaattaattaaagtaaatggattaaagaagtataaatttgatgaagtaatttacataaattacttaagaaatagaggattagctttttctggtattaaggatgaggaagcttttgtagtaatgccagaagagttaaaagaagttatttctaagcaattaaataaagaagttagagataaagcaagattaaatggagaaataataaaagccatggcaggaatggtttattattatggtgtatgcaactttgatttagtaaaagctaatttagaaaatatatttggaaaaacatttgaagaatcatacttaaatggattaatagcaaatggtgaagaattaggttatgactatgtaattgaagaaaaattattatgtcatatagatgttgaagatgtagaaggtgtattacagcttcaagaaaaggctgaaaatgattattataagtttgataaaaaatcattaataaaagcaggaaaaattgattttgttgaagaaaataagcaaggagctaaaatagaaaaagttttaggtgaagtctttgttatagataaaaatatattaaaagatgaaatggttgggtttattgttgctattaaaaatgaaatggaaatgcaagaagcaatagataacttccttgaagcttatgaaattcaatcagatgaagaaagaaatatttttgtacatgaattagaattatttgcaaagagcattagaaaatggtctttaaaaggatatacacaagatgaagttgaaaaacttaaagcaagagttgttaacactgttaaaataggaagaaatgatccttgtatttgtggaagtggtaaaaaatacaaaaaatgttgtggataa

SEQ ID NO: 1452 - DNA, 1662 bp, Unknown
  Artificiall/Consensus sequence
gtgattattattaataaattaaaggttttaagtttattaatattatctgggatactaattactccaactcaacttacaagagcagaggagatttataatgtatctgaagcagatttaattaagcttttggaaaagtataaaaatgaagaagttgtaatggaaaatggattagtgttaacaattggtgaagctataaatttaccagttacagaaggctggacagtttataataaaaatgttgcagaaatagttgatggagaacttattgctaagtcgattggtagtacatttgtatctcagcaaactgatgatgttgtatatatattagaagtttgtataacagaagagggtatatcaactgctagttatgcgagaagtaatattaaagaggtaaacagagattattataaagtgtttattgatccaggacatggtggatatgataatggagcggttaaaaatggtgtttatgaagatgaaataaatcttcaaatatctaaaaaaatagaagctaagttaaaggctagaggtgtgcaagttaaaatgagtagatataatgatacatatttatcattaacagaaagaactagaatggctaataacgaaggttcagatgtttttgtttctattcatcaaaattcagctgaaagtcctagtgcaaatgggattgaaacattttattattctccaagaacagatagtaaagaattggcaaatgatatacaaaatgatataataaatgctacagatgcttataatagaggaattaaaactgcaaattttgcagtaataaaaacagcacaaatgtcttcaagtcttgtagaatgtggatttatttctaatccaacagaagctcaaaatttaagttcaagtagttaccaagataaggttgcagaaggtattgtaaatggaataatggattatttaagtcaaaatattatattaaataacaattcaggaaatcaaaatccagataattcgctaggtaaaactacagaaaaaggaacaataaaagtaagtgattcattaaatgtaagaagtggagcaggtacaagctattcagtagtaggttcactgaaaaatggaacaagtgttgaaatagtagaaacaagtggaaactggtataagataaagtatggtaatggctatggatatgtaagcaaggattatgttacattaaattcaagtagcaatagtaatactggaaatacaagtaatagtggaagtacaaataatacaccagcaacaagtacaacaaagggaactgtaaaggtaagtgattcattaaatgtaagaagtggagcaggtacaagctattcagtagtaggttcactgaaaaatggaacaagtgttgaaatagtagaaacaagtggaaattggtataagataaagtatggtaatggctatggatatgtaagcaaggattatataacattacaaaatagaagtatagcagaaaatacaattacaaaagaaggtactgtagttactgttgcattaaaagtaagggaaagtaataattttgattcaaatgtaattggaacaatagctatgggacaaaaggtatcagttatagaggatgataatgaatggggtaaaataagttataaaggaatagatggatatattttaaatgaatatatagattttaatatagcataa

SEQ ID NO: 1453 - DNA, 2361 bp, Unknown
  Artificiall/Consensus sequence
atgaataaaatagaaattttagcgccagctggaagtatggaaagcatgtatgcagctattaataaaggtgctgatgctgtttatttaggaggaaataaattttcagcaagagcatatgcatcaaattttgataatgaaaatatgcaaaaagcaatagattatgctcatagttatggtgtaaaagtttatgttacaataaatactatattaaaagaatctgaaattgaagaagctgtaaaatatgtaggctatctttatgaaataggtgctgatgcattgataatacaagatttaggattatttaaaagaataaaagaagaatatgaagattttgaaattcatgcatctactcaaatgacaatacataatggagaagctgctatatacttcaaagaaaagggatttcatagattagttttatcaagagaaatgtcatttgaagaaattaaacatatatctactgatttaatgattgaaactgaaatgtttgttcatggtgctatatgtgtaagttattctggtcaatgcttaatgagctctattattggcggaagaagtggcaatagaggaagatgtgctcaaccttgcagaatggaatacacattacaaggtgaaaaatctggtgagcaaaagggatatttattaagtccaaaagatatgtgtacaatagaagatgtaaaagatattattgatacaggcacatattcattaaaaattgaaggaagaatgaaaagaccagaatatgttgcaggtgttgttgacaattatagaaaagctgtagataaagttattctaaaaaagaaatataatgagcatgaagggaaagaacagttattacaattatttaatagaagcggatttactaatgcttacttaaaaagtaatccaggtaaagatatgatgagttttaattctccaaaaaactctggtgtaccattaggacaaattgaaaaaagtggtgaaattaagcttaaaacttctatagctttaggagatggcgttcgtaataacgataaagggttttcaattagcaaaattttattaaatggaaaagaagaagctaaagctaataaaggtgatatagttaagatattccctattaattataagccaggcgacttccttcataagagtttaaataaagaactttttgatgaattagaagattacataaagccatattcaaaaaaaataactttaaatgccacagtaaagtttgctgtaaattcaccagtagcattaaatataaattataaaggtaaagaatatacttatactggtgaaataattcaaaaagctgaaaagcgacctttagataaagaacgtataagagaagcattaatgaaatctggagatgtaccatttaaattaaatattgttgattttacagaatttgaagatggatttatgagaatttcagatttaaataacttaagaagagatgcaatagaaaaccttattaagaatatttgtaaggaatctagaagaagacgtcctgcaaaaaagaacatcgtagtagaaaagacaaaatcaacaaatgattgtccaactgaattatatagttgtgtaacaaaagaacaattaaaagcattattagaatgtaatgttaaaaatatagcttttgatatttttagtagagaagcaaatgcattaagattttctgatataattgatacttttgaaaaatataatggtaatattaacttatatataaaaacttcttctattataaagggggaatttgataaggtatgtactgttatagaaaaagtaaaatcatatattaaaggaattattacttctaatataggaataatccatttatacagaaattcacttcaaataataggtgattataaacttaatattatgaatacacaaagtttagaattttatcaatctgaaatatctattccaacactaagcatggagcttaatagaactgaaatcaaagatattttacgtaaaaataagggcaataatgcttatgttatttatggaaaaccagaacttatgataagtgaatattgcccaattggaagtacatttggaggaagaaaaactaatgttgattgtaatgctatatgtactagagacaaatttactttaatagatagagtaaatgaaagattaagagttatgaccgacttattctgtagaagttatattttaaatccagtaccattaaatctttttgatgaaagaacttaccttaaagaagctggaattaaaactttaagatttgattttagagatgaaagttatgaagaagttaaaaatgtttataatatgtatttaggtaaaatggaatatgataaatctaattatacaaaaggacaatttagaaggggtatagaataa

SEQ ID NO: 1454 - DNA, 1317 bp, Unknown
  Artificiall/Consensus sequence
acaaaatttacattatttcttactaaaaccattttaaaagggggtactactttccctggaagagttgcattaaaattagataaaaatattttatctactgtttctaagggatataaagtaatacttgtcacaggaactaatggtaagactactactacaagcatgatttataatatcattaaagaaaaaggctattcagtaataactaataatactggtgcaaatctttttccagggatagttactacctttgtagaaaactataagttttttaacaaagctgaagataaatatgctgttattgaagtagatgaagcaaatttaaaatttataacaaaataccttactcctgaaataattactgtaacaaacttatttagagatcaattagatagatatggtgaagtttatactacattatctaaaattttagaaggtataactcttgttccaacaagtaagttaattttaaatggtgatgaatcattacttggtaagcttgatgtaaaaaatccattagttttttatggttttaaaataccaataaatgaaaataaaactattgatgttaatgcagattcgaagttctgtaaattctgtaagacaccttacagctataactttgttacatataatcatttaggagattattactgtacaggctgtggatataaacgtcctactctaaaatatggtgtagatgaaatagtagaattaacagcagaaagctctactgttaaatttggagatactaaaatatttttaggtcaatctggtgtatataatatttataatgctctttgtgcttattcaataactaaagaacttaatattgatgactcttgtataaaaaaatctttagaaagtcaaagttctagttttggaagacaagaaataataaatattgatgataaagaagcaaaaataatattagttaaaaatccagcaggctataatcaagctttagatacactttgcttaaataaagaaccattttcttgtgcattcttattaaatgacaattatgcagatggaagagatgtttcttggatttgggatgttaattttgaaaatttaaataatgtaaaattagatgaagtatatgtatctggtcttagaacttttgatatggctgtaagattaaaaactgcaggtatttcaccttctaaatttgttattgaagaagaatatgaaaatttaactaatcaaattaaaaatggtaaaaacaaaaagatatatatccttgcaacttatacagcaatgataaattatagaaaatacttacattctaaaggatatattaaaaatctttggtag

SEQ ID NO: 1455 - DNA, 1167 bp, Unknown
  Artificiall/Consensus sequence
atggcaagatttacattaccaagagatatttatcatggaaagggaagtttagaagtattaaaaacattaaaagggaaaaaagctattgtagtagtcggtggcggttcaatgaagagatttggatttttagataaagtagaatcttatttaaaagaatctggattagaagtaaagttaatagaaggtgttgaaccagatccatcagtagaaactgttatgaagggtgcagctattatgagagattttgaacctgattggatagttgcaatgggtggaggatcaccaatagatgcagcaaaagcaatgtggattttttatgaatatccaaattttacttttgaacaagctgttataccatttggattaccagagcttagacaaaaggcaaaatttattgcaataccatctacatcaggaactgcgacagaagttacagcattttcagtaattacagattataaggcaaaaattaaatatcctttagctgattttaatttaactccagatatagcaatagtagatccagacttagcacaaacaatgccagctaagctagttgcacatacaggtatggatgccttaactcatgctattgaagcttatacagcatcattaagatcaaatttttcagatccattagcattaaaagctatagaaatggttaatgaaaatttagttaattcttttaatggtgatgaagaggcaagaagtttaatgcatgaagcacaatgtttagctggtatggcatttagtaatgctttattaggaatagtgcattcaatggctcataaagttggagccgtatttcatattccacatggatgtgcaaatgcaatattcttaccttatgttattcaatataacagaaaggaatgcgaaaatagatatgcagatatagctagagtattaaaattagaaggaaaaagtgatagtgaattaacaaattcattaattaataaaataagagagtttaatgttgcacttaatattccagcaactatgaaagaatatggtattactgaagtagatttcttagcaaatgttaaacatatagcacacaatgctgtattagatgcatgtacaggatctaatcctagaactatagacgatgaaacaatggaaaaacttctttcatgtacattctacggaagtgaagtgaaactttag

SEQ ID NO: 1456 - DNA, 1662 bp, Unknown
  Artificiall/Consensus sequence
atgtcaactgaaattaattcttctaattttataagaaatataatagtaaatgatttagaaagtggaaaacaccaagaaataataactcgttttccaccagaaccaaatggataccttcatataggtcatgcaaaatctattcttttaaattttggattagctgaagaattccatggtaaaacacatcttagattcgatgacactaaccctgtaaaagaagatacagaatatgttgaatcaataaaagaagatgtaaaatggcttggtggaaattgggatgaactttactttgcatctgattatttcgatgaaatgtataacagagctgttcttttaataaaaaaaggattagcttatgtttgtgacttaactccagaagaagctaaagaatatagaggtactttaactgaacctggtaaagaaagtccttatagaaacagaagtgttgaggaaaatttagatttatttgaaagaatgaaaaatggtgaattttcagatggagaaaaagttttaagagctaaaattgatatgtcttctcctaatatgaatatgagagatcctataatctatagaattgctcatgcaactcaccataacactggagataaatggtgcatctaccctatgtatgattttgctcatccattagaagatgccatagaaaaggtaactcactctatttgtactttagaatttgaggatcatagacctttatatgattgggttgttagagaatgtgaaatggaagctcagcctagacaaatagaatttgctagattaaacatgactaatactgttatgagtaaaagaaaacttaaacaattagttgatgaaggtgttgttgatggatgggatgatccaagaatgcctactatttgtggcttaagaagaagaggatgtacaccagaagcattaaagaatttctgttctgctattggtgttgctaaagcaaattctacagtagattctcaaatgcttgattattttgtaagagaagatttacaattaaaggctcctaatgcaatggctattttaaaacctttaaaattagttattactaattatccagaagggcaaactgaaatgttagaagttagcaacaatgctaaagatgaatcatttggaaagagacttgttccattttcaagagaattatatgttgaacaagaagactttatggaagttccaataaagaaatatttcagattattccctggtaatgaagttagattaatgggtgcttactttgttaaatgtaatgaagtaattaaagatgaaaatggcaatttaactgaaattcattgcacttatgatcctgaaactaaaagtggttctggatttacaggaagaaaggttaaaggaactattcactgggtagatgcaaataactgtgtacctgctgaatttagattgtatgaacctttaatattagatgatgctcctgaaaatgaaggtaagcatttcttagaacaaataaatcctaactctttagaaattttacaaggattcattgaaccaacagctgttgaaaatgctaaacctcaagataaattccaattagttagaaatggtttctttaatattgatactaaatatactactaatgaaaaattagtatttaatagaattgtacctttaaaatcttcatttaaattaaaataa

SEQ ID NO: 1457 - DNA, 1215 bp, Unknown
  Artificiall/Consensus sequence
atggatattataaaagaaactaaacttataggtaattatttaatttcactaagaaaggattttcacaaacatcctgagctaggaatggaagagtatagaacttcaaaaagaattaaagaagaattggataaaattggtgtaaagtatgaagatggaataaaaacagaagtagttgcaactataggaagtggtgaggaaaaagtaattgcattacgtgcagatatggatgcattaaggattcaagaaaatacaggggtaagatatgaatcacaaaataagggattaatgcatgcttgtggacatgatgcacatatggcagcattacttggtgcagcaatgattttaaaaaaatatgaagaaaaccttcaaggaaaggtagttttaatatttcaaccagcagaagaatgttcaagtggggcaaaattaatatcagagcatggatatatagatgatgttgatgaaatatttggattacatgtatttggtgatattgaatgtggtaagatatcaattgaagaagggccaagaatggcagcatcaaataaatttacaattaaaattataggaaaatcaggtcatgctggaaagccacatcaatgtatagatgcaacagttgcttgtgctgcaattgtaatgaatttacaatctattgtgagtagagaaattgatcccttaaattcagcagtagttacaattggacatattaaatcaggggaaacacataatataatttcaggggaagcaatgattcaaggaactattagaagttttaatgcaactacaacaaagcatatacaaaattcaataaaaagaattgcatatggcactgctgtagcatatggagcaactgcaactgtagaatatgacatttctcatcatccagctgtaattaatgatccagaagtaactaaaatagcattagatgcagctaaaaaaatatttaatcctaatgatttgattagtgttcccagaatgatgttaggagaagatttttctatatatcaaaaaagaattccaggggtatttgcatttgtaggtgctggaaatgaagaaataggaagggattatccaaatcataatgataaatttaatatagatgaaaaggcaatattaataagtactcaattatatgttgcttttgcattagaagcattaaagaaggaaaataagaaacatattttgataagtaaaattaaggaggaaaaatggaattag

SEQ ID NO: 1458 - DNA, 1953 bp, Unknown
  Artificiall/Consensus sequence
atgaaacaaaagctcaaaatttacaggtctttattaatattaattgtagtaattatttttacaataatactgtattattttcgatacttttatttagcaagcacaatattaattgtatatctagcttttaaggaatatttgaatattgagaatgaaatacaaaatgaaaagatgaatactttaactgatgaaattaaggcaaatataaatgataatatttcaaatatgtcatatccaatagctttaattgataatgaaggaaatatattgtgggctaataagagattaaaggaagagctaaatttattagatttacaggagcaaaatatacttagtataggaagaaatcttgatttgcataaattattaaaatgtgataaagatttaggtcaaagagtaaagataaaagatacattttacagtatatatgctaataatataagtggtgaaaatattaaatataatgaagcaaagtatttagtatattttaatgaagtaagcaatttaagagatttatattcaacaagagagagcataatgttaatagaggtagataatttatcagaggcattagaaagaactgatgaagcaaatagacctatgcttgcagctgaagtagaaaaagcaattaattcttatagtaagaaattaaaagctatgattattaaatatgaatataataaatattgtttatcagtacaagataaatatataaatgatgaaattaattgtaagtttaatattttagatgaaatttctaatatagataggggaaataagttagaagttactttaagtattggaattggtaggggtggagataatccacaagaaaactacaataatgctatgactgcaagagaattagcattaggtaggggtggagatcaggcagttattaaaaataatgaaaaaataactttctttggtggaaatactcgtgaattagaaaaaagaactagagtaagagcaagagtaattgcacaagctttaagagaattgatatttgaaagcagcaatatatttattatgggacataaaaatcctgatatggattcattgggagcatctatagggctatggtcatctataaggcagttggggaaaaattgtaacataataatagataatgatataactgcaattgattattatatgacaaaattaaaaaaagatgataaatatgataatttatttatatctagtgaggaagctgaaaaaaatattaattataaaactttattaattatagtagatgtgcataataaagggtatgtaaataatttagatattgtggaaagaattaatagaaagataataatagatcatcatagaagaagtccagatataatagagggagcattattaaattatattgaagtatatgcatcatcaacttcagaaatggtaacagaattaattcaatatatgctacaaaaaccaagaatacctaaaataatagcagaaggacttttaggtggaatttttatggacacaaagggatttcaatttaagtctggtgttagaacctttgatgcagcagcattcttaagatcattaggtgcagacacaatagaagtaaaaaaaatgtttactgatagtttagatgattatttatttatatcagatactataagaaatgcagaagttcatgaaaatttagcaattgcagtttgtccaagtggtgttaacaatactgtaatagtagcaagagctgcagatgagttgttaggtatatcaggaatagatgtatgttttgttttatgcaatataaatgattctattattattagtggaagatctactggggaagttaatgttcaagttatattagaagaacttggtggaggcggccatatgaatatggctggagctaagttagaatgtacaatagatgaggctgttaacttattaaaggaagcaattaataagcatttagaaattaaagaataa

SEQ ID NO: 1459 - DNA, 1515 bp, Unknown
  Artificiall/Consensus sequence
atgaatataaaaccagaagaaataacatctatcataaaaaaagaaatacaaagatatgaaaatcaaataaaaacttctgattcaggtacgataatccaaattggtgatggaattgccagagtttatggattagatgattgcatgcaaggtgaacttttagagtttccaaacaatgtatatggaatggctttaaatctagagcaagataacgttggatgcgttttattaggatctgaagaaggaattaaagaaggcgacatagttaaaagaacaaataaaatagttgaagtacctgtgggggaagggattttaggaagagtcgtaaatccacttggtgaagaaatagatggtaaaggacctattaattattcaggaactagaccaatagaagttccagcaccaagcattattgatagatcttcagtaaatgagccattacaaacaggtattaaggcaattgattctatggttccaattggaaagggacaaagagaacttataattggtgatagacaaacaggtaaaactgcaattgcagtagatactattttaaatcaaaagggtaaagatgtaatatgtatatatgtagctattggacaaaaacaatcaacagttgcacatatagttaatacattagaggaaatgggagcacttgattattcaataattgttgcaggaactgcatcagaaagtgcaccacttcaatacttagctccatatgcaggatgtagtatgggtgaatatttcatgcataaggggaaagatgttcttataatatatgatgatttatctaagcatgcagtagcttatagaacaatgtcattattacttagaagaccaccaggaagggaagcttacccaggagatgtattctatatccattcaagacttttagaaagagctgcaaagttatctaaagagcatggtggaggatcattaactgcacttccaataatagaaacattagcaggagatgtaacagcatatattccaactaatgtaatatcaataactgatggtcaaatattcttagaaagtgagttatttaatactggacaaagaccagcagtaaatgcaggtatttcagtatcaagagttggtggtaatgctcaaattaaagcaatgaaacaagtttcagggactttaagattagagcttgcacaatatacagaacttgcagcctttgctcaatttggatctgacttagattctgattctaagagaagattagaaaagggtaaaagaatattagaagtattaaaacaagagcaatataagcctatggatgttgaaaagcaaatagttatattatatgcaactttaaatgatttcttatctgatataagagtaaaagatataagaagatttgaagatgaattcttagaatttatggatacacatcatagagatgtattaaagcaaataatagatgaaaaacaattaagtgataacttaaaagaaaacattgaaaaatgtataattgaatttaaaaaagaatttttaaaagatgcatag

SEQ ID NO: 1460 - DNA, 3498 bp, Unknown
  Artificiall/Consensus sequence
atgaagatgaggccaattaaacttacagtaaagggattaaatagttttattgaagagcaaagtgttgattttgaaaaattaactgacagaggattatttggtatatttgggccaactggaagtgggaagtcaacaattttagatggtataacattagctttgtatggtgatgtttcaagaaaaagttctaattatattaatacaaattgtgaaaaggcaaatgttagttttgaatttcaaatatccggtgcagaaataaaaaggtatattgtaacaagggaatttaaaagagataaaaagtcaggaaatcctgtttcaggcaagtgtaaaatggttgatataacaaatggagaagatgttttagctgataaggttaaaagtgtaactgataaatgcaaggaagtaatagggttaagcttagaggattttacaaggacagttgttttgcctcaagggaagttttcagagttcttaaaattagaaggaaagccaagaagggaaatgcttgagagactttttaatttaggacaatatggtgatgagttatcaggaaagttattaagggaaattagtaaggaaaagaatgcaggaaatattttagctggacagcttaagggatatgaagatataagtgaagctaagaaaattgaaaaggaagaaagtttaaaaataagtattgaaaatttaaaaaatattaatgatgagcttaaggaaatagaaaaggattttaaggaaaaatcagaactttggaatttgcagcttgaaataagtgattataaggaaaaggaaagtatacttgttgaaagaggaaatgaaataaatttaattagggaaaaaattaaatttgctgaatcagcaaataaggttaatccttatgttattgcttatgaagatactttaaaaaatattgatttaacagaaaaagaattaagtcaattaaaagataaatgtgaagagttaaaagagaaaaagttaagtattgaattaaaatggaataatattaagaaaattaaggatgagaagcttcctcaatataaaattcaagaagaaaaaataaaggatgcaatagaagataaaaaagcattaaatattttagaagaagaaattaaaaaaattaataataatataagcttattaaataagaagaaaaaggaaaatgaagataagttattagattctgaagagagattaaagaagggtaatgctttattaaaagaaaaagaagaatatagagacacattaaatataaatagtgaattaaagcaggatgttttgcaaggtgtagtaattacaaatgattataatagtttattaaaagttgtaagtgattataatataaaaataaagagattgaaggatgtagtagatagttcattaaaggaaaagaaagtattagatattgaacttaatgataaggaaaatttattgaaaagtaatgaaaaagccttagaagaattgaataaaaattgtcctggaagtcaagaagaattatttaatttgcaacaaaagcatttagagttaacaaggaaactggatatatttaataaatctaaggaagatataaataaaaataaaaacttaataaatgagctggaaagggaagttgaagttaaaaagaaagaatttgagcttttagaaaatgaaataaagaaaataagcagttatatacttgaaatagaaagagaaaatttagcttataagctaagaagtgagttaaaggatggagatatttgtccagtttgtggttctgctcatcatcataaggagaatattaagcatatagaatttaaggaaagtatcaagtttgaagaagaaaaatcattaaaggaaaaatgtgcaagtgatttagatagtattataaaatctatggaagctaaaattaaggtagcaaaagaaaaaatagaagaagaaaaagttgtaataaaacatttgggagaggattttaatgaagatttggtaaggacttcgcaagttaaaattagtgaattaaaagcaagccttgatgattataatgttaaaaaagaagaattagaaaaaataataaaattattaagtgatgaatttaatatattaaagcttaagtttaccaaattagaagctaaaataagcagtgatgaaaaaacattaatgcaattaaaagaagaatttaatgataatgaagctaaatttaaggaaattgaaaatgaattgaatttacttaaagaaaaaactaaagttaaggattttataactaaaaatgaagaaataaataaaattgaaaaagaaaaagaagatatagaaaaagttattaaaagttatagaaatagattagaagaattaaataataatagagatgaagcaataaaaattttaaatgaaacttcaaatgaattaggtaaatttaatactgctttagaggaaaaagctaaagttagagaagaaagcttagttaagataagaagtaaagttgaagatgtaaataatattgaagagatattaaaaaatattcaaaatgaaataaaatcaattgaagaaaattatattttaatagaaaagcaaaaggaaaaagctgataaggattatgaagaatgtaatttaaaagtaaatggtataacaggaaaatgtacagagctttataagcgaaaagttaatgaaaaagaaaagttatatgaggtattacaagaagaaaactttttaaatataaatgaagttaaagaaaatgtcttaaataaaaataaaatagaagaattaaaattagaagttgataattataataatgatttggctaaaattaaaggtgcaatagaaagtgtttctcaaaaaattaataatagaaaattagctaaagaagaatggactgaaatacaaaataagaaagaagaaaaggaaagccaagttaaggaattagaagaagtaaaaattaagcttcaagaagaggttaagttaataaaagaaaaattattagaacaaatggatttactaaaggaaaaggaaaagttagatcataagttagcattgttaaatgatttggataaattgtttaagggtaaaaagtttgttgaatttgttgctgctacaagattgaaatatgtttctttagaagcaagcagaaaattaaaggaagtaactaatggaaattatggattagaagttgatgaagatggaaaattcattattagggattataaaaatggtggagcaggaagggatgcatctactttatctggaggagaaactttcttagcatcacttgcattatcacttgctttatcagcagaaattcagcttaaggggacagcaccacttgaattatttttcttagatgaaggatttggaactttagatgacaatcttttagaagttgttatgagctctcttgaaagaattcataatgataaattaaaagttggtattataagtcatgttgaaagtattaaaaatagggtgcccgttaaattattggtaactcctgctcaagctggaatgggtggaagtaaggttaagatagaaagaagttaa

SEQ ID NO: 1461 - DNA, 1728 bp, Unknown
  Artificiall/Consensus sequence
atgaattataaagagaagtataatgagtggttaaactcaaaagtaatatcagaaagcgtaaaagaagaactaagaggaattacagacgaaaaagaattggaagatagattttataaagaattagattttggtacaggtggactaagaggggttataggatatggttctaacagaatgaacgtttacactgtatcaaaggcaacacaaggctttgctaattatttaaataaaaactttgaatcaccaaaggttgcaattgcatatgattcaagaaatatgtcaaaggaatttgctgaagcagcagctttaactctttgtgcaaataatgtaaaagtatatttatatgaaagcttaagaccaacaccaatgctttcttttgcaacgagacatttaagttgtcaaggtggaatagtaattacagcttcacataatccaaaaatatacaatggatataaagtatatgatgaattcggtggacaagttacagacgaaaaggctggactaattattaatgaagtaaatagcatagaaaattatgaagatataaagactatttctttagaagaagcaataaaagacaatcttttagaatatataggtgaagatgtagataaagcttatcttgaagaagtaaaaggtcttactataagaacagaattagttaaagagcatgctaaagacttaaaggttatatatactccaattcatggtagtggaaatatgccagttagaagagttcttaaagaattaggatatgaaaatgttgaagttgtaaaagaacaagaaaaaccagatggtaatttcccaacagcttcttatccaaatccagaaaatccacaagtatttgaattagctttagaaatggctaaaacaaatactcctgatatcatatttggtacagacccagattgtgatagaataggtgttgttgttaaagaaaatagtggggaatataaagttttaacaggaaatcaaacaggtcttttattaacagattatatattatcatcacttaaagaagaaggaaaattaccttcaaatggagttgttattaaaactatcgtaacaagtgaaggtgcaagagctatagctaattactatggtgttgaaataatggatgttttaactggattcaaatatattggagaaaaaataagacaattccaagaaaagggagataagaagtatttatttggatttgaagaaagttatggatatttagctggagaatttgttagagataaagatgctgttatagcttctatgttaatagcagaaatgacactttattataaagaacaaggaaaatctttatatgaagctttaattgaactttataatagaattggattctttaaagaagacttaatttcaattgagttaaaaggtaaagaagggcaagaaaaaattagtaagtgcttagatttattaagagaaacagctttaacagaagttgatggagttaaagttgcaactagacttgactataagttaagtaaagaagaaaatttagaaagcaatacagaatttgttattaacttaccaaaatcaaatgtattaaaatacattttagctgatggttcatcatttgttgttagaccttcaggtacagaaccaaaaatgaaagtttattcagcagttaagggagaaagtttaacaaatgctgaagaaaagttaaagagatttaacgaaaaggttatggaaattataaatgaaaaattagcataa

SEQ ID NO: 1462 - DNA, 1785 bp, Unknown
  Artificiall/Consensus sequence
atgtttaaaataagaggaggtaaagttatgaaaatatttattgaaaaaataaatgatgtagtaaaaagtgcttttgaagaacttggatatgataaagaaacaggaaaggtaaatgtatctaatagacctgatttatgtcaatatcaatgtaatggagctttagcaaatgctaaaaagcataaaaaagcaccaatggtaatagcacaagaggttgttgaaaaattaaaggataatggaatgtttgcaaagctagaagctgttgctcctgggtttattaacatgaatattaatgatgaatttttagtaaattacgttaatgaaatgaataaagatgaacagtttggtgtctcaaaaacaacagaaattaaaaaaatagttgttgattatggtggagctaatgttgctaagcctttacatatagggcatttaagatctgcaataataggagaaagtataaagagaattgcaaaattcttaggtcatgatgttattggagatgttcatttaggagattggggtcttcaaatgggaatggtaatatcagaagttgagagaagaaatccttctttaccatactttgatgaaaactttactggagaatatccagaagaagcaccatttacaatagatgaacttgaagaaatatatccatatgcaagtaaattagctaaaagtgatgaaaaggtaatggaatctgcaaagcaagctacagttgaacttcaacaaggaagaagaggctattttgctttgtggaaacatatattaaatgtttctgttgctgacttaaagaaaaattatggagcattagatgttaattttgaattatggaatggcgaaagtgatgcacaaaaattaattccatcaatgatagaagagttaaaagaaaaaggatttgcaaaagaaagtgaaggagctttagtatttgatgtaagtgaagaaactgacaagagtccagttccaccactattattattaaaatctgatggagcagctttatatggaactactgatttagctacagttgtagaaagagttagagatatgaaagctgatgaaataatatatcttgcagataagagacaaggacttcattatgagcaattctttagagctgctaaaaaatcaggaatagcacatgaagatactattttagatttcattggttttggtacaatgaatggaaaagatggtaagccatttaagactcgtgaaggtggggtaatgagacttgcagacttaataagtatgattaaggaagctggtaaagaaaagcttaaagataataagaatatagcagaagaagatgttgaagaaatatcttcaaaagttggattagcggcattaaaatatggtgatttatcaaatcaagcagctaaggattatgtgtttgatatagatagatttgcttcatttgaaggaaatactggtccatatatcttatatacaattgtaagaattaaatctatattaaataaggcagaggaatttaaagctcaaaatattatatcagtgcctcaaagtgaatctgaaagagggttaatgcttcaattagctaaatttaatgaagttatagaattaagctttagagatagagctccacataaaatatgtgaattcctttatgagttatctaataactttaataagttctataatgatacaagaatattatcagaagaagatgaggctaaaaaatcatcttggttaagcttaataaatcttgttaaaaatgttttagaacaaggtttagatttattaggtatggaaagtgtagaaagaatgtaa

SEQ ID NO: 1463 - DNA, 1446 bp, Unknown
  Artificiall/Consensus sequence
atgatgaagtatttacaaaagttgggtaaatcattaatgcttcctgttgcatgtttaccagtagctgcaattcttatggggattggatactggatagatcctacaggatggggagcaaataatattgcagcagcatttttaattaaagcagggagcgcattagtagataatatggcaatattatttgctattggtgttggtgttggtatgtcagatgataatgatggtacagcaggattagctgggcttgtttcatggttaatgattacaacattattatcaacagatgcagttgcaatgtttaaaggaatagatgtagagttagtaccagctgcattttcgaagattcaaactcaatttattggtataatagcagggttaataggtgcaggatgttacaataagtttaaaaacactaagttgccaccagctttaggattttttagtggtaagagatgtgttgccatagtaactgctgcaatgtcattagttgcaacaataatattattatttgtatggccagttgtatatggaggattagtttcatttggtgaacttatagtttctactggagcagtaggagctggtatatacggtttttcaaatagaatattaattccatttggtcttcaccatgcattaaattcagtattttggtttgatgttgctggtataaatgatattgctaagttctggggaactgcagaaggtggaattttaggtcaaacaggtatgtatatggcaggatttttcccagttatgatgtttgggttaccagcagcagctttagctatgtatcatacagctaaagataataaaaagaaagctatagcaggtttattattagctgcaggattagcatcattctttacaggtgttacagaaccattagaatttgcatttatgttcttggcaccaggattatatgtagtacatgcagtattaactggtattacatttggtgttgttgctgcacttccagtaagagctggatttaactttagtgctggtttagtagactgggttttaagttttaaggctccatttgctgaaaatccactttggttaataggaattggattaattgttgcagttatatattatgtaatatttagatttgttataactaaatttaacttaaaaactccaggtagagaagatgatgaagaattaggaaatgaagaaacaaaaatttctaataatgattttactaaaagagcagaaattattttagaaggattaggtggaaaagataatttagttagtattgataactgtgtaacaagattacgtttagaggttaaagattatgaaaagataaatgaaaagactataaagtcatcaggtatttcaggaataattagacccggaaaaacaagtatacaaataatagtaggtacacaagttcaattcgtagcagatgaattaaagaaattatgtaaataa

SEQ ID NO: 1464 - DNA, 1719 bp, Unknown
  Artificiall/Consensus sequence
ttgcaaaggaataataaatataaggaagttgataaaacaatgaaaggaaatgttttaatgagtgaggaaaaagtaaaaataattccacttggtgggttaggtgaaatagggaaaaatattacagcttttgaatgtgatgatgaaattatagttatagattgcggaatttcatttccagatgaagaaatgtatggagtagatttaataatacctgatatatggtatttaaaaaataatataaaaaaagtaaaaggaatatttttaacgcatgggcatgaagatcatataggggcattaccttatgtgttaaaagaaataaatgtacctgtttatgggacaaaattgacaataggtattgtaaaaacaaaattaaaagagcataaattattaaatagtgtaaagttaaataatgttgaagtaggggatattattaagtttaataagtttaaggttgaatttattagaaatactcatagtatagctgattcttgtagtttagctttatttactccagttggaataatacttcatactggtgattttaagatagattatactccaattgatggagaaacaatggacttgcaaagaatatctaacttaggtaaagaaggtgttactttgcttatggctgatagtaccaatgtggaaagaaaggggcattcattatcagaaaggagtataggatatacattagaaaaaataattagtaaagctaagggaagagttattgttgctacttttgcgtctaatatacatagaatgcagcaaatagttgatgcatcaataaaaaataatagaaaaattgtttttaatggaagaagtatggaaaatatatcaaaagttgctattgagttggggtatcttcatataccagattctgaaattttaattattgatgatttaaaaaattacgaaaataatcaaataacattaattacaactggtagtcaaggagaacctatggcttcattggcaagaatagcattttctaatcatagaaaaatacttatagaaccaaatgatacttttattatttctgcatcgccaattccaggaaatgatagattaatttctagagttataaatgaattatttagaaagggggcagatgtagtatatgaggatttagaagctgttcacgtttctggtcatgcatatcaagaggaattaaagttaatacatactttagttcatcctaaatattttatgcctatacatggggaatataggcatttaaaacatcatggtgatttagctgaaaagttaggaatggataaaaataatatatttattttagaaactggaaatatattagaacttacaaatgaggggtgtaaaaagggaggaaaggttaaaacaggagctgtatttgttgatggtttaggtgttggagatgttggtaatattgttttaagggatagaaggcatttagctcaagatggaatgttgactatagttgtagcaattgatagggaagctttaattattgtatcaggacctgatgttattacaaggggatttgtatatgttaaagaatcagaagaattaattaataaagttaaagaaatatcaattatagaagttgaaaggtgtttagagttaggggttattgaatggtatgtattaaaaagcaatatgaaaaaagctacagaaaattatatttatgaaaaaactaaaagaaggccaactataattccaataataatggaaacataa

SEQ ID NO: 1465 - DNA, 1347 bp, Unknown
  Artificiall/Consensus sequence
atgaactggaatcttaaaaagaatataaagttaagtggagttcaaatattagctttaggatttgttgtgataattttagtaggaacaatattattgactttaccaatatctacagcaagtggggaaagtactagttttttagatgcactttttacagcaacttctgcagtatgtgtaacaggattaatagtagttgatactgggagttattggaatatgtttgggcaaacaattataatgatattaatagaaattggtggtttaggatttatgtcttttactacattaatagcaattattttagggaaaaagattacattaagagaaagattaattttacaagatgcaatgaatacttttaacattcaaggattagtaaaaatggttaagtatgttttggtatttacggtatcagttcaattttttggggcattattattatcaactcaatttattccagagtttggttttgggaaaggggctttttatagcttgtttcattctatttcagctttttgtaatgctggatttgatgtattaggaaaaggaaatagtttaatatcttttaatacaaatgtagtagttattatggtactttctattttaataataattggaggattaggatttactgtttggagtgaactatacacatgtaaaagcataagaagagtttctattcattccaaaatggttttattaataacaaccggattggtagttggtggaacacttttaatgtttttatttgaacataataatccacaaactatatcaaaaatgtcatttataaataaactgacaaattcattttttgcatctgtaacaccacgtacagcaggatttaatagtatttcaacaagtggtatgactacagcaggtcagtttctaactattattttaatgtttataggaggttctccaggctctacagctggaggaattaaaacaactacaataggagttttaattgtaactgtagtttctgttataagaggtagagaagattctgaagtatttaaaagaagatttagtaaagatttagtatataaagcatttacattattatttataggatttacattagtagtcatagtaacaatgttattatcttatacagaaaagggtgcaacatttatgtctatattttatgaaacaatttcagcttttggaactgcaggattaacattaggattaacacctgatttaagtaatataggacgaattttaattataattatgatgtatttaggaagagttggccctttaacagttgtattatcactcacaagaaaaaaggaaaaatctggtgtgaaatatccagaaggaaaaattttaataggttag

SEQ ID NO: 1466 - DNA, 1356 bp, Unknown
  Artificiall/Consensus sequence
acagtccagagaggctgcaagggggaatttttattctccttaaaaagaaatagggagggtgttataatggcacaatatacaggtgaattattacaggaaaagaaaagtattaaggatggagtaatgaaaattattcttgcaatgcaacatttaattgcaatgtttggtgcaacggttttagtaccaattttaactggccttgatccatcagtagctttattttcagcaggtgtcggaacactaatgtttcatttatgtactaaggggaaagttccagtatttttaggatcatcatttgcatttataccagtaatagtagcagtttcggaaaaatataatggtgatttaagatatgcacaaggtggaattatagtagtaggattgatttacatagcaatatcttttttaataaaaaaatttggattagataaaattaaaaagatattaccagctcaagtagtaggacctatgataatagtaataggattaaacttaattccaacagcattagatatgacaggagtaacacaaattgcttctggtgataaaaatactatagtaagtgtaataatagcaactataacattaacaatagttttagcaataaaaaagtttaataaaggttttttatctcaagtagctattttaatagcagtagtaattggatatgtaattagtttggctttaggacaggtatctacaactgaaattcaaaatgcaagtttaatagctataccaagtttcacattacctaaatttgatatgggagcaattgctataatagcaccagtaattttagcagtttttatggaacatgtaggtgatataacaacaaatggagaagttgttggaaagaattttattgaagagccaggattaaatagaacattattaggtgatggagttgctacactagtggcaggattaataggtggtccagcaaatacaacatatggtgaaaatacaggagtattagctatgactaaaaattacaatcctgcaatattaagattaactgcagtatttgcaatattattaagttttatagctaagtttggagctgtaataagaacaattccacaatctgtaatgggaggaataagcttaatattattttctatgattgcaattgttggatttaaaacaataaaaagagaaaaagttgagtttaatatatttaatatcatagtaatggcatcaatattaatagtaggtttatcaagtaattttttacctaatgcaattagtattcaaattactgaaacagttagtatatctggattaagtcttgctgcaatagtaggtgtagttttaaatattatattaacgaaattaagtaaggttaaaaataaataa

SEQ ID NO: 1467 - DNA, 2031 bp, Unknown
  Artificiall/Consensus sequence
atggatatatcacaagatgtaaaatgcttaaagggagttggtcctaagcttttagaaaaattaaataaatgtggcatattttcaattttagatttacttttatattttccaagagattatgaatttttaagaagcaatattccatttaatgaaattgatgaagaagataaacaggttttatcttgtatttgtgttggaatagatagggatgtaagaactaaaacaggaaaagtattaactacaattaggcttaattatttaggaaatttggttttagcaaaatggtttaatcaaggatttatcaaaaatacatttaaaatagggcaaagctatgatttaatgggaaaatttaaaagggtagctaatagattagaagttattaatccaattataggagttaaacttgcaaaagaaaatgaaatagttcctaagtatagtttaaaaggtgagttaagcgataaaattttaataaagcttataggaaattgtttagaacaaattactattaatgataatttacctaaatatttattagaaaaatataaaatgactagcttagattttgcaattaaaaatatacattttcctagtgggaaaagggaacttgagcttgcaattaacagattaaaatttcaagagctttttacttattcaatgaagcttttaatgttaaaaaagaatttaagaactaaaaatggcattgaatttaaattagtagatgaattaagggatttaaagatggcacttccttatagcttaacagaggcacaaacaagggttgtaagagaaatattaagagatcaaaaaagtccttggccaatgaataggcttgtacaaggtgatgttggaagtggcaaaacagtagttgcattaattgcaatgtttaatgtagttaaaaataggtatcaagctacattaatggtaccaacagaaatattagctaatcagcattatttagaagcaaaaaaattattagagccttttaatatacatatagaattattgacaggaagtactccaatgaaggaaaaaagacgtattaaggagcttattagcactgatgaaccgcttattgttattggaactcatgctttaattcaagaagatgtagattttaaaaacttaggattagtaattactgatgagcagcatagatttggagttgaacaaagaagtaggcttattaataaaggaagaagaccagatgtaatggtaatgacagctacacctattccaagaacacttgccttatatgtttattcagatttagatatatcagcaatagatcagcttccaccaggaagaaaacctattgatacaagattttttaatgaaaatgaaagaaattctgcatatgatttagctttagatgaaatagataaaggaagacaggtttatatagtatgtcctttaattgaggaagatgaagataataagttaaattctgttgaaaaactttataatgaattaagtcatggaatgtttagaggaattccaattgaaattcttcatggtaagatgaagtcaaaggaaaaggatgaaataatagaaagatttaagaaaaatgaaactaaagcaataatttcaactacagttattgaagttggtgttaatgtgcctaatgcttcagttatgataattgaaaatgctgaaagatttggtcttgctcaattacatcagttaagaggaagagttggcagaggtagctatgaatcttattgtttcttaattgcaaaagcaaaaagtgaaaacactaaaaaaagaatggaaataatgatatcatctactgatggattttatatttcagaagaagatttgaaattaagaggctcaggagaaatgtttggaagaaggcaaagtggagatgaagagtttattttagctaacatatatgatgatatgaatatattaagatgtgctaaaagtgaagcaaagcttttgcttgattcaaatgagccagaaaaagttgagttctgcaaagaaattaaaaattctttagaaagatggagcaagtatatttgctttaattaa

SEQ ID NO: 1468 - DNA, 1128 bp, Unknown
  Artificiall/Consensus sequence
aagctgaatttacacattaacttgaaacttgaaactaaaaaacggggggttataaatatgaattataatatagcagttataccaggggatggaataggtccagaggttatagacgaatcaataaaggttttaaataagattggggaaaagtataatcatacatttgaatttgaatttttacaagctgggggttgtgcaatagattctatgggaacgccacttccagaaaaaactttagaaagatgtaaagaaagtgatgctgttcttttaggagcagttggaggtactaagtgggataatcctaatgcaaagataagaccagaacaagcattattaggattaagaggtggattaaatttatattgtaatttaagaccagctcttttatataaaccattaaaggaggcatctccattaaaagacagcataattggtgatggaatagatatttgtgttgtaagagaacttactggaggaatttactttggtgaaagaggtagggaagtagttgatagagttatttctgcttatgatacagaaagatataacataaatgaaattaaaagaatagttaaaattggttttgaaacagcaatgaagagaaataaaaaattaactagtgttgataaggctaatatattggaaagttcaagattatggagaagtgttgttgaggaaatgtctaaagaatatcctgaagttgaagtaaatcatttatatattgacaatgcatcaatgcaattagtaagagaccctaaacaatttgatgtaattgttacttcaaatatgtttggtgatattttatctgatgaagcttcaatgattactggttcaataggaatgcttccttcagcatcattaggagaaggtacattaggcatgtatgagccaattcatggttcagcgcctgatattgcaggaaaaggaatagccaatccattagcaacaattctttcaactgcaatgatgttaagatatagctttaatttagaacaagaagcaagggatattgaagatgcagtaattaaagtattagaagaagggtatagaactggagatataaaaagtaaaggaactacacttgttggaacaaaagaaatgggacaacttgttgtagaaaaaatttaa

SEQ ID NO: 1469 - DNA, 2322 bp, Unknown
  Artificiall/Consensus sequence
ttggatttaaaagctttattaaacaaagaacaatatgaaggcgcagtaactgtagaaggtcctgtacttattttagcaggagcgggttcaggaaaaactagagttttaacttatagaatggcacatatgatagaggagcttaatattttcccatataaaatattagctattacatttactaataaggctgctagggaaatgcaagagagggttgaaaaaattataggtgaaagagctaaagatatgtggatatctacatttcactctacttgtgtgagaatattaagaagagaaattgaaaagcttggatataaaaagaattttactatatatgattcaactgatcaaaaaactcttataaaggaatgtataaaacttcttcaaattaatgataaagaaattactgaacaagaaataatgggtaaaataagtagagcaaaagataatatgcaaagtgctgatgcttattatagacaacatgaatcaaactttagagaaaagaaaattgctgaagtttataaaatgtatcaaaaaagattaaaagaaaataatgcattagattttgatgatttaattttcaaaactgttgagttattcaaaaagaatcctgaaacattagaattttatcaaagaaagtttcaatacataatggtagatgagtatcaagatacaaatggagctcaatatgaattagtaacattacttgcagctaaatatagaaatatttgtgttgtaggggatgatgatcaatgcatttatcaatggcgtggtgcagatattaaaaacattcttggatttgaaaaagattatccagaagctaaagttataaagcttgagcaaaattatcgttcaaaagcaaatattttaaatgcggccaatgttgttatagtaaataattcaactagaaagagtaaggtattaagaactgaacaagaagctggaaataaaattaagatatatagagcattttcagatactgatgagggtacttttgtagctaatcaaatagaaaagattaaaaaagaacaaaatatgcaatataaagattttgctatactttatagaactaatgctcaatcgcgtatatttgaagaaagcttaagaaaagctgcaattgcgtataaaattgtaggtggaactaagttctacgatagaaaagaaattaaagatatgctaagttacttaaaagtacttgttaatccttcggatagtatagctttaagaagaattataaatgttcctaagaggggaattggtgatgcaacaatacaaaaagtattagattttgcagaaagttatgagttaaatttatgggatgcgttaacagaagttagaactattccaacattaacagcaagaaattgtgctggaattgaaaagttcatggaacttatggaaaatttaatgatgatagcagaaactactccaatatcacatttgatagaaacaatcttagaagatactggatatatgagagagcttgaagcttcaaagcaaattgaagataagagcagaatagaaaacttaaaagaattagtatcagatgcagttgattttgaaaaagcgtatgaaatagaaaagaaaaatggatcttcagattttgatataaacaaaactcaattagaagcatatttagaaaaagtatcattagtacaagatacagataagttagataatgaagaaaatgaaaatggaacagttgtattaatgactattcatagtgcaaagggattagaattcccagttgtatttatggttggaatggaaaatggaatattcccagggcaagcatcttttaatagtgatgctgaaatggaggaatcaagaagactttgctatgttggaataactagagcaaaagaaacattattcatgacatctgcagaagtaagaagagtatttggtagaactgtagcttatcctcaatcagatttcatttcagaaattaagccagaacttagagaatatgtatcaatgactggagacatgagggaagtaggtaaaaattcttttaataataaatataaaacaagttatagtaatccacatagtttaagaaatgattatggaacatttgaaaaaagaaactttggtggaactgtaacattaaagactggtttatcagaaaaatcaaataggtcatcttcaataattacagctgcagaagcaactattggaagaaaagttaagcatgataaatttggtgaaggtacaattgtatctgttgcaggtgttaatggggataaaaagttaactatagcatttgataaacaaggtataaaaatgctaatgttatcaatggcaaaacttaagcttttataa

SEQ ID NO: 1470 - DNA, 1353 bp, Unknown
  Artificiall/Consensus sequence
atgacttttgaagaaatgttaaaggcagtaaatggagaggttattgtacaagggacagaaaatacctttaataaattatgtattgatactagaaagatagctaaaaataacgtgtttttagctataaaaggagaaaattttaatggaaatgattttgtattaaaagcattagaattaggtgcaagcattattattgttgatgaagtaaaatttgatgcaaatgaagtaaaagaaagtggaactataattaaagttgaaaatacaagaaaagcattattagagttagctaaattttatagaaaaaaattaggacttaaagtagtaggagtaactggatctacaggaaaaacttcaactaaggatttaatagcggctgtattaagtaaaaaatataatgtatttaagactaaaggtaactttaataatgatataggtttaccattaatgatattagagctaacaagtgattatgatgtagcaatacttgaaatgggaatgagttcccttggagaaatagaacttcttgcagatgtagcaagacctgatattggtgtaataacaaatataggattatcacatatagaaaaccttaaaacacaagaaaatattttaaaagctaaaatggaaataattactttctttgatgaaaagaatgttttaatacttaatgcagaagatgaatatttaaagaatattaataaaaaaggatttaaagttaaaaaaattggttataatcatgaatatgatgtttacgcatctaatattatattaagagaagatgaaacaaaattttcagctcatgcctttggtgaagaagctgtatttactctaccaatggcaggtaagcataatgttttaaatgcaatgcttgcaattgaggttgcagaatgtcttggtgtatcttttaatgaaatgattttaggattggataatttagaagcaacatcaatgagattacaagtgataaaaaaacaagattttataataataaatgattgttataatgcaagtccagattctatgaaatcttctttagatgttctttctgcttataaaaatggaagaagagttgctgtattaggagatatgtatgagcttggagataaagctaaaaatgctcacttcaaaattggagaatatgcaagagataaggttgatttattaattgtaataggtgaacaaattaataactttaaagatggatttaaaaatgataatataatcatgtacaatacaaaagaggaatgcataaaagaattgaaaagtattgtaaaaaagaatgatgtaatattaattaaagcatcaagaggtatgaaactagaatatgttgttaaaagtctagaagaaatgtaa

SEQ ID NO: 1471 - DNA, 1659 bp, Unknown
  Artificiall/Consensus sequence
atgagaagtgatgtagttaagaagggagttgcaaaggctcctcatagatctttgtttaaggcatcagggttaactgatgaagaaataaataagcctttaataggaattgtaacatctcaaaatgatataattcctggacatattaacttagataagattgttgaagctgttaaaaagggagtattaatggcaggaggaactccattagtatttccaactataggtgtatgtgatggaattgcaatgggacatgaaggaatgaaatattcacttgtaacaagggaactaattgctgattctgttgaatgtatggcaaatgctcatgcttttgatgctttagtatttataccaaactgtgacaagatagttccaggtatggttatggcggcattaagagtaaatgttccatcagtaatggttagtggtggacctatgttagcagggaaatttaaatgtaaggaagtatctttatcaacaatgtttgaagcagttggatcagttgaaagtggcttaatgcttgaatctgatttagcagaattagaagaaaaggcatgtcctacatgtggttcatgttcagggatgtttacagcaaattctatgaattgcttatgtgaagttttaggtttagcattacctggtaatgggacaattcctgctgtttattctgaaagaataagacttgctaaatatgcaggtatggctgtaatgaatttattagaaaaagatattaagccaagagatatagtaacaaaggattctattaaaaatgcattaacagtagatatggcacttggatgttcaacaaatagtgttcttcatttaactgctattgcaaatgaggctaaaattccaatgaatcttgatattataaatgaaatgtcagctaaggtaccaaatctttgtaaattagcaccagcatctgatacacatattgaagatttatatgcagctggtggaattaaagctttaatgagtgaattaaataaaaagaatttattaaatttaaattgtattactgcaactggtaaaactgttgaggaaaatattaaagatgctaaggttttagattattcagtaataaaacatatagaagaaccatatagccaaactggtggtatagcaatattaaaaggaaatttagctccagatggcgcagttgttaaaagatcagcagttttaaaggaaatgcttacacataaaggaccagctaaggtttttgattctgaggaagaagctatagaagctattttaggaaagaaaattgtaaaaggtgatgttgtagttattagatatgagggtccaaagggtgggccaggaatgagagaaatgttatcaccaacttctgcaatttgtggaatgggacttgattcatgcgttgcacttattactgatggaagatttagtggggcaactaaaggagcagcaataggacatgtttctccagaagcagctgatggtggaaatattgctttagtacaagatggagatattatttctattgatatttcaaatggaaatttagatttacttgtaacagatgaggagttagctaagcgtaaagaaaatttaaagccatttgaaccaaaggttaaagaaggctatttatcaagatatgctaggttagtaagctctgcaagtagtggagcagtgtttagatag

SEQ ID NO: 1472 - DNA, 1245 bp, Unknown
  Artificiall/Consensus sequence
ttgcatcatgatttaataattgttggtggtggagcttctggcttagttgctgctattactgcaaaagactttggaatggatgttgctatagttgaaggaagtgatagaattggtaaaaagattttaactactggtaatggtagatgtaatatatctaataattgtattaaacctccatttattaattatcatagttctaattcagactttaaattttcagcattagaaaaattttctcttgaagatacaaaaaacttttttttatctttaggacttccaattgtatctcttccaaatggcaaactttatccacaatcattacaagcttcatcagttgttgatattttaaaaatggctttagaagatagaaatatatctttatacacaaactgcaaagtaaaagatatccacaggggtaaagaatttaaattatccacaactaatgaggagtttaatttattcacagctaataaaattattttagcttgtggaggaaaatctgccccaaagacaggttcagatggaagtggatataaattaacaaaatcgctgggtcattcaataactgatttgcttcctggaatagttcaattaaaattagattataatcatttaaaagcattatctgggataaagtttgatggatatgtcactcttttatgtgatgataaagccataaaaaaagaatttggagaaatattatttactgactatggaatatcaggccctcctatacttcaaatatcagccttagcttctgaaaatacctttaagaaaaataaaacagaaattattgttgatttaatgccaagttatactcttgaagaattagaggattttatagaatgtcactttgctttacttagtcatagaccaataataaatgcattaattggtgtagttaataaaaaactaatacctatacttcttaaggaatctggaattgataatcttcaaatgccttgttatgaactttcttggcatgaaaagaaaaaattaattagcaccttaaaatcttggaaatttacatgtacaggtactaatgactttaatcaagcacaagttactgttggtggcgtaaatacaaaagaaattaaccctactacattagaatctaatatagttcctaatttatatttttgtggagaaatattagatgtacatggtgattgtggaggatttaacttacaatgggcttggagttctggatatgctgttgcccaatcaattgcacaaaaaaaataa

SEQ ID NO: 1473 - DNA, 948 bp, Unknown
  Artificiall/Consensus sequence
atgagtaaaatatcaataattggtgcaggcgcaattggtgcaactacagcatttgctttattacaaagaggaattgcaagagaaatagtaataaatgatataaatcaagaaaaagcattaggcgaagttatggatttaatgcatggaagttcattatgctctccttgtaatgttactttaggaagtatagaagatactaaagattcagatatagtaattattactgctggttcaccacaaaagcctggtgaaactagattagatttagttgataaaaactatgaaatatttaaaagctttataccccaaattgcaaagttaagtcctaattcaattttattagtagtatctaaccctgttgatatattagcttatatgacgtataaactttcagggttcccaaaagaaagagttattggctctggaactgttttagatactgcaagacttagaagcttattaggtaaatatttgggtattgatggtagaaatgttcaaggttatgttcttggtgaacatggtgatagtgaatttgttacatggtcttctttaatgattggtaacattccagttaaaagcttttccgaacaaaatttaataacttgggatattggaacagaaaatgttattgctgaagatgttaaaaattgtgcttatgaagttataaaaagaaaaggtgcaacagctttttcagttgcaattgcattaacaagaattactgaagcaattataagagatgaaaaaagtattttaactgtttcaacacttttagataattattatggagttagtgatgcttatttaagtgtgcctacacttcttggtagaaatggtattgaaaaagtattaaatattcatttatctaaagttgaagaaagaaaatttattgaatctgctaatttaatgaaagaatatatagatagaattaatacaaaacaaaataattag

SEQ ID NO: 1474 - DNA, 1158 bp, Unknown
  Artificiall/Consensus sequence
atgaaagtttatttagacaatggaagcacatcttttcctaaacctaaagctgtagctgattcaatatataattatttaattaataatggaggcaatcctggaaggtctaaccatgaaaaatcattagaagctaatagaattttatatgatactagaaatgaaatttgtgacttttttaattttaaaaagacagaaaacgtaattttcactaataatattacatcatctttaaacattttaattaatggaattattaaagatggagatcatataataacttcatcaatggaacataatgcagtaattcgtccactatataatctttctcaaaatttaaatataaaattagatattgcacaagctaattctcaaggattagttgatataaattcaataaaatcccttattaaacctaataccaaactaataataatcacacatgcatcaaatgtaactggctctattcaaccaattaaagatataggtaaactatgtaaagaaaataacattttctttatattagatagtgcacaaagtgctggtgttcttgatatagattttcaggaatttttcttagatgcattagcctttactggccataaaagccttttaggtcctcaaggtattggaggttttataattaataataaattaaatgaaatttgtacacctacaattttaggtggtacagggagtttatctcattcattaactcaacctgattttttacctgataaatttgaatctggaacactaaatattcctggaattataggacttaatgaagcaattaaatttataaataatgaaggcttaaatacaatttatgaacataacagttatttaagatcatatttaatttctggattattaaatattccaaattataatattattggtactttagatagatcactttctacatcttgtgtttctataactcactcaaaacttgatgtaagtgaattatcttatattttagattctgaatttaatattagtaacaggagtggattacattgtgcaccacttgctcataaaacaataggaacttttccaaatggtactgttagattaagcgttggttattttaatacaactgaagaaattaaatataccttagattgtttaaataaaataaataatatttataaataa

SEQ ID NO: 1475 - DNA, 1797 bp, Unknown
  Artificiall/Consensus sequence
atgatatatggaaatatagatggtgttaaaaaatctgctatagaagaattagatagattatataaggtaaaatgtcctaaagatgaagtgtgctcaatagaaataatagaagttatttctagagtatcatcatttattgaaagagaagtaagtgttgcaattgacagaagaggaaatataaaatcaattgctattggtgattcaacatctgttgaaatagaaacattagatattcgtgaaaaaaaattagctggggtaaggattattcatactcatccaaatggaatgagcaacttatctgccttagatattagtgcattaataaagttaaagcttgatgctatagtagcaattggaatttatgaaggaaagatattagattgctctttaggaatgcttacagttaatgatgataaacttgattatgaggaaaaaggaaatattccacttaaagaaattaccaagattcatattttaaataaaataaattatattgattctttagtaaaggaaaaagatattattgaagatgatgaagaaaaggcaatattggttggttctgatacaagggaaagtttagaagaacttaaggaattaacaaaagcttgtgatattccagtgcttgaaagtgtttatcaaagtagaaataaaatagatgcagctttttatataggtagaggtaaagtattagaaattgctcaattaagacaaaagttaagagctaatgtagttatatttgatgatgaattgtcaggttcacaagttagaaatttagaagctgcaattggagcaaaagtaattgatagaacaacacttattcttgagatatttgcaagaagagctaaaagtagagaagctaaaatacaagttgaacttgctcaattaaaatatagaatgagcagacttcaaggtttaggtactataatgtcaagaactggtggaggtattggtactaaagggccaggggaaaagaagctagaaactgatagaagacatataaaagaacaaatttatgatttaaatgatgaattaaagaaaattaaaaagataagagaaactcaaagagaaaagagaaataaggaaagtattcctaaggtatcattagttgggtatactaatgcaggaaaatctactttaagaaatgctctttgtgatgtggcagctcaaaaagaagttgttggaaaagaaaaagtatttgaagcagatatgctatttgcaacattagatataacaacaagagcaatagttcttaaaaataaaggagtaataacattaacagatacagttggatttgttagaaaacttcctcatgatttagttgaagcatttaaatcaactttagaagaagttatttattctgatcttttatgtcatgttgttgatacatcaagtgatacagcaatagaacaaattaaagcagttgaagaagttttaagtgaattaggtgctagtgataaaaaaactattcttgttttaaataaaattgataaggcaactgaagaacaacttgaaaatgtaaagaaagcaacttctgaatatgaaactatagaaatttcagcaagagaaggtattaatttggaagagctattaggtcttatagaagaaaatcttccatataaaatgaaaaaatgtgaatatttaataccttatgatagaagtgatatgagttcattcctacatagaaatggaagagtattagaagaagattatagagaaaatggtacttttatgtttgttgaagttgatgaagaaagttataataaatcaaaagattatatcataaatataataatgtaa

SEQ ID NO: 1476 - DNA, 1431 bp, Unknown
  Artificiall/Consensus sequence
atgacaaacttatataactcaccgctaaactctagatatgcatcaaaagaaatgagctttatattttctgatgatatgaaattttcaacttggagaaaattatgggttgcattagcagaaggtgaaagatcattaggaattaatataacagaagaacaaattaatgaattaaaagctaatataaataatataaattatgatgaagcaagaaaaagagaaaaagaagtaagacatgatgttatgagtcatgtatatgcatatggattacaatgtcctaatgctaaaggaataatacatttaggggctactagttgttatgtaggagataatacagatataataataatgagagatgcattattattaataaagaaaaaacttataacagtattaaatcacttatcaaattttgcaatgaaatataaagatatgcctactttaggatttacacattttcaacctgctcaattaactactgttggaaaaagagcgactttatggatgcaagatttagtaatagatattgaaaatattgattttgtattagctaaattaaaactaaggggagttaaaggaacaactggaactcaagctagttttatgaatttatttgaaggtgatgaagaaaagattaaatctttagatacatatgtagctgaaaaaatgggctttgaaaaaagttatggagtgacaggtcaaacttatcctagaaaaattgattctataattttaaatactttatcagaagtagcacaaagtgcttataaattcagcaatgatttaagattattacaaagtattaaagaaattgaagaaccgtttgaaaaacatcaaataggatcttctgctatggcatacaagagaaatccaatgagaagtgaaagaatgagttctttatcaagaatagttatagttaatgcattaaatcctgctattacagcagctacacaatggtttgaaagaacattagatgattcagctaataaaaggatatctgttccagaagcttttttatctttagatggagttttaaatttatatattaatatagcagaaagtatggttgtttatgataaggtgattgcaaaacatgttaatgaggaacttccatttatggctactgaaaatataatgatggaatgcactaaaagaggatgcgatagacaagaattacatgaaagaattagggagcattcaatggctgcagcaaaaagagttaaaggtgaaggtttaagcaatgatttaattgagagaattatggctgatgattattttaaattaacaaaggaagaaattttagatataattgatccattaaaatttattggaagagctccaagtcaagttgtagaatttattgatgaatatgttacacctattataaatgaaaataaggatgcattagaaattaaaagtgaaataaatgtttag

SEQ ID NO: 1477 - DNA, 489 bp, Unknown
  Artificiall/Consensus sequence
atggattttttcaacaccgcagtcctgggcaatatgtccctgtacgatgcaatggcctactttttgctgtactcctttttgggctggtgcagcgaggtggtgtatgtggccgctgccagcggcaagcgggtgaaccgcggctttttgaacggccctgtctgccccatttacggctttggcgtagtggcggtgctgtggctgctgcacccgctggaggacaacctcctgctgctgtttttggctggcggcgctgtggccagcgccgtggagctggtgggcggctgggcactgttcaagctgtaccacacccgctggtgggactacacccagcgcccctttaacattgggggctatatctgcctgcaatactccctgatgtggggcgtgggggtgctggtggtggtcaaactgatccacccgcccattgcccatctgatcgccctgacccggcagccagccggcctggcggtgatggtgggatgctatctg

SEQ ID NO: 1478 - DNA, 714 bp, Unknown
  Artificiall/Consensus sequence
atgaagtacgattgtgagatcatccgggatctgctgcctttgtatgcagaggagatcgccagcccggccagcacggccatggtccgggcacacctggaagaatgtcccgactgtgcccggctgctggcacagatgcagcgccctgtgccggtgcgggcggagacggcggcaccgctgcaaaagctgaaaaagaccctttggaaaaagcgcctggtcaccgctctggcggtctgtgcggtcacggcggtctgcgtgggcggcgggtatgggctgtataaccacactacgccggtcacgctggaacaggcggcgctctggcctttcgtcacccagatggagggggaaaaggtgtatgtcgtagagacacagggccgcaatgtccggctggaggtctgcccggaggtgggcttcggcgggatgaacgctgtgcgggccgtagagatcaccgggttccgccgaggggtggaccggctgctgcatctggtgggggcggatactgccctggatacccaggccgtgctgcggcaggaccaggccattgagatccgctgtctggacggggtgacctactgcttccggggacagatgtacgactatcgggagatctggatgaacggcatcacccccaccggcggtacccgcagggtggttcaggacgaaaacggggattttgtggatgcggtgaccggcgagcggatcgaggacggcaggtga

SEQ ID NO: 1479 - DNA, 804 bp, Unknown
  Artificiall/Consensus sequence
gtgaaaattcgtctggaccaatacctggtgcagcatggcttgatccaaagccgggagcgcgccaaagcaatgatcatgtccggcgttgtgtttgtaaatgagcaaaaggtggacaaagccggtgagatgatccaggaggatgcaaaagtagaggtgagaggccatgatatcggctatgtcagccggggcggtctcaaactggaaaaagccatgcaggtatttcctatgagccccaacggtaaggtatgcatggatattggtgcctccacgggtggctttaccgactgcatgctgcaaaatggggcgtgcaaagtctatgcagtggatgtgggctatggtcagctggcatggaagctgcgcaccgatgagcgggtggtcaacatggagcggaccaatatccgccatgttacgccggagatgctggcagagcctatcgagtttttcagcgtggatgtgtcgtttatatcgctgcatcatattttcccggtcgcacaggctgtgaccacggcagatgctgtaggtgtctgtttggtcaagccgcaatttgaggctggacgggaaaaagtgggcaaaaacggtgttgtacgagaccccgcgacccatcaggaagtgctttgccgggcaatggagtatgccgttgcaaatggattttccgttcgtgggttggatttcagccccgtaaagggaccggagggcaatattgaatacctgatgtttgtgcagaaatgtgatcaaccggttctgttggaacagacggaagcacagcgagtggtgcaggccagccatacctcgctggaccgctga

SEQ ID NO: 1480 - DNA, 423 bp, Unknown
  Artificiall/Consensus sequence
atggacgccacccgttattttgaggagatgcaccgcgcaatggccgcgcaaaagaccgcttcccagctggtgctgacggcctgctaccaggataccgctggcagcgatgcctatctggagctgcgccgcagcccggcagacggcagtttccgcattttgtactctacgatgggacgcagcgatctgaattttcagctcttccgcaaagggtggcagctgtgccataacgccgccggagagctgaccggccgtttcccttccagtgccgagggattgatcgcacagaccgacttccgggccttttatcgggatgaatcctttgacccggacaaagctacccatatcctggacacgctccgccgctatgccgggcaggacatctctgcccctgcacaacaggggggctcccgtgtgactgtgaca

SEQ ID NO: 1481 - DNA, 834 bp, Unknown
  Artificiall/Consensus sequence
atgaatcgatccttagctgatacgctggtgctgtgcgatctggacagcctgctgctgggaccagatggaaacctgacgcaggtgctccgggatatcatccagctgtacggcagccggggcggccgtctgaccgtgttctctcaacgtacccccaaggcagtccgcaccttgctgggcggggtgcggctgggggcgccggcccttttgtgcggcggtacgctggcgtatagttttgcacagggccgcagccaggggctgtgcagctttgcagggtttgggccgtctctgctggagcggctgccctcggtgccggggctgggcatcgctgtgcagatggcagatggtgcgacccgtgtgctgcgtatgagtcagggcctggcacgccacctgcatcaagagtggactccctatctgctgggcagtgccggggatctgccgctggaccagtgcctccgggtgctgctttatcaggacgaaaagaatatgcccttggttccgctgctgaaaaaaacgctggcggaggacgcttcccgggtggagctggagcgcctggctccggatctgctggcactttctgcgcgtctgcccagcggtgagacgatgctgcaggctgtcagcggagaggtggggataccctctgcacaggtgcaggtagtggcgggcagcggggcgatgctgtccctggtgcaggctgccggatgcagcattgcttcggcagatgctccggcggaactgcggctggctgcaaagcacaccaccttgaccgatagccaggggggcgcggcggcagaggttctgtaccgtttggtgcagcaaagtgatgctgtccagtaa

SEQ ID NO: 1482 - DNA, 756 bp, Unknown
  Artificiall/Consensus sequence
atggtacattttgttggtgcaggaagcggcgcagtggatctgatcacggtgcggggcgccaggcttttgcagcaggcggatgtgatcatttatgcagggtcgctggtgaataaacagctgctggagatggcaaaggagggctgccagctctacgacagcgcacagatgaccctggaacaggtgatcgatgcgatcgctgcggcagaggctgcgggcaagacgacggtgcggctgcataccggagaccccagcatctacggcgcagtccgggagcaatttgaccagcttctgagccggggcattgcatacgatgtctgtccgggggtcagctccttctgcggggcggcggcagcgctcaaaacggaatatacgctgccggatgtcagtcagacggtgatcatcacccgggcggcaggccgtacaccggtgccggagcgggagtctatccgtgctttggcggcccatcaggctaccatggtcctgtttttaagcacctcgcttacaaagaccctgcagcaggagctgcaggcggggggataccctggcacgacccccgctgcggtggtgtataaagcgacctggccggaagagcggatctatcgctgcaccgtggaaacactgcataagatcgtgacggaaaacggcctgaccaagacggccctgatcgtggtgggagaatgtatgggagaacgctatcttcgctcgctgctgtaccatccaggcttcagcactggttttcgggaggcttcgcaatga

SEQ ID NO: 1483 - DNA, 675 bp, Unknown
  Artificiall/Consensus sequence
gcggcctgtgcccgtgccgggctggacaagccgcgcccgcaggtacaggtagaaaggctctggccggcagaatcgcctgccgtggcgcagccgcaaaagaccttgtatatgccggtgcctatgccgtggctgggcatcgggtttaaggagcagcccatcccggcggaggacctgcgcaccgaggcgctttatgacctgatctgcggctgcattctgggcggaatgtctccgctgtaccgccgtctgtacgatcaggggttggttgacccggactttggcggctcggtgctgcataccgaaggctgctgctgcttcttgtttgcaggggagagcagcagcccggagcttgtgcagcagatgctgctggaggagatcgcacgggtgcgcaaagagggcgtggaccgggaggtgttcacgctctgcaagcacgaacgctacggccagctgatcgagaacctggaaaatgtagaggactccgccagccagatggcggactttgcacttgcagggcagacagtagcgcagcagatcgagatgctggcaggcctgactgcagaggatgcagaccgggcgctgcagcagatcttcagcaccgaccgcatggcggtggtgcaaattttgccggatggcagcctgccttccgatgagaccgaaggggaggattttgaggaatga

SEQ ID NO: 1484 - DNA, 597 bp, Unknown
  Artificiall/Consensus sequence
gagcgtcagttccgtacgccgctgagctatggcgcggtgcgtacgcccacagcgcagtggaccgccacggcagcgggctgctgtttggtgcaggcggaggggcgaggcccccggatcacggccgctgcatttggccgggtgcaggactacgccatcaaggacatcaacaacatgggggcggctatggcgccagctgcggcggccactctgctgcgctattttgaggatacccataccgacccccaggactacgactgcatctataccggagacctgggacaggtgggcagcgggctgctgcatgaactgctggcagcagaggggctgttggtgaagaaccacctggactgcgggtgcctgctctacgatccggcccgtcagaaggtgaaaagcggcgcttccgggtcggggtgctgcgccgccgtgctttgcacccgcatcctgccgcggctggcccggggcgggcaggagcgggtactctttgtggcaaccggcgcattgatgagccagaccacgtttttgcagaaagagagcatcccggcggtagcccatctggtggagctgcggggggcagaaaatggggagggtgaagcatga

SEQ ID NO: 1485 - DNA, 303 bp, Unknown
  Artificiall/Consensus sequence
atgaaaggcaatgcgtcgtttgataggagaaagaaaatggatattattctggttatgctggcgggaatggtcgcaggccactttttcttcccaaaagccttaaaaaaggtcaacgaaaaaatacagcttctgtgcaccttatgcctgatcttctccatgggtgtcatgttgggccgcaaggaaaactttttgcaagagctcacctctatgggcattgtcagttttttgttttttctgatccccactgcgctctccatcctactggtctattatctgaccaagcgttttttgaagaaaaaataa

SEQ ID NO: 1486 - DNA, 957 bp, Unknown
  Artificiall/Consensus sequence
atgaaattcagcgagatgcattatacccgccccgatatcgacgctctgctggcccaatgcgcccagctggcccagaaggccgctgccgcttccagcggggaagagctggttgccctgtattatgagcagagcgccgcttttgcggattataccaccgccgccaacctggtgaacatccattatacctgcgacacccgggatgactactggcacgccgagcaggacttttttgatgccaacggccctgctgtggaaaatgcccataccgagatcagccgcgcctttttggccaacccccactgcgatgctttgacccaggcctttggctccacttgcgtggccggtatgcgcaatgccgtgctgagcatggacgaccgcaccctggagctgcagaagcagtacaacaccctggtcagcgaataccagcgcatctacggcggcgctatggtagagctggacggcaagcagctgaccatcccgcagctgggtccctataaggagagcctggatgccaaggtgcgccgcagcgcctacgaggccgaagctggctactttgacgcccaccggcaggagctggacgagctgtataccaagatcgtcaaaaacctgaacgcccaggcacaggtgctggggtacaaggattacagcgagctgtcctatgtgcggatgaaccgcatcggctacggcccggaggagatccgccgcttccgtgaccaggtggcacgggatgtggtgccggagctgcaaaaggtgatcgagctgaagagccgccgcaccggcatccagcaccccacctttgcagacctgcccatttattttaaggatggcaaccctaaccccatccccggctaccaggcccgcatggacgctgcccgtaaaatgtaccacgagctgagcagtgagacggcagagttcatcgactttatgcaggacaacgacctgtttgacgtcgagagc

SEQ ID NO: 1487 - DNA, 570 bp, Unknown
  Artificiall/Consensus sequence
atgagcatcgttatccgagggctggaaaagcgatttggggagaaggtcttgtttacagggctggatctgacggtggaagccccggcggtgctgtgggcccccagcggctggggaaagaccacccttttgcgcatcctgatggggctggagccgcctacggctggcacagtgcagggggtgggccgcgtgggggctgtatttcaggaagatcggctgtgcccccacctgacggctgtgcagaatgcagcgctggtgctgcctggcccgccgcagcagtaccatgcagcgctccgggcggactttgcagcactggggatggaggatgcggcactggcactgcctgcggtgcggctgtccggcgggcagaagcgccgcactgctctggtgcgggcgctctgggctgagagtgacaccctgctgctggacgagccctttaccgggctggacccggagaccttgacccgtgctgccgccctgctgcgccagcgcgccgccgggaagaacgtccttctggctacccacgatcaggcggccattcaggctttgggctggcaggtgatccggctgtga

SEQ ID NO: 1488 - DNA, 570 bp, Unknown
  Artificiall/Consensus sequence
atgcccttttatggagagcaagaccttttgctcgaactgccgtgtgcattgctactgcccggatatgcgggagaagatccgcatggtcatgcggttttctggtccgcggatgctgttttatcacccggtgctggcgatccggcatttggtggagagcacaaaggaaaaaagaaggatggatcgggtatgaagatcaaaaaattggtgtacctgctgttggggtgtctgggactggggttgggcgcagtgggcgcggtgctgcccatgctgccggcttttccttttttgatgctggcggcctgctgctttgcaaaaagctctgcccggctggaccggtggttccgggggacaaagctctataaggacaacctggaaagctatgtccagggccggggcatgacctggcaggccaagcggcggatcatgctgctggtgactgcgctgatgagtgtgggtttcgtcattatggcggcacagtcggtttgggtgggctgtgctgtgctggctggcgtatgggggttccatattgtatattttatctgggggatcaagaccttgaagccagaataa

SEQ ID NO: 1489 - DNA, 747 bp, Unknown
  Artificiall/Consensus sequence
ttggcggacgatgagccgctggtattgatcgggctgcaggggatgctggagtgggagaagctgggctataccatctgcggaaccgcccgcaacggccgccaggcgttggagaccatccagcaggaaaaaccggatatcgtggtggcggatgtgaaaatgccgctgatggatgggcttaccctggcccgtacctgccgggaaaaaggctcgctgccggtgttcatcatcctgaccagctttgaacagttcgactatgtgcgccaggcgatgggcgccggagcggtggattatctggtgaagctggagcttacgccggaaagccttaccgcagcattggcgcgggctgcggagcgggtcaaaaaggaacgggcgctgatgggggagccgcctgccccctccggcatggccgaaggactgcgcagctaccaggacagtttttttacgcggctgtacgctgggatgtttcagcaggaagaggagctggaagcgccgctgcgccggttgggggcagaccttgcggcggaccggtatcttctggtcagctgtgagatccgcccggcgggtgcggcactgaccgacccgcagcagatcaaattgagcttctcctgcgccaaaatgatggaaaacctgctgaaaaactatctgccctgctatgtcaccggggccgatgtgctgcgctgcaatgtattgttctgcctgacgcagacccaagcggagaactaccagcagctggtgcgcccgctgctg

SEQ ID NO: 1490 - DNA, 804 bp, Unknown
  Artificiall/Consensus sequence
atgagaaaaattgcagtgctgatggcagcccttggcctggcggcagtcttgaacggctgcggatcgggcctgacacagagccagcaggtgctggagatggagacagaggatgttctggtcctttcggacggacaggctgtggactgttggcgggaatacgagacctttccggatacggatgtccatctgcccagcggctgggtggactactgcttagaggatggcacggtcctgctgcaagagcaggatctttatccgccagctttgccggagacgctgccggaacaggtgcgccagagcatccagaaccattacgcccgtcagggccgccggtattcggcagaaagcctgctgcagggagcctatgcggagtacaagaaagacccggcgggcttttctccctggatggcctggcagaatacctgggagacagccctggccgagcgggtggtctatgtggtgacggatgtcactctgccccttggcggccgggagcagaccagctacccggtcggggcggcgtttgaccgcaccaccggggaaaagctctcgttttggagcctgtgcgctgtgccggaggccgaagccaaggagatgctgctgggacaggtagacccggaggacccgcgccgggcgccgatgctggaagctctgaccgaggatatggtggtgatagccggcgaccattacaggatcagctatcccgtgggcaccctgcccggagaagagctgggtactcttttgagtggtgagctgccggagggtctgctgcagccctgggctgtgccggaggcccggtcatga

SEQ ID NO: 1491 - DNA, 933 bp, Unknown
  Artificiall/Consensus sequence
atgctgactgtcacactgctgggcactgcagcaacgatgcccctgccggaccgggcgctgagcgctgcggtgatcgagtgcgcaggccatagtttgcttttggactgcggcgagggcacccaggccgctgcccgccgggcgggggtcaacctgatgcgggcggatgcggtctgtctgacccattatcacggcgaccatatctttggcctgccggggctgctccagacgctgggctgccaagggcgcacaaagcccctgacgatctatggcccggcggggatggagcaggtcgccgggccgctccgggcgttggctgggccgctgccttatccggtggggttctgtgcccttctgcagccggtggaactgcctgaactggcgccgggctggcctgccggggcgatcctgcgcccggtccccacccgccaccgggtgcagagccaggggtatcggctggagctgcccagagccgggcgttttctgccggaaaaagcccaggcgctgggcgtcccggtgcgggaatggaagcgcctgcaagccggtcaaagcgtggtgactcccgcaggcagcatcgccccggagcaggtgctggggcctgcacgccggggcctgcaggtggtgttttccggggacacggcgccctgtccggggctggaacaggccgcccaaggggcagatcttttgatctgtgatgccacctatgccggggaagaatatgcggctcaggcccgccagtatgggcacagcacctttgcgcagacggcatctctggcggcgcgggcaggctgccggcggctttggctcacccactattcgcccatgatcgaagatccagaggcggaactggaacaggcccaggcggaattccccgcagcggagtgcgggtttgacggcaaatgtcttaccctgcggtttgaggaggacaggacatga

SEQ ID NO: 1492 - DNA, 240 bp, Unknown
  Artificiall/Consensus sequence
atgccgggtcttatcttcctgattgtaccacatcccctgccagaaaaaaagtatcggcaccgctgcggctgtaaaatacaagcctgccgttccaacgcctgcctggaagcgccgaaagcgcagaatggaaaacgttttttccacaagaccggttctttgtgtggaaaaaccagcctctcttttacgcttttagaccgtatttcgacaggaatttacagaaaaaggagaaagccggggtga

SEQ ID NO: 1493 - DNA, 384 bp, Unknown
  Artificiall/Consensus sequence
atgctgaatattctgatctttgctgctggtgcggccattatgttctggatggggcttcgctctctgctggcccgccgccgtctgtgtacaaaaggcgaaaaagtatcggcccgggtgacgggcacggtgcaaagcagctccggctcggcctatgtgctggagtttgagacccaggggggcagccaccggctccagtacccgaagcccagccggggcaagagctttgaagtggggcagaccgttgcgctgttttatgaccccgatgacctggacaagatgtatgtagagggcgacaaggctatgctgggggccgagatcctgtactatgccttgggcgcagcgctgctggtgctgatgtttgggctgatgggaggacaggcatga

SEQ ID NO: 1494 - DNA, 384 bp, Unknown
  Artificiall/Consensus sequence
atgacggtaggacaagcgctggaacagacccagcagctgcgcccgggcagccgtatcccggcattgactttacagcactggctgcgggatctggatggatccctgcgctgtcaggtgtttgcccgcagcaaaaggccggaagaaaggacgcagggggcagacctggcctgggacgatggacttcgggaggaggatgtactgctggtccccgcgccctatgatgggctgtaccctcactatctctgtgcgcagatcgatggagcgctgggggaagcagaccgctatgcgggggagagggcacagtatcaggcgatcctggcagaatttcgggcctggatgcgccgcacatacccgccttgcagccaggtccgctggcgctggtaa

SEQ ID NO: 1495 - DNA, 702 bp, Unknown
  Artificiall/Consensus sequence
ttgatttacgattggcgtaccaccatcgccctggctgccctgcgggatcttcagctgtctgcgcccctttgcctggaaggagacgggctgtgggtatgcctggtatccagcggccaatgcaccgccgccctggcagacccaggggcgctgccgccccagacagccctggccggacagctcatcctgagccgcagcccgctggagctgtcgccccaagggggcagccacctgctctgtgccctgctcaccggccaggctccggcacagtttctggcggggctgaacagcccgccctttttggccaagggcgagacctgccccgctgccgccgagctgatggagcagctggcctttgaacaggccgggcgcagccgtgctcacagccagatcgcctttgccctgctgtgtgagctggcagaagccgacgcagccgccccggccctgccgccccttgtagcggccgccatggaggatatccggcagaattacgccggtctgtacggggtggaggagctaagcgagcggctgggcgtaagcaaaagccacctggtgcgggcttttacccacgcagtgggggtctctcccgggcgctatctgacccgggtgcgcattgaagcggccatgcggcttttgcagcatcgggaatacacgctggaggtggtggccagcctatgcggattttccggcgcaaactatctgtgc

SEQ ID NO: 1496 - DNA, 672 bp, Unknown
  Artificiall/Consensus sequence
atggtatcggatacagcacagcgcagtgcctttattgagcagaacctggggctggtccacgcctgtgccggacgattccggggccgtggcatcgagtacgacgacctgtacagcgcaggttgtatgggattggtcaaagcctatgatggttttgacgaaagccggggagtatgcttttctacctacgcagtaccagtgatcctaggcgagataaaaaagctgtttcgggagggtggggtagtaaaggtgagccgctccctgaaagagctggggatgcgggtcaatgctgcgcgggaacaatacatcaagctgtgcggtaccgagccaagccttacacagctggcgcagcagctggatgaaccattggattccatagcgctggcagtacaggctgcacagccagcattgagcctgacaccggataatggagaggaaagcggggcacaactggatataccggtagactccccagaggaagaactggcagatcggatcagtttgggggaggtgctccgcagcctgccgcaggaagatcaggacttgatccgcctgcgtttttatggagagcgtacccagagtgaaacagcacgcctgctgcatactacacaggtacagatctcccgcagagagcgcaagatcctgcgttggatgcgtgcgcagctattggaatag

SEQ ID NO: 1497 - DNA, 828 bp, Unknown
  Artificiall/Consensus sequence
gtgagccgctatacgctgggcattgataccagtaactatgcaacctctctggcggtttttgatacggccggagaggttgtttgtgccaaaaagcgttttttgcccgtaaagcagggtcagctgggactgcgtcagagcgatgcgctgttccatcacacggccgccctgccggaaatgctggcacagctgaatacagagtttgatctgacgcagatccaggcggtaggcgtgtcccaacgtccccggccggtagagggcagttatatgccttgttttttggccggagtcaatgccgcccaagcgtttgctttggcgaaagggatcccgctggtctataccacgcatcagcaaggacatgcggcggctgcactgtttgcagcaaaaggcgcagagctgtttcatcaaaaggtacttttgttccacatttctggcggaacaacggatcttttgctctgcgatcaggtgaaaaatattcaaatgttaggcaccagcatagatctgtatgcaggtcaggctgtggacagagtgggcgtcaaattgggatttgacttcccggcgggagccatggtatctgagatggcggcgcaatgtgatgaaaccatcaaaccgagatccagtgtcaaggagatgcaatgcagcctttctgggctggaaaatcagtgcaatgctttgctggcatcgggtcaaagtcctgcttatgtttgcaagtactgcctgctttgtgtggcggatacggtggtcaaaatgacccgcgcagcgcagcggcagtatcctgcgctgccggtggtatgcgccggaggggtgatgagcagcgatgtgatccgctcc

SEQ ID NO: 1498 - DNA, 342 bp, Unknown
  Artificiall/Consensus sequence
gacgagcagcgggtgttcgacgcaatggatgcagaccgcaccggccgttatctgccgttccgttaccggggggatgcccccagtccgttccagaaggataaacgggcggatgaagccaagatcgagcgcatccgccagcatctggatgagctggtggaacagatgggccagcagctgtacgatggacgcattgaagcggcgccgctggtcagcggccgaagtccttgcctgtggtgcgattatagcctgatctgccgccatgagaccggtgtgggggagcgggagctggaagcaccccaaaagccctttgagccggagaaaaaagaggaggaagaagcatga

SEQ ID NO: 1499 - DNA, 831 bp, Unknown
  Artificiall/Consensus sequence
ctgacaggcgataccctgtgggagatcgcccagaagaacaacctgaccatgaaggagctttgcgccctgaaccccaactttaagggtgcacccctgagccaggattccagcatcatgccaggggatgagctggtcatcaccaaggaggagtctctgctggaggtgcagatcacaaagaccgtcacctggaaagaggagatcccctacgccatcgaaaagacaaaatccaatgagtacacagtgggcaccaccaagaccctgcaggaaggccagaatggtctgcgggcggtgacagctcagaacatttacgatacggacgggatgctgttggagcagaccatccttggcaacgagaccctgcaggaaccggtgaccaaaaaggtggtggtgggcaccaaaaagatcaccaacaagaccacatttatcacgggcagcggtcagtttatctggccggtgccggggtatagctattgctcgcgctggtttggcggcagccaccgaggcgtggatatctgcgccagtgccggtacccccatttatgcttcggcagggggcacggtggcaaaggccggttataaccgtgcaggcgcaggcagcaactatggctattctattatcatcaaccacgcaggcggctacaagactgtgtacgcccactgcctgtccctggtcgttagtgcggggcaaaccgtcaaacaggggcagctcattggctatgtgggcagcaccggcagatccagtggcaaccattgccactttgagatccggtccggcaataagtacatcccgcctcagaatgtgttcaaccgcagtagttaccgtaaccggtaa

SEQ ID NO: 1500 - DNA, 567 bp, Unknown
  Artificiall/Consensus sequence
gagccgctggactttttgttctgtttttcctgcccggtgctctgggtggcccatgccgccctggcggggggatttatggtgctgctgcaggtgctggatgtcacagcgttcagctccaatctgttcgcttcgctgctgctcaacctcagtgccggggccgatgccacccgctacccgctgttttatctgctgggggcggtgcaggtgctggcctattttggcgtgttcacggtgctgatccgggtgctggacctgcccacgcccggccgcttcaaggccgtgggccgtctgcgggagcattggcataccgaccccgcaatggtgtgccagctcattgaggcgctgggcgggccggacaatgtacaaagcctgagcagctgctttacccgcctgcggatcaccgtggcggacccggcgctgctgaaggcggacgccttgctggaactgccccaccggggcatggtgcgccggggcggggagctgcagctggtctgcggcctccatgccggggagctgtgccgggcggtggaagcgcagcttttgcagcagatggcgggcatacactag

SEQ ID NO: 1501 - DNA, 354 bp, Unknown
  Artificiall/Consensus sequence
ttgtttcaatttgtccgtatcctggcattctgctttttaggggagctgctgcatgctgtgctgcctttgcccatcccggccagcatctatggtctggtgctgctgctggctgccctgtgtctgggcatcgtccggctggatcaggtgcaggagaccgggatgttccttaccgggatcttcccgctgctgttcgttccggcggcggcaggggtcatggagctgtggaccgagctgggggctatggcgctgccggtggcgctggcggtaggaccagtgacggtactgatcctgatatgcgccgggcgcaccacccaggctctgaccgcccggaaaaaggaggactgccatgagtga

SEQ ID NO: 1502 - DNA, 549 bp, Unknown
  Artificiall/Consensus sequence
cagatcgtggccgcagccgtgcatggagccggtgatgcattggaagggcagaccggtctgctcttgaagggccaaagcatccatatcggcccggagcagaatggtcttgccggggcggctgccctggatggtggcggtcagagagctgtgggccagctcctgcgggcattagccatactggatcagtttttcctttacaaaggctttggtccggggcagctgctgccccacttctgcattttgatgaagggtgtgccgcatctccaccagctcgggctggagagcaagggcctgctgatagatctggtgcataaaataaaactcctttcagaaaaaaccgcagcattttacggtcctgaccgtgggggacgatgtttctattatacgcttgttggcgcagcaagggggagaaatttttatcggtcttatcgtttgcggcaagcggcacaggaccggctataccggacggtcggtttgatcccatgcctggcgcagcagctgcaatgcgtggctttccaggcgggatacatagcgccctgcttattgtaa

SEQ ID NO: 1503 - DNA, 288 bp, Unknown
  Artificiall/Consensus sequence
atgacatcgctgctgcttgcagtcatctatctggccttcatcgggctggggctgccggactctctgctgggggcagcctggcccatgatctaccctcagttcggggtgccggtgtccagcatggggctcatctctatgatcatctccgccgggacgatcctttccagcctgaacagcagccgcctgacccgggcactgggcgccggcaaggtaaccctgctcagcaccgtactcaccgccctcgccctgctggggttcgggatgtcccgcagcctgtggcagctctgc

SEQ ID NO: 1504 - DNA, 870 bp, Unknown
  Artificiall/Consensus sequence
atgcgggtagaacagacctcccaggggtttgccctatataaggaaaaatcacagatcggctgggtccatgcttcggccagcccccaaggcggggacttcggctgtctatggctggaccccgcctggcggggccggggctacggctcctacctagtcaaagaggtcctgcgcttgtggggcggctttgacaccagccgggccacggtattcactgcaccggcgcccactgcgcctgccgaagccgccctctgggcaaaattcggctttgctgccgagggagggcggctggtgcgccgccgcaagccagacctgtccgccgtgcagctggcgcagcagttcgtagccggtcactgccccgcccccgggctgtgcattgacgccacctgcggcaacggcggggacaccgcctttctctggcagctggtgcaaaaaagcggcggacgtgtgctggccatggacatccagcaggccgccatcctgtccacccgccgacgcctggaaaagctgggggcagaccccgcccgctgccagctggtgcaggacagccacgaaaacctgctgcatcacgtccagcccggcagcgccgatgccatcatgttcaactttggctggctgcccggagccgaccaccaggtacactcgcaggcggggtccagcctgaccgcactgcaggcagccctggacgctttgcgccctggcggcatcctgagcgcggtgctgtacagcggcaaggtggtcggctgggatgagcgggatcaggtgctggcgtttttccgcagcctgccgctgacgcagtatactgtgctggtgtgcgattttgccaactgggacaaaaccgctcccctgccctgctttgtgctgaaaaagtag

SEQ ID NO: 1505 - DNA, 453 bp, Unknown
  Artificiall/Consensus sequence
atggccgccatgctgctctccctggtgctggcatgcgggctggcatttggtgcgcacgctgcggaggatctgcccgtaagtgtccagttctggcgggagcataccgacaaagctgcgctggaaaatgacggcgtggatactgaccgggaggccacccttacccgccagcccaatggcacctataccctggagctgcccatcctgagtttttcccgcatgggaatggcaggccatctgaccggcctgaccatcggcgacatctcctacgatggcgaactgagcggccagctgacggacaacactgcggtgctgaccatcaaaaacctgcccgcctcggtgcttaccgggccggacgctgcacaagccatagatgtgatgtgcaacgtccggatggatgccggtgtcctgggcgagatctccaccgccgcacggctgtgcatctggcagccgtaa

SEQ ID NO: 1506 - DNA, 615 bp, Unknown
  Artificiall/Consensus sequence
gagatggtacagcaggtcacccgccggactgcaatgcggtacgatcgggatggggacgaccattatgatatcgtctctgcctatcagaaatccatgcgggggtcggacccggatgctgcgctgcattacttggcccgcctgctggaagccggggacctgccctcggcctgccgccgtttgatggtctgcgcctgtgaggacgtgggtctggcttatccgcagatcattcccatcgtaaaggcagcggtggatattgccaatatggtgggcctgccggaagcccggctgccgctggcggatgcggtgatcctggtggctaccagtcccaaatccaactccggccacgatgccatcaatgcggccatggcagatgtgcaggccgggcgcaccggcccggtgccccgacagctgcaaaataagcattatgacggggaagatgcccttgtcaagggccagaattaccgctatgcccatgattttcccgggcattgggtggatcagcagtatctgcccgacgctctgaaggatgtgcgctactatgcttttggcgataaccgtaccgagcaggcagcccgagcctactgggccaagatcaagggcgaggagaagctttga

SEQ ID NO: 1507 - DNA, 288 bp, Unknown
  Artificiall/Consensus sequence
ttgtatcggctgctctgtgaggaggacccagccctgtccggtcaaggaggtctgtcgcagctctctttgcctagctccctgacgggagaggaacagacgcttttgcgagaatgtctatccgggatcggtcatgcggctgcgcagcaggagtgtgaacggctggactattaccagcttcgctttgaaaagatccttgtggaagcggaacagaaggaacaggcgcgcgctgtactgacccaccgtctgggagccgctgccggagcggtgttggctctgtggatcgtgtga

SEQ ID NO: 1508 - DNA, 606 bp, Unknown
  Artificiall/Consensus sequence
gattttaccctgatggagaaagcacgctggctggaggagatcctgcagcgggaggctctgcccccgccggtattggtaggccagtcgatggggggatatgtggctcaggcttttatgcagcagttccctggcagggcgaagggctttgtctccattgattcggctccgctgcagcggcagtatgtcaccggggcagagctgtaccttttgcagcggatggagccagtctatcgctggtatccctggccgctgctggtttggtccggcagcgtggggtgcgcggtctctccgtatggccaggagctgatgcgtcggatgatggatgcctatactggggatcagccccgatatgcggcattggcaggccatggatacaggatgctggcccaggcgatggcggcagacctgccttatcgcatcgactgcccggcgctgctgctctgcggccggaaggatcaggcgggttccacccggcgatataacaaagcctggcatcgctgcaccgggattcccctggtctggctggaaaatgcgggccataattccaactgtgataagccgcagctggtcaatgccctgttggagcgttttgtggcccagctgtaa

SEQ ID NO: 1509 - DNA, 516 bp, Unknown
  Artificiall/Consensus sequence
atgaccgccgaacgctcccaccagaccgctgcctggtttgctgcccatccccgtctcaaagccggggtggtggccgccaaccgctggctgcctctgatcccttttgcgtgctaccctgccctgctgatctggctggggctgaaactggctgccggccagacccagcttctgcccgcagcggtccgggcggtgctggtgccggcagcggtgtttctgggcggcacagccctgcgccgggcgctcaacttcccccgcccctaccagcagcccggcttcgtgccgctggtgcagaaagagcggcagggctgctcctttccttcccgccatgcactgagcgccggtgtcattgcagcggtgtggctgtatttcagccccgccgccggggctgcgctgacggtcgttgccctggtcatctgcgggcttcgggtgctgaccggcgtacattttgtccgggatgtagctgccggttttacccttggttttgcattgggtctggccggtatgtggctgctgtaa

SEQ ID NO: 1510 - DNA, 936 bp, Unknown
  Artificiall/Consensus sequence
ttgacccagctggcaagccgcggactgccggtctttgcggtcagcggaaaccacgactctgcccagcgggtcgggtttggggcgcagctgctggccaatagccggatctacctcagcccggtcttttccggcccgctgacacccattacgctggcggatgcctatgggcctgtggaagtatacctgctgccctttttaaagcctgccactgtgcgccatgtttggccggaagatgagatcaccagctatgccgatgcgttggcctctgttttgcggcgcatccccgccggggacggatgccgccgggtgctggtggcacaccagttcgtagccggagccgccgcctgtgacagcgaggagccatcggtaggcggggtggatgccgtagaccctgcgttgttcgatggctttgattatgtagccctggggcatctgcacagcccgcagcctgtggggcggcagggggtgcggtactgcggctcgccgctgaaatactctttttccgaggcaaaccagcaaaaaagcctgacctttgtggagctgggcgccaaaggggaactgaccctgacccaggctcccctgcacccgctgcacgatgtgcgccagctgcggggcgattacatgaccctgaccgaccgccgccagtacgagggaacaccggtggaggactatctgcgcatcacccttaccgatgaacaggacatccccgacgggatggcccgcctgcgcaccatctaccctaaccttctgcggctggactatgataaccgccgcacccaggcgcaggcagcagccgcaccggcacaagcggcggccgccaccccgcttgaagcatttgccgctttttacgagacccagaacggccagcccatgagcagccagcaggccgaattctgccagcagatgatccaagagatctgggaggaggagctatga

SEQ ID NO: 1511 - DNA, 282 bp, Unknown
  Artificiall/Consensus sequence
atggaaaatgcaaagccgcccaggagcctggcaagtctctcccgggccaccgacaccctcagcaccctgctggcccagcaggtccgggagctgaaccttcagcagcgggcggcccggcgggaaggaggcgcagaccctggcgggatgaagggattgaaagaggctacggcggtgctcaaagatctggcagcggtggccaagacgctgaatgaacagggaagcggagcggaggcagccgcaggcggtgtggtgctgctgcccgccgtggaggagcgaacatga

SEQ ID NO: 1512 - DNA, 165 bp, Unknown
  Artificiall/Consensus sequence
ttgatcagtgatctctatgcggcgtatgaatattgcgatacgcccaatctggctgcggagatacacaccatctggaatacgctgctgttcaaccccatcgaggacgaaaatgcgctgtctatgcagctgaaaaccctctccgatgccatgaaaaatggagtatga

SEQ ID NO: 1513 - DNA, 699 bp, Unknown
  Artificiall/Consensus sequence
atggaaaagatcaaagtggtacagtacgggtgcggcaagatggccaagtacaccctccggtatttatatgagcacggcgcacagatcgtgggcgccattgacgtgaaccccgccgtggtcggcatggacgtgggcgactttgcagagctgggcgtcaagaccggcatccggatctccagcgatgccgacaaggtgctggacgagtgtgatgcagacgtggccatcgtgaccctgttcagctttgtgaacgacatctacgaccatgtagaaaaatgcgtggcccgcggcatcaacgtgatcaccacctgcgaggaagcgatctatccctggaccactgccgccgcccagatcaacaagctggatgcgctggccaaggagaccggctgcaccatcaccggctccggcatgcaggacatcttctggatcaacatggtggctatggcggccagcggctgccacaagctgacccgcatccagggcgcatacagctataatgtagaggattacggcctggcactggccgaggcccacggctgcggcctgaccaccgaggagtttgagcagcagatcgcccacccggctgagttcgagccctcctatgcgtggaacgccagcgaggccatctgcaacaagctgggtctgaccatcaagtccatcagccagaagaacgtcccctacacggcggatcacgacgtgtac

SEQ ID NO: 1514 - DNA, 1413 bp, Unknown
  Artificiall/Consensus sequence
ccaccggtgttcaaattggtaaaatgttttgcaaagccggtggtgctgcaaaaacagctacagcccgggcggctgagcttggaggggtacctgcgctgtatcgtctattaccaaggggaggagggggcgggtctgtgccagaccgagcaaaagctcccctttgaaaaatccctggaactgccggtatttgactttacagcctggacggcggtcgtggaaggggcgaccgaatatctgaactgccgggtggtcaacccccgccgcatcgaggtcaggggcgcctttggactggtggcgtcggtgcgggcgcaggtcaagaccgaggtgatcacagcgctgtcagatggcggggtggagcagcggatgtgtacgctgtccggcgtcaggagcgtggccgtgcaggaaaaactcctcaccgcagagggggagctgacctttccccggcccccggaagccattttggatatcagcgggaccgctgccgtgcgggaaatcaagctgctggcaggcaaagctgtgatcaaaggggagctgcaagcccagtgtgcttggcgggcagaaggcgagcctggcctgcaaagccaggcagtgaccctgcctttcaatcaggtactggatgtggagggccttacggaggaatgtcggtgcttgtgtgtggtggagccggtggggttcaccctggcacaaggggagggcgaggcgaccagcctgacggctaccgctatgctgcacctccgggcctggcgcagttttcagctgcaatgcaccgcagatgccttctctacaaaatatgaagccagcctgaccccccagactgtgccggtggaggggcttgcgtgtctgctggaacagaacgccgtggtcagcggttccgggcctttgccggatgccggggcaaagatcctggcctgttttgcttcgtttagcccggtccaggtaagcagtcagggggaggggtatgccctcactgccaaggtcaccgcaacggcgtttgcggagaatagcctgggtgagctggaaagttacgataaaaccatggacctgtcgctgccgctggagctggttgcgccgccggacagtgagttctatccggaatgttggctctcggcagaaaatctgcaatgcagctgcgccgggggcacgttggaggtgtcggtaacggtccatgcggagggggcagtcctcagccgcagcacccagacctgtgtgggtgccattgagctgggggagccactggcacccgcagacccggagatctctctgcgcatctattatgcccagaccggcgaggcgctgtttgatattgcccggcattaccatgtatctccgggtcagatgctggcggccaatcagttggaccctgcggtccagatactggaggagccccgccgcctgctggtgccgggggcctga

SEQ ID NO: 1515 - DNA, 912 bp, Unknown
  Artificiall/Consensus sequence
atgaagatcattgatgcgcatgtccatctggtgcagtgcattgcgggtacgggtgccgggggcgagctgcgcagctgcggcggcggacagggcatttatgcggatggatcggtctgtgcattgatcccgcctgcctgggggaccgaccaggtgaccccagagcggatgctggagctgatggatgcccaccaggtggagcgagccgttctgctgcaagggggctatctggggttccagaatctgtacagctggcaggcgcagcagcagtggccgcatcgctttttggcggctgccgcctatgatccttacagccgtggccgggatgcgatcgtacatcacttgttcgaggagcagggcatccgggtggtgaaatttgaggtcagcacgggttctgggctgatggccacccatccggtgtttgcgctggatggagaggtcatgtgccgggaggctgcctttgccgccgagcatgggctggtgtttgtgattgatattggcaagctgggcagccccagcagccagatcggggcattgcgccggctgatcctgcggcatccggatatgaagttcgtggtctgccacctgctggcgcccaaacagacggagcttgcgcagatgaccgatggtttggaagcgctgcacctgcccaatgtatggtttgacttggcctcgctgcagcggaatgtccgcctggatgaaccgccgttccccattacacggcggttcatagcgcgggcggtggagacggtgggtgcggagcggctgctgtttggccccgatgcgccctctaacctctgccatatgacctaccagcagatggtggataccattgcccaggaccctgccctggcagaggagcaaaaacagatgatcctttacgagaacgccaataaggtattctggaacgagtaa

SEQ ID NO: 1516 - DNA, 507 bp, Unknown
  Artificiall/Consensus sequence
atgccgattgcaatttaccccggctcctttgacccggtgaccaaaggtcacctggatatcatcaagcgggccgccaagatccacgaaaagctgatcgtggctgtgctgatcaacagctcaaagcatcctctgtttaccgtagaggagcgggtggagatgctgcgggagtgctgccaggggctgcccaatgtcacagtggaaagctttaatgggctgaccgtggattttgccaaaaaacgccgtgcttccgtgatggtgcggggcctgcgggctgtgacggattttgaaaacgagatccagcttgcgcagatcaatcacgcactgatgcccggcatcgagacgatgtttctggccaccagcatcaagtggagttatctgtcctccacggtggtcaaggaggctgcccgctacggcagcgatatctccaagttcgtcacccccaatgtggaaaaggctgtgcacgataaatttgcacagctccggcagcagacagaccccgatctatga

SEQ ID NO: 1517 - DNA, 876 bp, Unknown
  Artificiall/Consensus sequence
gtgatccatggagctctgcggggacaacaagatcactaccgctccggaagcatcgcacagagagctgatgagttcaatcaacttctctacgacccagacatccatgttcttatggcttccatcgggggaaacaatacaaactctattcttccctatatcgactacgcatatctgaaaaagcaccccaagatcatcatcggttactcagacacaaccgcccttttattagccatctatgcaaaaacaggactcatcactttttatggcccagctgcagcctcctcgtttggtgaacttcctccttttgtagactggacttttcaaaactttcaacagattttgagtaaggatttatcactttcctacacctatcccttaccccccgtctggaccgatgagtatatcaactggagtcagcaagaccgttccaaagaacaatatcccaatcgctggatctgcgttcatccgggctgtgttcaaggccgcctgatcggtggaaatctgaataccatggaaggattctttggtacagagtatatgccccctattcaagatggcgatattcttttcctggaagattctctcaaggatgcctgcacgattgagcgtagtttttctctcttaaagttagcaggcgtatttgataaggtcagcggcattatcttaggcaagcatgaaaagttcgatgacaatggaactggcagatcgccctatgagatcctgctagaggttctcggatcaccgcagattcctatcctagcagattttgattgttgccatacacacccaatgctgacgcttcctattggctgcactgttctgctggatgcggaccatacccaactaaaactattagaaccgcctttagagtactaa

SEQ ID NO: 1518 - DNA, 600 bp, Unknown
  Artificiall/Consensus sequence
atgaaaaacacaacgacccgcagtctcacagtcgccgccatgctcagtgccgtggcgttcatcctgcaatttattgagtttccgctgccgatgctgatccccagctttgtcaagatggatttttcggacctgcccgccctgctgggggcgtatgccctggggccggtatacggcgtggtgatcagctttatgaaaaacctgctgcacatcgtcataaagggtacgtctaccgcctgtgtaggcgagctgtgcaactttttgctgggggcggtctttgcagcctccgccggttttttgtatcagcaccgcaaaaaccgcaccaccgccctgctgggggcgctggcgggtgctgtggtcatggggctggtcagcgtgccggtaaactattggatcacctacccggcctatgtggagttctatcatatgccgatggagaccatcctggggatgtaccgggccatcctgcccacagccgatacgctgatggagtgtctggtcatctttaatatgccgtttaccatcgtcaaaggtctgctggatgccgggatctgtatgctgatctataagccgctgtctccgctgctccatggccgccgctga

SEQ ID NO: 1519 - DNA, 483 bp, Unknown
  Artificiall/Consensus sequence
atgtgggagatgctgtacgaggagttctgggacaagctggaacacttctgcttccggctgtgccgggacgaagggcgggccgaggatatgacccaggaagtgttcctccgtgcgctgcaaaaccgtgcattgatcgagagctttacgtccggtcagtgcaaagcctggctgtttgccgccgcccgcaatctgtactgtgaccaggtgcgccgggcagccagggagcagcagctgctggagacgctctgcccgggaccccagctggatgccccggatgagaccgccgccgatgccctggagcgggtggacctgaacagtctgctggagcagcttcctccggaggaccggcagctgtttttgctgcggtaccagcatgggtggaatgccacccagctggggcagcagctggggctgccgccagccaccgtccgtacccgcctggcccgtatccgggcccgcctgcaacaagaaatggaggattga

SEQ ID NO: 1520 - DNA, 951 bp, Unknown
  Artificiall/Consensus sequence
atgaatctgcagcagctccgggatatcctgaccattgcccgggaaggctccatcaccaaagcatcccgtgtgctgttcaaagcgcagccaaacctcagcaatatgctgcgggaggtggaggaggaactgcagatcacgatttttgagcgcacccccaccggtgtgaccctgacccctcagggcgagcggtttgctgcacaggccagcggtattctggcccagatggatcagctcatgcaaatcggtcagcagccggaagaaaaattcaccttagggatctcggtctgccgggcctcttattgtgtgcgggcggtctctgcctggatggaccagacccttgacccggagcatccgttctccctgcatctccacgaaaccaataccgatgaagccatcgaccaggtatttcatgccgaaagcagcctgggtatcatccggatgcccaatttttttgaaaaccactacctgcagcagctggaaaacaaggggctgtgctgggagccgctgatggattttacgatgatgctgatcatgcggaaggaccaccccttggcctcggtgcagaacatccaacagcgggatctgtatcgctacaccgagatcgtacatggagaccaacagatccccgccctgagcatggcccgcatcaatcccctgctccacggcaccccgccccgccggatctatgtctacgaccggggcagtcagatcgacctgctgcagcggcttccggatacctatatgtgggcttcccccattccactggatatggtggatgactacggtatgtgcatccgccgctgtgccctttccaccgtggtgaaccgggatatgctgatttggcgcaaagaatccatggaagatgcccgcctgcgcagctgcggagagtttttgcgggattatgcttcggagctgagctaccgtacagcgcagcggctggaacagaaataa

SEQ ID NO: 1521 - DNA, 1023 bp, Unknown
  Artificiall/Consensus sequence
tccggcggggtggtgcgctttatccataacgacaaaaaccagcttccgtgtgacgtggtcatcctggatgagatgagtatggtggatgtaaagctgtttcaggcgctgctcacagcgctgcggtacagctgccgggtcatcatggtgggcgatgcggaccagctgcccagtgtaggggcgggcaatattttgggggagaccatccgttccgggctgatccctacagtctgcctggaccagatcttccgccaggcagagcgcagcctgatcgtggaaaatgcccataacatcgtggatggcaaaccgctgcaaaaggggacccgcacagacgacttcttttttctggaagcggacggcgaggcggcccagcgcctggtgtgcgacctggtcacgacccggctgccccgcagctatgggtttgaccccatcaaggatattcaggtgctgtgcccgacaaaactgggcatgaccggcacccaggcgctgaacactgagctgcagaacctgctcaacccgcccgcccccggcaagccgcagctgcaaagcgctgcccgtgtgttccgtgtgggggacaaggtgatgcaggtgcgcaacaactatgaactggtgtggcaccgcattggcggcgaacagggtgtgggcgcatacaatggcgatatcggcatcgtggagtccatcaacctgcgggatcgttcgatggtggtgcggatggatgaccggcggctggtctcccctgcggagaatctctcggaactggagatcgcctatgcgatcaccgtacacaaaagccagggcagcgagttcccggcggtgatcctgccggcggctcaggtgccgccccggctgtgctatcgcaacctgctgtacaccggtgtgacccgtgcccggaagctgtgtgtcctggccgggcggcgggatacagtgaaccagatgatgtccaatatccgccagaatctgcggtacagcggtttggcagcactgctgcaggccgagcttccgccggaacagctccgcacagagtaa

SEQ ID NO: 1522 - DNA, 504 bp, Unknown
  Artificiall/Consensus sequence
atgctcgttaccccggaatatgtgttcaaggatgttactcgtatcacccctgcattcctggcccaaatgggcatccgtgccctggtgctggatgtggataatacccttacggaggaccgcagccaggagctgtctcccgaggtggcgcaatggctggagcagatgcgcgcagcggacatccggatgaccatcgtctccaacggcactggcaaacgggtaggcccctttgcgcaaaagctgggcatggagtttatcagcctgtccgcaaagcccctgccgctggggctgatgcgtgcccgccgccgcctgggcgtgaagcgcagccagatggcgatggtcggcgatcagctttttgccgaccgtatggccgctgcgctttatggcatccccgcctttgtggtcatcgcccgtgggccggatctggatgccagcgtgcagctgaagcgccgctgggagaaaaaatattggaaaaagttttacgaccaagggggacaggtccgttga

SEQ ID NO: 1523 - DNA, 612 bp, Unknown
  Artificiall/Consensus sequence
atggcaacacgacatggcgatacactgctgttcagccagccgccggtcatttcggcctgggcggcggtggggggcaaaaaagaaggggaaggccccttggcgcccggctttgatgagctgtgccaggacaaccgttttggccagtccagctgggaagcagcggagaaatacctgcagctgcgggctgcacggctctgcctgcaaaagggaaaggtggcgcagcagcagatcgagctggcgctggcgggggacctgcaggcgcaatgcacggcttccagctatacgatgcgggagctgggggttccttttgcaggggtgttcggggcttgcagcaccatggcagagaccctggccctgggggcggcgctgtgcagcggcgggtatgcccgccggttgctggccatgacctccagtcatttttgtgcagcagagcgtcagttccgcacgccgctgagctatggcgcggtgcgcacgcccacagcgcagtggaccgccacggcagcgggctgctgtttggtgcaggcggaggggcaaggcccccggatcacggccgctgcatttggccgggtgcaggactacgccatcaaggacatcaacaacatgggggcggct

SEQ ID NO: 1524 - DNA, 1218 bp, Unknown
  Artificiall/Consensus sequence
atgcgcgcttatgaacgacttttgcactatgtgaccgtccacacgacctccgaccctcattccggcgaccacccctctgcggcacgggagctggatctggcatatcttttggtggaggagctgaagggcttaggcgtggagaacgcttatgcagacgagcacggctatgtgtatgccagcctgcctgctacccctggctgcgaggacaagcccgctctgggcctgatcgcccatatggataccgctcccgatgccagcggtaagggggtgcgtccggtgctgcacgagcattacaacggcaaggacgttacactgccgggcaccggtgccgtgatgaaggtatccaccttcccgtttttggccagcatgaaaggggagaccctgatcacgaccgatggcaccacgctgctgggtgcagatgataaggcgggtgtggcagagatcctgaccgcagtagagaccctgctgacggaaaacctcccccatggcaagctgtgcatcggctttacgccggatgaggagatcggggaaggcgcactgctgtttgatatccccggttttggcgccgattttgcctataccgtggacggcggcgatgtgggcggcatcgaatacgagaacttcaatgccgcggatgcgaccgtcaccctccggggtctgtcggtccaccctggcagcgccaagggcaagatggtcaatgcctgcaacctggcgatggaattccatgcagcgctgcctgtgatggcacggccggagacgaccgacggccgccaggggttctatcacctgtgcgatatgcagggggatatcaacacggcgaccctgaattatatcctgcgggaccacgatgcggccaagctggaagccaaaaaggataatctccgccagatcgcttcctatctgaacggaaagtatggcgctggcagtgttgcggtggagatccaggacagctaccgcaatatgctggaagcagtgcgcccctatttccacctggtggagactgcccgcaaagcggtgcagatggccggactggagccggtggaggagccggtgcgcggcggcaccgacggcgctaccctgagctggaacggcttgccctgccccaacctgggcaccggcggattcaattaccatggtgtgtttgagtgcatcaccgtcgagcggatggacaaggctacccaggtgctgctgaatatcgtaagcctgtacgcacagtaa

SEQ ID NO: 1525 - DNA, 534 bp, Unknown
  Artificiall/Consensus sequence
atgtcgtttcattctatcaagcccgctgaactccaggagaacctgttcaatctgatcggtaaggactggtttttgatgtccgcagaaaaggatggccgggtcaatcccatgactgtggcatgggcgaccatgggcattctgtggcagaagccggtcgtgatctgcgcggtccgtccggagcgttttacccgtgagtttttggatgcttcggatgtgttcagcctgaccgtatttgagaacagctggcgcaagatgctgggatactgcggcactgtgtctggccgtcaggaagacaaggtggccaaggcgggtctgaccgtagcccataaggacggcgttccctactttgaggagaaccgcatggcgttcctgtgcaagaagctgtgcgtcacccccctggctgaggaggatttcctggggaacagcgcctttaccgacaagtggtacggtggtgagaaccgtgcggacggaacaggcggcggctaccatctgctgtacattgccgagatcacggatgttctggtcaaggactga

SEQ ID NO: 1526 - DNA, 1488 bp, Unknown
  Artificiall/Consensus sequence
atgaattttccagcagtccctcgtgaattttttaccggcgagtgttttgacgcctaccgttatctgggcgctcatccgcacaccagcccggatggtcagtccgggtggctgtttcgggtctgggcaccgggcgctgtgcgcatccaggtatgcggcggctttgacggctggggtcccggcgtggagatgcagcgggaggacaccggtatatggagcgcctttatccccggtctggcggagggggaactgtataaatatcgtatccttggcaaggacggacagaccgtgatgcgggcagacccctatgctttccgcaccgagctgcgtcccggtacagccagccgcctggccaagttggactttacctttgacgacagcgcctggatggagctgcgcaataaaaaccacaaccgccccatgaacatctacgagctgcacgcaggcagctggcggcatcggcccggggcatgccaggccgatggttcggacggctggtacagctatgacgagctggccaaagagctgatcccctggctgctggaccataattttacccacatcgagctgctgcctctggcagagcacccctttgatggcagctggggctaccagaccactggatatttttcggccaccagccgctatggcagcccggcacagctggctgctctgatcaacgcctgccaccggatgggcatcggggtcatcatggactttgtgccggtacattttgcagccaacgccgatgctctggccaactttgacgggacccatctgtacgaatatgacagcgatgtggggcgcagcgagtggggcacctgcaatttcaactactaccgccacgaagtgcgcagctttttgaacagcgccgccgccctttggatggaggtctatcactgtgacggcatccgcatggacgctatctcccgtgcgctgtactggcagggcgaccccgcccgcggggtcaaccagggtgctgtggatttcctgcgcgggctgaatcatgggctgaaccagcgctggcccaccggcatctatatggcggaggattccaccaactttttgaaggtgactgcccccacccgctacgacggtgtggggttcgattataagtgggacatgggctggatgcatgatacgctggactactttgccaccccctttggggagcggcccgaccactaccacaagatcaccttcagtatgcagtacttttacaacgagctgtatctgctggccctgagccacgatgaggtcgtccacggcaaaaagaccatcattgataaactttggggcacctacgcagaaaagtgcagccagctgcgcaccctttatttttatatgtatacccacccgggcaaaaaactgaactttatgggcaacgagatcgcgcacttccgggagtgggacgaaaagcgccccctggactgggagctgctgcaataccccttccacgacagttttcagcggtattttgcccggctgggg

SEQ ID NO: 1527 - DNA, 1311 bp, Unknown
  Artificiall/Consensus sequence
atgtctaagacaatacagcttttgacagcccgctgcggcaaaatccgtcctgactctgtggcggactatatcgcaaacggcggtttttcggctctgaaaaaagcaatgagcatggctccaatggagatcatcaatgaaatcattgatgcaaaacttttgggacgcggcggcgcttcctatccagcaggcaaaaagtggaaacagctttatgaaattgaaggagatccaaaatacattgtctgcaatgccgacgaaggcgaaccgggaacctttaaagataaggttttgctggaaaaagatccgcttagcatcatcgaaggtatggcaattgcaggttatgtttttaactcgcatgatggttatatttatatccgcggtgagtaccgtgagatccagaaactgttccaggctgcaattgataatgcagtaaaagcaaactatctgggcgacaacatcatgggttcctacttcagcttccgcgtacatattgtttcgggtgctggtgcttatatctgtggtgaaaactccggtctgctcaactccattgaagcaaaaaccggtcgtcctcgtgtaaaaccaccgcatctggcagaggttggtctctattctcagccaactctggtaaacaacgtagaatcctttgcaagcgtacctcaaattattaatatgggcggcaaagcattccaggaactgggcgtagaagattccggcggtaccaagttgatctgtctgtccggtaacgtaaatcgcagaggtacttttgaagtgccgattggcggtgttaccctgcgtgatattatttttgaccctgaatttggcggcggtattccggatggtaaagagcttaaatgctatcatctgggtggtcagtccggtccaatcggtttcccagaacagctggatacccgttatgaccacacttccctgaaaaaacagggactgagcatcggttccggtgcagtagttgtactggacgatactgtatgcatcattgattacctgaagaaggtatcggaattctttatccatgaaagctgtggtaaatgtgttccatgccgtgaaggtaaccgtcagatgtacatgatcctgcataaatttgcaacaggacttgcaacagaaaaagattttgagcgtctggaacgcctgtcctttactatggctaccgcatcttcctgcggtctgggtcagtcggcttccaccgcacttgactcctgtctgaaacacagacgtgaagaattccaggcacatatcaacggcatttgtccggtttgtttaaatagcagaaagtatggtgaccagtatgcatattga

SEQ ID NO: 1528 - DNA, 1149 bp, Unknown
  Artificiall/Consensus sequence
atgtttttaatcaaacaggcgcaggtgtatgcaccggaatatctgggggtgaaggatattctgatatgcgggggaaagatagaggcaatcgaagatcatatcgatgaccagattccattttgccaggtaatcgatggcacagggaagaaactcacaccaggcatcatcgacccacatgtacacattaccggtggcggcggggaaggaagcttccatacccaggttccgccggtcaagctgtctgagctgattggcggcggtgtcaccaccgttgttggtcttctgggaaccgatggtatcagccgcaatgtggaaagtctgctggcaagagtaaaagcgctgcgggaggaaggactcaccgtttatgcactgaccggttcttatggttatccaagtgtgacactgaccggagatgtcaaaaaggacatcatgtttgtggaggaaattatcggtgtgaaactggcactgtccgatcaccgtgccccaaatgttacagtggatgaactggtacgccttgcaagtgatacccgcgtggcaggaatgctttcgggcaaatgtggaatggtgaccctgcatatgggaagcgatgacgctgcactgagcaaggttcgtgcagcattggaacagacagcaattccaatcaagatttttcatccgacccatattacccgcagtccaaaacttctgcaggaaagctttgattttgcaaatgatggcggctacatcgatatgacctgtggttccggtggagaaggcaaaccgtccaaatgtatcatgaaggcaaaagagcagggtgtagacctcaaacggattaccctcagctcagatggcatgggcagctggtccaactatgacaaggaaggaaatctgatcaagattggatactccgcggtggataccatctatcatgagatctgttctctggtgaaggaagagggcatggatttaagcgaagcacttacctttgcaaccagcaataccgcacattcgctggaactcttcccacgaaagggatgtgtgcgcgtaggagcagacgcagaccttctgctgatgcaggatgacctgtcgcttgatatggtgatggcgcagggacagatgatgatgcaggacggcgttctgctcaaaaagggaacctacgaaaaagattaa

SEQ ID NO: 1529 - DNA, 1359 bp, Unknown
  Artificiall/Consensus sequence
atgaacgaaaaagatactcccgtttcctctctcgcgctcaagctggtggttggttttcttcttgtcctttccaccggacttgccatctgggcaagctataatcacatgaagatcaatacctatcgcactgctttgcagaacacctacctgcgcgccgccgatcttgcttcggacaatctggcaaatctctcgtccgatctggtcaagggcatgtatgtcggtacctcatcgcagctgtcgatgatctcctccaaaatgtggaaggaatcttcggaagcaaaatctgccctctccacccttccggtatcggacaaaacattggagaataccaaccgctttctctctcaggcgggcgactatgccatgtacctctccaaaaaatccgcctccggtcaggaactcagcgaagaggaacgcagccagtttgcttccttgcgcgaatatgccgaccgtttaagcggacaactggatgagatcgccaccggactgcaaaacggaaccctgacactggaacagctctccacacctaaaaccactgtggatgatccggaaaatccaggaaccacctctcacatgcagcagattgaagacagctttatgggttatccaaccttaatttatgatggtccattttccgaccacattctggacaagactcctctcatgaccgaaggcaaggcagaagtcccggtcgaccaggcaaagcagcttgctaatcaggttgccggcaaagatctgaccgaaatgcgggaagaaaactccactcttccttcttatgttttccatgacggaaccagcaattcagttgctatcaccaaaaatggcggctatctttgctacctcatcaccgataaaccggattctctcactgaaaaactctcttatgaggaggcagtagccaaagcacagcagttccttgagaaatatggctattcttccatgaaggatacctattacgagacccgcgacggtgtcatgaccctgaattttgcctactatgagcccaacacccagactatctgctacactgatctgatcaaggtggaggtttccctccaagacggttctatcgtaggactggatgcacgcggctatctggttaaccaccacgaccgcacgctgcaatccccatccatcaccgtcgaacaggcacagcaatccttaagtgatattctcaccgttgataacactcgcctcgccctgatcccaacctctggacaaaatgaggtctgcgtttatgagtttctctgcacatctcctaccggagatcgaattctttcctatattaatacacagaccggtgctgaagaacaaattttaattctaatgcaaaccccgaatggaactcttaccaaataa

SEQ ID NO: 1530 - DNA, 1278 bp, Unknown
  Artificiall/Consensus sequence
atgtatgagattttacgatggatatttgataaattcacgaaaatccgctataataaaaaaatcaagaaaaaaggaagggaatgcgttttgtcaatttattttggaatggcagcctttttatgtgcaggttcgctgctctggaaacagacctctccgcttcagggagagtttttagaaaagaatcgaaaacagcttcaaaatctgtttttgatgacagcagcattgatttttatttttgttgcaacctttcgctatggaataggatacgattattttaattatgaaaatctctatgaacagttgggaccattatcgatccagcagcttgttacagatcatgtcgggcgtgagtttatcggctattcgatcttcacccacctgtgctgggaactggggctaagttatcggatgcttctgtttgtggtaaatatcattttaacagcgatcgtgttctggtttctcaagcgatattctcctctaccatggctgggtgcatatctttatctgacgctgcagttctttgcacatagcatgaatctgtttcgtcaatccatcgcagcgacaatctgcctgctggcatttccttttttaaagaaacgcaaattgattttctttgttctggtggttctgctggcttctgcttttcacatttcggcattgtttctgcttccattttactggattttaaactggaaggttgatggcagaatctacggtgtgattgcagcgatttctctcccgatttatctgttcagcacacaggcagcacagtttttgacccattatctgtttcaaaattatgccggctatatcggttcgcactactgggcaggtctgggaaaacgttatgtgatctttccagcaatttattttgctgcagtatggtttttccgaaagagattgcttaatcaggatgagaaaaatcgaatcctgattaattcctcgttttatgtgctgatcttgtatgtgttcagtacccatcacatgattctcgaacgcttttcgatctatctttttatgtatgcaatggtactgcttccaaagctggtctgcacattctgccaaaccagcgaagtagaaaaagcagataaaaagcgggcaaaatcagtatccaaacggacaaagaatacgcataaccagaaaaagaaagaaataattttcttggcatctgttctggtagttaccatcagttttggctatttgatctttgcttcccagcagggaacgaacggatttcataaagtttatccatatgtatcggtgtggacagagcaatga

SEQ ID NO: 1531 - DNA, 1440 bp, Unknown
  Artificiall/Consensus sequence
atgaacgctgttgtttatctcttatccggtttttgttttataaaaatctttccgaacacaaaactactgaggagtggtatgatgtcaaaattacacgtacaggatctgacacaaggcagtattacccaaaagttactggtattcgcccttccttacctgtttgcaaacctgattcaagcactttatggcgcggtggatatgattgttgtaggctggtttgacagcgctgccggcatttctgctgtatccatcggcagtcaggtcatgcagattttaaccagtatggtagcgggacttactatgggaagtaccattttgattgcgcaatattccggtgcccgccgtcaggaagaaacagtccgaactatcagcacaacactgacactgtttgcattgcttgcggtattttttaccggactgctatttttctttgctccaaccgttctttctttgctgcaaacaccacctgaagcattttctgctgcactcagctatgtccgaatctgttcctgcggcactctttttatctttggttataatgccatcagtgctatcctgcgcggactgggagattccaaaaatccactcaaatttgttgccatcgcctgtgtatgcaatatcgtccttgacgttgcccttgttggaggagtcaaaatgggagctgccggggctgcattggcaaccattctgtctcagggaatcagtatgctgctcgcaatcttctttttgcagaaaaataacttcatctttaccttttcactcaaaaacttccacatctatccggatgaggcaaagcgtttaattcgtctgggacttcctgtttctcttcaggaaaccatggtcagcctgtcgtttctggttatcaatgctatcgtcaattctctgggtgtggttgcttctgccgctgtcggtatctgtgcaaaatttgaaagttttgcgatgcttcctgccggagcattctccagtgcaattgcgtccatgtccgctcagaatatgggagcacaaaaaccgcagcgtgctaaaaaatgtatgtggacaggcattgcatttgcctttttatgctctctgtttttctttttctgggtgcagattctgccgcagagcgctcttgctcttttcaaggcagatgaacaggttacagctgctggcattgaatatctgcggacattcagcttcgactttatgtttgtttccttctacttctgcatgaatggcttcttaaacggatgcggctgcaccacatttaccatggcaaacggcgttgctgcaactttcctggtaagaatccctctggcatttctgctcacaagcttcctaccaaaggaattgtccctgtatggaattggcgcagctgctccggttgctactctgttttccattgcattgtgtctgttttacctcaaaagcggaaagtggaacacctgtgaaatttcctcctaa

SEQ ID NO: 1532 - DNA, 1068 bp, Unknown
  Artificiall/Consensus sequence
atgcaagagcaaatttttaagcacagagagacacagcttttaactgtaaaggaaatgaaacaggacagggaagcgatcatccgtgcaggacagatcatccgtcagggcggactggttgcacttccgactgaaacagtttatggtctgggtgccaatgccctgaatcctgatgcggtaaaaaatatctttctggcaaagggacgtccgcaggataatccactgattattcatatcgaggatgcttcccaggcagaacgttatgccaaaaacatcccgccggtttattatgagctgtgcaggcgtttttgtccgggaccgctgacgatcattctgccgaaaaaggatattatcccactggaaacttcgggaggactggaaacggtggcaatccgtattccagctcacccggtagcaagagcgattatccatgaggcaggggtgccgattgcagcgccttcggcaaatctttccggttccccaagccccaccacagcgcagcattgtgtgcatgacctctggggtcgtgtggacgcgattgtggatgccggagagtgcagtgtgggcgtagagtcgaccgttatttcccttgcaggggaaaagccgatcctgctgcgcccgggtgctgtgactccgcagatgttaaaagaatttctgccggatctgatgattcatgaagcggtaaccgaaaagctcaaagagggagtccgcgcggattctccgggtatgaagtacaagcactatgcgccgaaggcaaaaatcaccattctggatgcagacagtagggagtttacagaatatgtcaattcccagaagaaagaaggtctgtttgcactctgctttgaggaggatgttccttttttacaggttccatatatcagcctgggcaaagatgaaaccgatcaggcaaagcacctgtttgcagcgcttagagaattggatgaaaggggcgcacaggaagtgtatgcgcgctgtccatccaaacaaggcgtgggtcttgcggtgtataatcgcctgattcgggctgcagcatatcaggagcatactctggatggggaaagtgaggcatag

SEQ ID NO: 1533 - DNA, 1386 bp, Unknown
  Artificiall/Consensus sequence
gtgttgacacaaaaattgattttgaaaggatgggtattcttgttttccaaaaaagaccttcagcgcctgattatcccgctgatcatcgaacaatttcttgccatcaccatcggtatggccgatactgtcatggtttccagctgcggtgaggctgctgtttccggtgtatcgctggtcgatgcaatcaacattctgctgatcaacattttttccgctcttgctactggcggcgctatcatttcctcccagtatattggtcgtgaagaaccgcataaagcttgtgaagctgccaaacaactcgtactttccgtgtttgttctttccatggtaattggcggaatctgtgtttttggcggaccacagattctgggactgatctatcatgatgttgagcgtgcggttatggataacgctgagatttactttttcctgactgcgctttcctatcctttcatcgctctttataacgccggtgcagcattgttccgtgctatgggaaactccaaagtttccatgacaatctccatcatcatgaactgtatcaatgttggaggaaacgcaatttttatctttggctttaacatgggagctgctggtgcagcacttgcaaccctgatttcccgtattgtaggcgcaatcttcattttgattctcttaaaacgtcctgtcaacattatccatgttgactcttatctccacttggaatttcgtcctcagatggtcaaaaacatcctggaaatcggcattccaaatggtctggagaacggaatgttccagcttggaaagatcattgttcagggtatgatcgcctcctatggaaccgctgctattgcagcaaacgctgtctgcaactcgattgccggcttcccgattatccctggtactgcaattggacttgctatggtaaccgtagtaggacaatgtgtgggtgcacaaagatatgaagaagccaaaaaatacattgtccgtctgaccggacttgcctatatctttatgttaatcctcaatattctgattgctgttttctgcggaccgattgtcggattctttaatctgtcagcagaagcaacctccactgcagaacaaatcatgctctggcacagcctgttctgtgcggtcctttggccaacagcatttacgatgccaaatggtctgcgtgctgcaaacgatgtgaagtttaccatggccgtttctgttctctccatgtggatctgccgtatctgcatgagctacgtttttggaaccatgttaggaatgggcgtcctgggtacatggtttgcaatgttccttgactgggtattccgcatcattttctttgtcgttcgtctccaatccaacaaatggcagcaccgtgaactgcagcaaaaactttctgcacaaggataa

SEQ ID NO: 1534 - DNA, 1674 bp, Unknown
  Artificiall/Consensus sequence
atgaaaaacaccgataaatatacccgaaattattttaatccacctgtcagcgagcatcgatggagctcacaggaatacatctccaaagctcctcgctggtgcagcgttgacctgcgggacggaaatcaggcgctgattgtcccaatgagtttggaaaaaaagttggaattttttcaatttctttgcaaactgggatttaaggagattgaagtcggttttccggcagcatccgaaacagaatttcaatttgtccgcacactgatcgagcaaaaactgattcctgaggatgttaccatacaggttatcacccctgcaagagaacatatcataagaaaaactttcgaggcattggatggatgccacaaagcaatcatccatctttacaattccacctctgtcgcacagcgggaacaggttttccagaaatcccgcagcgagattattgaaatcgcagtttccggcgcaaaatggctgaccgaatatgccgctaaaacgaacggtgaatttctgtttgagtacacaccggaaagctttactggaaccgagcttgattttgctgtggaaatctgcaatgcggtgctggatgtctggaaaccacagaaagaacaccccgtcatcatcaatcttgcttccaccgtttccctctcgatgccgcacgtttacgctaaccagattgaatacatgagcgatcacttaaactaccgtgaaaatgtggttctttccctgcacccacacaatgaccgcggcagcgctgtcgcagaagcggaactgggcattcttgcaggcggccagcgtgtggaaggaaccttattcggcaatggagagcgcaccggaaatgttgacctgattactcttgcactcaatctgttttctcatggagtggacccgatacttgacctttccaatataccacaggttgtcgaaatgtatgaggatgcaaccggaatgaaccttcctccccgtcagccttatggtggtcagctggtatttgccgctttttccggctctcatcaggatgcaatcgccaagggaatgcagtggcgccagagccattctggtgctcattggaatgttccttatctcccgatcgacccgcaggatatcggacgaagctatgaaaatgatgtgatccgcatcaattcccagtcgggcaagggtggtatcggctatctgctggaacacaagtacggcatcaatatgccaaaaccgatgcgggaagaatttggctacatcatcaagggaatttcggaccatcagcacaaggaactctctccagaagaagttcaccagatttttatggatacctacctcaatctgcaaacaccgattcgtctggacgacttctactttgtccacaaaaaggaatatcataccactgtttccctgaccgtcggaaaagaagaaatggaactgaccggacgaggaaacggtcgattcgacgcagtgagcaatgctttgcgtcgtggacttaatatccgctttcatgatattgtctaccaggagcatgcgctggaacgtggttccacctcccgagcaattgcttatgtcggcatcacctcggacagccagaaaacctactggggctgtggtgttcacaccgatattatcgccgcttccatctttgctctctttagcgcaattgaccgcatgctgacacaggaacaaaatgactaa

SEQ ID NO: 1535 - DNA, 1407 bp, Unknown
  Artificiall/Consensus sequence
atgagtaacctggcagaaagaaaatccggggagaaaaggaaagagagtggttatatgaaagaaaacaagggactgatgaccgagggtgtgatctggaagcagctgttttggtttgcgcttcccttgctgcttggaaatttgtttcagcagttttacaacacggtagactcgatcgttgttggaaactatattggtgcaaacgcattggcatcagtaggtgcaagtacgccgatcattaaccttctggttggtctgttcaccggactgggaaccggtgccggtgttgtaattgcgcgattttttggtgcgcaggatgacaaaggggtacatgatggagttcataccaccattgcattgtgtctggtttccggtgttgtgatgggtgcgattggcgttttgttttcaccccagattctgcaatggatgaacacgccaagcgaagtcatggagggctcgattacctatttacaaatttattttatgggaatcatagcgctgatgatctacaacatgggatcgggaatcctgcgtgcagtgggagattccaaatcgccgctgtattttctgattgtatccagtgtggtcaacattattttggaccttgtttttgttatcaaagtacaaatgggtgttgcaggggtggcctgggcaactttaattgcacaggtgatctctgcctgccttgttttgattcgtctttcgatgagcagggaaagctatcggttggttttgaaagagattcgttttcataaggatgttctgctggaaaccatccggattggtctgccgggcggaatccaaaatgcggttatttcattttctaacattattgtgcagtacaatatcaacagctttggagccgcagcagtagcgggatgcagcgcctataccaagattgatgggtttgccatcctgccagttatgagcttttccatggcaattacaacctttaccggacaaaatgtcggtgcgaaaaactatgagcgtgtgaaaaaaggtgccaacacctgcctgaaaatgtcctgtgcagttaccatagtgatttcagttgtactgtttttgtttggcggaaatctgttaaaggtcttttcgtcggatacacaggtgctgcactatgcaacacagatgatgcattttctggttccgggatatctgtgccttgcaattgcacacacctattgcggtgttgtcagaggtgcaggtatctcaatggttccgatgcttgctctgatcggaaatatgtgtgttctgcgcatgatttggattacgcttgctatgccgtttgcacacagtatcatcatcgtttttctgggatattctctgacatggcttaccagcgcactgaccatgctggtatattatcataaatcgggctggcttgaaaaatatcagcttgcccattcataa

SEQ ID NO: 1536 - DNA, 963 bp, Unknown
  Artificiall/Consensus sequence
ttgaacgatctcagtcttgaccgtcttgatgacgaaaagattctatggcaaaccttcactctcccatcttcctgtgatgggcagaacttgttctgccgcctggcagagcccacaacacctttgcgcggggtagtccagatttcccatggaatgtgcgaacatatcgatcgctacatcccattctttcgctttcttgctttggaaggctttgtagtttgcggaaacgaccatctcggacatggaaagacctgtcagaatcctgaccattttggattctttgcagaggaaaaaggataccagtatctaatcgaagatcttcaccaggtcagtcttttcttaaaaaagcgttatccccagcttccactctttctgtttggacacagcatgggctcgatgattacacgactgtacctttccaagtattcttccctgcttcagggcgtagtaatctgtggaacagccggaccaaatccagcatccaaagcaggcatgctgctttgcaaacaggtcattgccaaaaaaggtgaattttctcactcctctcagctgcaaaagttgatttttggttcttacaataaccgctgttcccatccaaaaaatgagtgggcatggcttagccgggatgatgaaatggtggatgcctacattcaggacccattgtgtggattcccgtttactgcatctgcttatctggatctgttgtccctgcaatatttctgcaacacccgggtatggtacaaaacactcgaccaaaatcttccaatgctgttgatttctggagcgatggacccggtcggcaactatggaaaaggaattcgtatgattgaaaaacagttgcttcgtgccggtgtcagcgatctgaccgtttggatttatcccggtgcccgccacgaactgctaaacgaaacaaaccgcgatgaagtcatgcgggatgttctttcctggtttgctcttcacgtataa

SEQ ID NO: 1537 - DNA, 972 bp, Unknown
  Artificiall/Consensus sequence
atgccagaagtaaaagacagtgaagtggtgctgaaagtagagcatctgaaaaaatatttcccgatgggaaaacatgctgttttaaaagcagtggatgatgtttcttttgaaatgaagcgcggagaaacattaggaattgtaggagaatccggctgtggaaagacaacctgcggacgtaccgtaatcggtttatatgataaaacggatggaacagtgttgtacaagggaaaagatgttcatgcgatgaaggggaatgaacgaaaggcatttaccaaagaagtgcagatgatctttcaggacccttatgcatctttggacccgcgcttaaaggtaaaccagattgtcggagaaggaatgcgtatccacaagatgtattcgagcaacgcagaaattcaggaccgagtgtttgagcttctggatcaggttggactgaatcgggaacatgcaagcagatatgtccatgaattttccggtggacagcgtcagagaatcggcattgcaagggcactggcacttgatccggaatttattctctgcgatgaaccgatctctgcactggatgtttccattcaggcacagatcatcaacctcttgatccgcctgcagcaggaaagaggtttgacctatctttttatcgcgcatgacctttcgatggtaaaacatatttctgaccgtgtaggggttatgtatctcggtaccatggtagagatgaccacttcagaggaactttatactaatcccgcacatccgtataccaaagcgttgctttctgcaattccgattccggacccaaaggtagaacatgaaagacagcgcattatgctcagtggagacgttccaagcccaatcaatcctgctcctggctgccgctttaagggaagatgtccttatgcaagcgcaaaatgttcgcaggaaactcctgtactgcatgagattgcgccaaaacattatgtagcgtgccatctttattag

SEQ ID NO: 1538 - DNA, 636 bp, Unknown
  Artificiall/Consensus sequence
atgaagctttttgttttttctggcagaaattggacaccgaggaggaggatgctcatggaagattgtcagaccccaacgtcaaaaaagtcgaacattgagatttgcgatatctatgacatctatggaaaccgcactggaaaaactttcattcgcggggaaccattgtcagatggacagtttgtcatggttgtcgatgtatggattgtcaacagcaaagatgaaattctgatccaaaagcgttctccatataaaaaagatcttccagatacctgggctacccacagtggctgtgtactggcaggggagacttcccagcaggcttgtatccgtgagccactggaagagatcggcatccacattcttccatcgcagattcacaaattgaatcgaaaactgagaggaaggcttctttcggaaaacttcgttgtggaacaggattttgatgttcgcgacgcagttttacaggaggaagaggtcagccagatcaaatgggtcactgtttcccaactcaaacagatggcaagcaaaaaagaattttaccgctatcccgagttttttgatgttgtccgctttttagaagaacgcaggcggcgtcaaagctctatgaacaaagttaaaaaacacaacaatgaatga

SEQ ID NO: 1539 - DNA, 885 bp, Unknown
  Artificiall/Consensus sequence
atgaaacagcttttgattttaagcggcaagggcggcaccggtaaaaccaccattgcctcctcctttatttccctgctcaaaggacagcacaagacctgttttgccgactgtgacgtcgatgtgccaaacctgcatctgatcttttccgaaggacaaaccatgctttcgcaaaaaacctgctttggcaaacgtgctgtcattaaccaaagtctgtgtacccactgcggactgtgcgaacagcactgccgctttggtgcgatgaaaaacggcgtagttaacccttatctgtgcgaaggctgcggtgtttgcgaactggtctgtccgattggttccggctcggaaaaggcggttcatctggcagaaaccagcacaggaagctacagtgtttctgccaccgaatatggggttttctccaccgcttccttaaagccaggtgccggtgcaaccggaaaaaccatcaatatggttaagcagaatctttccacctacggagaaaatgctgaaattgcagtcatcgacggttctcccggcattggctgccccatcatttcttcggttgccggtgtggatctggtgcttttagtcctggagccttccctgtcagggctgagcgaccttacccgcatcctgaaaacagtccgtcagctgcgtgttcccgctgttgcctgcatcaaccgctcggacaccgctcctcaatttacacaggacatttatcgttactgtgccgagcatgagctgatggtactggaagaaattccgtttgatccgctggttatccgtgcagtcaaccacaatcggccaatcgtcgattatccaaactctcccgctgcccagcgtgtaacaagtctgttctccaagacactggaagttttgaacaccttatag

SEQ ID NO: 1540 - DNA, 2121 bp, Unknown
  Artificiall/Consensus sequence
atgaaaccaatgaatatcaatatcttcgattatcttaaagagactgcgaacgtctcattgaccccgcagcagttgcaggccgctcaaaccattgaggggcctgttcttctgttggcggttcccggcgccggaaaaaccaccgttatggtcgcgcgcatcgccaatatgatcttccatcatcagatcgacccgggcgcgattctgaccatcaccttttccaaggcgggcgctgtggatatgcgccgcagatatgaagcgctcttttcttcgctttccgaaaaatatcatcgggagattccgtctttcagcaccatccatgcgttctgctatcgggtgctgggctcctactgcaggctcaccggcggtaccgctccaagccttatcgaatcccgcgaccgcaccctcatcctgcgcgagctttatgggcagattgccggcgagtttttgaccgaggatctggaagaggaactgctgtccaacttaagctttatcaaaaatgccatgctgcgggaggaggatgtgaaggaaggaaagtgcatcgagacccagatcaagcacctctgggagatctaccgccagtacagtcagatcaaacgccagaacggctggatggattttgatgatatgctcagttacaccctcaccatcttccgcaaatatcccgaaatcctaagccattaccagcagaccttccgctatctgtgcgtggatgaagcgcaggacacctccaaattacagtacgccatcctctatctgctgacccgccagacccagaacctttttctggtgggggacgaggaccagagcatctatcgcttccgcggcgcgtgcccggaaaatctgctggaatttccaaaacgctttcccaatgcgacggtgcttaagatggaagaaaacttccgcagcacaaaggagatcgtctcccacgcaaaccggtttatcgctctgaacaaacagcgctttgaaaagcagatgtttaccaaaaatgagcagggaaatccgattgagctaaaagtcctgcacgatttttccgaccagtatcacgcggcaatcgatgcctatctcaaagagcctggcaccaccgctatcctttatcgcaacaacctgtccgccatcccgatggtggatattctggagcgcaacgacgtcgatttttatattcgggaacacaaggcgcggtttaaacagaactatgtcgtgctggatgtcatcgccttttttgcgctgagctttgacccaagcgatttcgaggcattttcccgcatctgctataagacttccggacgcatccgccgttcgatgctcgagcagatttcccgggcaccgctgcttaatagggaaacctactttgaccgcgtcatcgacctgtgcgaggaaaatcagaacaccggacgcatccgctatgtcagcgccatgatcgcgcgccttcgtcagatgcatccggcaaaggcgatggacaccatcctgcaccagctgggatatctggattatctggaattttcaagcggcaacgcctattcgatgcaggcacagaaacttggtatcctgacaagcctcgcctcgcgggtcagcaccgtcgagcagtttctggaccgcatcgacgaactggacgaggtgattgcccaacacacccagcgcaccgattccagactgaccctgaccaccgttcactcggcaaagggactggaatttgatactgtcatcctgcttgactgcatcgatgacgtttttccctgtcacagtgcaatcgaaaagtacaagaccggacaggaggaagagatggaggaggaagcgcggcttttctatgttgcctgcacccgtgccaaaaaggtgctggttttgccgtacgcaaactattcgggcaacaatccggcgctgccgtcccgctttttctcccgtctgctggaagaccctcagaaggattcttccggggaagcagatgtcggcaacatccggctttatccgggactgatgatcgagcacaagaactttggtcggggacaggtagtcggtgttgaccgaaagaagggggtattcaccgtctttttcggcaaaaacggcacccgcacactcaccatggcgatcttaaagtcggacaccatcaaaaaggcgatgccatag

SEQ ID NO: 1541 - DNA, 945 bp, Unknown
  Artificiall/Consensus sequence
atgacagcaatcattattatcgctattttgatcatcgctatcttggttttgcttgtttcctgtatcaaaattgttcctcagtcgatggtattcgttgtagaacgtctgggttcctattatcagacatgggaaaacggtttgcatttcaaggttccgtttttagaccatatcgcaaaaaaagtttccttaaaagagcaggttgttgattttaaaccacaaccagttattaccagagataacgtaaccatgcagatcgacagcgttgtattctatcaaattaccgacgcaaaactgttcacctatggtgtagaacgtccgatttccgcaatcgagaatctgaccgcaaccaccctgcgtaacatcatcggtgaactggaactggaccacaccttgacctctcgtgatgtgatcaacaccaagattaccacaacactggatactgctaccgataaatggggcatcaaggtaaaccgtgttgagctgaaaaacatcctgcctcctgcagaaattcaggatgcaatggaaaaacagatgaaggcagaacgtcagcgccgtgaatctatccttcgtgcagaaggccagaaacgcagccaggttctgattgcagaaggtgaaaaagaagcagcaatcctgaaagctgaggcagaaaaacagtctgcaatcctcaaagcagacgcagtgcgtgaagcaaaaatccgtgaagcagacggtgaagctaccgctattctcaaagttcagcaggcttatgcagacagcttgaagatgttaaacgaagcagcaccgagcgacaaggtgctcaccctcaagagcttcgaagcccttgcaaaagttgcagatggtcagtccaccaaactgattatcccaagcgacatgcagtctctcgctggtcttgcagcatcggtaaaagagattgttacagacaaaaagacagaagaaaccaaatag

SEQ ID NO: 1542 - DNA, 1383 bp, Unknown
  Artificiall/Consensus sequence
ccggaatccgggtttttggatataaaaataaacaggaaaggagatcacccgatgtcaggagtgcagtcccgcggctcgtccaaaaggcgtatttttcggaaggtgcggcggtaccttctgcattatatcctgcttgcggcattttgtcttgcaatcgcttttatcatgtgttataccgtgtttttcaagctggacaagatcaaaatcagcggatgtacggtgtacagtgagacacagattgtggatgaaatcggcgcagagaagggtgagagcctgtttaaaattaacatttccaacgctgaaaagaagttggtcggaaaactgccctatatccgttcggtcaaaatcagccgacagtttccaacaacattaaaggttgagattgaagaggaagaagttttaggtgcagtttataccgacgaaggttttgcaattctttccactaccggtaaggttttggaaaccggtgtgctggctttgtctgaagggataccacaaatcgtgggaattaccggacagacatacagtaccggaagttatgtgcgggaatcgagcaacctgaattctgatttgattccgcagattcaggcgttgcagaccgtgcagcaagaactgaagaacaatgattttaacgacatcacctattatgatgttaccgatatgctgaacatcaaagtcatgattgaggacaggcttctgatgaagctgggaaccaacatcgatatggattataaaattcattttatcaaaggtgtactagatggcaaggagagcggggacgaggagtttgaaaatgttccagaagagggaacactcgatttcagcaatcctccggcactgcacaccatgtcgattgacattgataaggtgaagaatgaagatgcctaccatgactttggtgtggagaaaccgcctgttaccgataatatcgtgggtggtgaagagtctgaaccgatgcagacattaactccaagtacacaggaaggggaagaatccacggaacaaaccggtcaggagcaaacgcaggaacaaactggtgaagcgacccagccggaagagcagagtcaacaggagtcagcagagcaaacagacgcacagcctgaacaaacgcaagactccggagaaactcaggagacggaacaacagacagctccacaggcacaaactcagacggatattccaaaagcttccccacaggttaacgaggttaatggagttgtccaaaacactggaggacaaacgtccggtacccagtcttccgctgcacagccgtcaactggtagccagacgcagcaggcagggaatggacaggctcaggatcagacgcagtcccaaaatcaatcgggcagcacgcaaactggcggaaatgtattcaactcgcca

SEQ ID NO: 1543 - DNA, 939 bp, Unknown
  Artificiall/Consensus sequence
atgaaagggatttcaaagccagttcgaatcggactgatcatctttttcctgatggtggcactgttttcatcactccatcttgtcaaatgggcgatcgaatcctataacagcagccagacacagaaggaattacagcagctgtatcatcagggttccctgacaggtgctggaaaagaggagcagtcagcacaggaaccagtgccgggagaaagcggcagccaacagaataatctgcctgcggctggagaagaaaatgcaacttcgaccggtccggtcatgctgcccgaatacaaggctttgtatgaagtaaattccgatattgtcggatggctcaacattggaaacggattgttgagtactccaatcatgcagcgggataatgaatattatctcacccataatttttatggggaggaagacaatcacggtcaggtttttctggatgagcgcaattcgccggatctaagcgacgacaacaccatcctttatggacacaacatcaccagtgataagtcgatgttcaatgtactgaccaactaccgcgaccctcagtttgtggcagataatccaatcattcaggtcaacactctgtaccagaagtatgagtatgtggtttcggcggtgtacatcgtgtccaccagaccggagcacggggagctgtttgactatatcaactacctgaaattcagtaccaaggcagccaaggaagcgtatattgcacagattgaccgccgttcactgatcgataccggtgtgacgatgaacgcagacgacaagattttaaccttttctacctgtacctatgagtttgcagatgcgcggcttgttgtagtggcaagacgtttacgggacggagaaaaggcagaagactttggtcacaatgtaacaatgcgtgaaaacccgctgatgccagaggtctggaccaaattgtttggataa

SEQ ID NO: 1544 - DNA, 810 bp, Unknown
  Artificiall/Consensus sequence
atggggaaaacgaaaggagagagacgaatccaaatgggaaagattattgctgttgcaaaccagaaaggtggagttggaaaaacaacttcggtaattaatctgactgccggtcttggaaagtcgggaaaaaaatgtctgctggttgatattgactcgcagggaaattccaccagtggattaggaatcaataaacgtgaggtggaaatttccacctatcatcttttaacgggagacgaacgcgcagcggaagctattgtaaagacagagtttaaaaatgttgacctgattccgtccagtattgatctggcggcagcagagattgagctggtagaactgagcgaaagaaccctgagattaagacaggctttggctccgattcgggatcagtatgattatattttgatcgactgtccaccgtctatgggactggtgacactgaatgctttttctgcctgtgacagtgttattgttccaattcagtgtgaatactacgcgctggaaggtttgtcccagctgatggcaacgattaaacaggtgaaacgcctgtataatccggtaattgagctggaaggaattctgcttaccatgtatgacagcagactgaaactgaccgaacaggtggaagaggaagtaagaagccattttccagataaggtgtacaaaacagtgattccaagaaatgttcgtttgtccgaagcaccaagttttggtatgccggcaatctactttgaccagaattccagaggagcaaaagcatatctggaactgaccaaagagtttttgaaaaagtatcgtgtaaagaaaaagtag

SEQ ID NO: 1545 - DNA, 1524 bp, Unknown
  Artificiall/Consensus sequence
atgaacgattccattacaataaaacaggtcgtggaaattctcaagcaggacggaattttgacagaagtttcctgtccggacgaaatgctcgaccatccatttgattatctctcatacagctcctccgatgtaaaggagaacactttctttatctgcaagggagctgctttcaaagaggagtatctgctggatgcagtgaaaaaaggagcaggggcatatcttgcagaaaaatactttaccaagacagttccttatatcctgaccagcgatattcgcaaagcaatgagcctggtggcaatcgctttttacagggaagcatacaagtctttccggttgattggtctgaccggaaccaagggaaagacaactaccacctattttatgaaaaatattttggatacattctgcgcaaaaaatcctcagctgtgcggtgctccaaagagtgcggttctttccaccgttgaagtggacaccggaatcgagcaccatgaagcgcatctgactaccccagagtccccggatcttcagcgctactttgcacagaccagagacagcggtatctccttcctgaccatggaggtttcttctcaggcatataagctcaaccgtgtttatggtgtagaatatgatctgggaatgttcctcaatatcggagaagaccacatcggtccgctggaacacaccgattttgaagattacttctcctgcaaactccagtttatggagcactgcaaaacagcggtaatcaatcgtgatatggatcatgcccagcgtgtactggagcgtgcacgtgcacacgcaaaaagagttatcacctttggcagactggacggtgcagatctggacgatgaggattgctggattctgcgtgatattcaaaaagaggatgttggatttacctttactaccagccacggaatgcagcaggacacttggcgtatccgcatggcgggaagattcaatgtagaaaacgctttggctgcgatcatctctgcaaaagcgatgggagtggacgatgagtccattcgagaaggtttgctcaaaaatgaggttcagggaagaatgaacctgtttgaaaaggacggcatcaccgttttggtagactacgcacacaactatctcagcttcaaaaaactgtatgagtcgctgaaagcagattatccaggaaaaaggattgttgtggtggtaggctgtccgggaggaaaagcatatctgcgccgcagagatattggaacactttccggtgaaaatgcggactacctctatctgactgcggaagatccgcagtttgaggatgttcgggaaatctgtgaggaaatcgcttcctttgtgaaaccatacaataaaccatacgaaatcatcgaagaccgtgcacaggcagtagaaaaagcaattttgaccgcacagtcgggcgatgtgattgttctggcagcaaaaggggaagaggtatatcagaaggtcaggggagaatatgtatattatgaatctgaccttgcaatcgcaaaacgtttgctttcggtatga

SEQ ID NO: 1546 - DNA, 1782 bp, Unknown
  Artificiall/Consensus sequence
gtgaaaatattgagccaaggcaaaattgttaaggttgccggtccgctgatcgttgcagaaaacatgcgtgacgccaatatgggtgacgtagttcgtgttggtaagcagaagctcatcggcgaaatcatcgaaatgagagatgacaaggcatccattcaggtttacgaggaaactgccggtatcggtcctggcgacctggtagaaaccaccggtttccctatgtctgttgagctggctccaggtgtactgaccagtatctttgacggtatccagcgtcctctgaccaagatcagagaaatgaccggaagcaacatcaccagaggtatcgatgttacttctctggaccatgaaaagaaatgggattttgttgcaactgctaaagttggcgaccatgttgtaatgggcgatgtacttggtaccgtacaggaaacatccatcgttacccacaaaatcatggttccaaaagatgttgaaggtgagatcgttgagattacctccggcagctacaacatcaccgaaaccatcgcaaaagtaaaagataaagacggcaacatccatgatgtctgcatgcttcagagatggcctgttcgtgtacagcgtccatatgctgaaaagctttctccagatatcccgatgattaccggtcagcgtgttattgataccctgttcccaatcacaaaaggtggtactgctgcagttcctggaccattcggttccggtaaaactgttgtacagcatcagcttgcaaaatggtccgacgtagatatcgtagtttacatcggctgcggcgaacgtggtaacgagatgaccgacgtactgaacgagttcccagaactgaaagaccctaaatctggagaatccctgatgttccgtaccgttctgatcgcaaacacttcggatatgccagtagctgctcgtgaggcttccatctacaccggtattaccatcgctgagtactaccgcgacatgggttactccgttgctatcatggctgactccacttcccgttgggctgaggctctccgtgagatgtccggccgactcgaagagatgcctggtgaagaaggttaccctgcttacctgacatcccgtctggcacagttctatgaacgtgctggccgcgttatctgtaaaggttccgatggccgtgaaggttccctgaccgctatcggcgctgtatcccctgcaggcggcgataactccgaccctgttgtacaggctactctgcgtatcgttaaagtattctggggtctggattcctcgcttgcttacaaacgccacttccctgctatcaactggctgacttcctattctctgtatcaggatcagatcggcgagtggatggacaaaaatatttccgacgaatggtccagcctgcatcatgatgcaatgcttctgctgcagcaggaatccgaactggaagaaatcgttaaactggttggttacgattctctgtccgctcctgaccgtttgactctggaagctgctcgttccgttcgtgaggactacttacagcagaacgcattcgacgatgctgatacctatacctccaatgacaagcagtacaagatgctcaagatgattctgaccttctccaaagagtgcagaaatgccctcaacagcggcgtaaaagttgaaaaactgttctctctgccagtatccgagaagatcgctcgtgctaaatatgttccagaagatcagttcaatgcttacttcaacgacgtattagctgagattgaatcgtccgttgcaaaagtcgtttctgaggaggtatctgcataa

SEQ ID NO: 1547 - DNA, 1848 bp, Unknown
  Artificiall/Consensus sequence
atgaacgatataaaaaatccaaaaacaaaaaagccgatgatttattattacgtcattgcgctgctggtttttatgctgctcaatactttcttgttcccaagtctgtttcgccgcaccgagcgtgaggtcgattacagtaccttcatgaatcagctcaatgaaggtcaaattcagcaggtagaggttcaggatcagaaaattgagtacattctgaaagaccaggaagactggaatatctatgttaccggaaacatgggtgacccgaatctggtggacaaactggaagctgcggacgtcatctatggcaaggaaatccaggagccaatgtcgccgctgctgtatctgctgatcagtgtcggcttcccgattctgctgtttgttggagtagggcagctgctttccagaaccttgcaaaagaaaatgggcggaggaaatgccatgacctttggcaagagcaatgcaaaggtctatgtggaagcacaaactggcaaaacctttgccgacgttgccggtgaggatgaagcgaaagaagcactgggagaaattgttgactttctgcacaatccgaagaaatatgaggcaattggcgcacagatgccaaaaggtgcactgctggtaggccctccaggaaccggtaaaaccttgcttgcaaaagcagttgccggtgaagcgagcgtaccattcttttctatttctggttcggaatttgtagagatgtttgttggtgccggtgcggcaagggtcagagatctgttccgccaggcacaggaaaaggcaccatgtatcgtgtttatcgatgagatcgatacaatcggtaaaaaacgtgacagtggtgtaatgggcggaaacgatgaacgcgaacagaccttgaaccagctgctgaccgagatggacggctttgatggtaaaaaaggtgttgtgattctggcagctaccaaccgtccggaaactctggataaggcgttgctccgtccaggaagatttgaccgaagaatcccggttgaattacctgaccttgcaggcagagaggccattttgagggttcatgcaaaagataaacagatggctccaaatattgactattctgttatcgcaagagcaactgcaggtgcttccggtgcagaacttgctaatatcgtcaacgaagctgcactgcgtgcggtacgaaataaccgtacacaggttgaacagggtgacctggaagaagcagtggaaacagttatcgcaggttaccagagaaaaagtgctgtggtatcagagaaggataaaaagattgtggcataccatgaaatcggacatgcgctggtggctgcaatgcagaaacattctgctccggtgcacaaaatcaccattgtaccaagaacttccggtgcactgggctacaccatgcaggtagaggaagaggataccttgctgatgagcaaggaggaagcgattgataaaatcacaacctataccggcggaagggtggcagaagaggttatcttcggttccatcacctcgggtgcatccaacgatatcgaacaggcaaccaagcttgcccgcgcgatggttacccgtcttggtatgagtgataatttcggtatgatggcattggaaacagtgaacaatcagtatctgggtggggatgcatcgcttgcctgctcagaagagaccgctgcaaaaatcgatcaggaggtttgcaccctgattgcacagtgtcatgatcatgcaaaagaaatcttgctgcaaaacatgccaaaacttcatgagctagcttcttatctgctggaaaaggaaaccattaccggcgaagagtttatggaaattttaaatgctccggtaaaatctcaggaagaacaagagtaa

SEQ ID NO: 1548 - DNA, 1233 bp, Unknown
  Artificiall/Consensus sequence
atggttatgctggatgtattgcgattattgatagcggttattgttgcattttttgcaggaaaactgatttcacgtctgcgtctcccatccattttgggttggttgattacaggaatggttttagggccgcacgcgctggggctgctcaacaacaacgtgctggacagcggatggtttgatgtgctggagagtattttggaatgtaccgtcggtttgatgattggaaccgagcttatttggagcaagcttaaaaaagcaggcaaacagatcattgtgacaaccattaccgaatcggtgggaacctttctggtagtcagcattgtgtttggtatcattttctgggtttcccagattccggtatatcttgcgtttctatttggaggaattgcgcttgcgacagcacctgcgccgtccctctccattgttagtgatatgaagacttcaggaccggttacacgaaccttgattccaatggcagcgttggatgacctggttggagcgcttatctttttctgtgtcatcgcaatagtagcggcgaatatctcaaccaaagagatcccgatttttgctatgatgtttttggttttccttccggtactgattggaatggcgaccggatttgttacaggaaaaatgctgcaaaaagcgcagacacaaaaagcatctttgctcattctgatcgggatgattctggtttcgtcaggaatcgggctggttttaaatgagatggtactgccgacccctgttttaaacttcatgctcttgggaatgggattttccactatttttgccaatatgatttcgcaggaacagctgggcgaaatcatgaagataatgcatccaattatcggggtttcgctcattgtcgtgattttgaatctgggtgcaccgctggattaccacttgatttttaacgcaggaatttatacacttatttatatcgtatttcgtgcgattggaaaatattgcggtgcttattttggggcaagtatcacccatgcacccaagacagtcaaaaaatatctgggctttaccctgcttccacattccggtgtatctcttgtctttaccggaattgctgtttcagttctgagcacaccggcaccggaatgtgcgcagattattcagggaaccattgcagcagcggcggttatcaacgaaatcatcgctgtgtttatagcaaagaaaggctttgaatgggcaggggagctgaacaaggcagagaaggaataa

SEQ ID NO: 1549 - DNA, 1677 bp, Unknown
  Artificiall/Consensus sequence
gtgataaagggaagtcagctcagagatgcgtttatctctggcgcaaacagcatttcaaattgcagacagcaggtagacgcgctcaatgtattccctgtaccggatggtgataccggtacaaatatgtcgatgaccatcaacgctgcaaaacgggaactggaaactctcaaggatgatccaaccgttgagcaggtatccaaaaaggcagcttcggctcttctgcgtggtgcgagaggaaactccggtgttattctttctttgctgttccgtggattctccaaaggtctggaaggcaaagaagaagcagacgcaaaggatattgcgcatgcactgtctctgggtgtttctgctgcttataaagcagttatgaagccgacagagggtactattctgaccgttgcaagacttgcttctgaacatgcgcagcaggttgcccagcaggaagaagtaaccgaagtgatgatgtggaaagagatcctttctgcagcagaggatgcgcttgcacagactccggagatgcttccggtactcaaaaaggcaggcgttgtcgatgcaggcggtcagggctttgttgaaatctggaaaggtatgctgtcggtaatcgaaaacgaacagatcattccttccgaggaagaagctcaggcagctccaaaagagaaaaaggcacacggtgttgcagcagagttcaatgaagaggatattcacttctgctattgcaccgagtttatcatcaacaaagagcatccggatgcagacccgctttctcttcgtgcatatctggagtctattggtgactgcgttgttgtagttgatgatgaagagatcatcaagtgtcatgtacataccaatgagccaggtaatgcaattcaggcagcactgaaactgggttatctgactaatatgaagatcgataacatgaaagaacagcacggcgataacaacaagctggtcgatctggaagcagaaggacagccagcattcccatataaggctgttgacccggataaagaatatggttttgttgcaattgcagcaggcgaaggtgtaaaacagctgtttgttgatttgggtgttgacaatgttgtcagcggtggccagaccatgaacccatctaccgatgatattctttccgcaatccatgcaactgcagcaaagagagtttttgttcttccaaataacaaaaacatcatcatggcagcagaacaggcagcaaatctggcagaccgtaaagtagacgttctccagaccagaaccatcccacagggactttctgcaatgctggcatttgatccggaagcagaccgcaaacagaatgttaccaacatggttcaggcttatgaaagagttggaaccggttcggttacctttgcagcacgtgacagtgactatgaaggtcacaagatcaagaagggcgaactgcttgcactggaaaacggcaagatgtcctttgttgataccgacctgaaaaagacagtagttaaactgacccacaacctcaccaagaaatcaccaaacaaggatgcaagctttgttactctgatttacggtgaagatgttgcagaagaccaggcagaagaaatccgtgaagcagtagcagaacgtcttggcgacagcgctgaggttgttctgattgcaggcaaacagccggtttactacttcattatttcagtagaataa

SEQ ID NO: 1550 - DNA, 885 bp, Unknown
  Artificiall/Consensus sequence
atgaaaacatatttagtgcttttgggaacaggaaccccaaatgcctgtcccaatgcaagcggaccatcttccgcagtcgtggtgggagacagagcttatctggtggactttggcccgggtgtggttcgacaggcatccaaagcatattataaaggaatagatgcactgcgtcctgaccgcctgacaacagcgttttgtacccatctgcacaccgaccatacagctggatatgcagatttgatctttacaccatgggtgttggaaagagaaaccccgttgactgtctttggtccaaagggaattcgaaatatgaccgagcacattcaggcggcgtatgcggtggatattgactttcgcctgcatggatttgaacgtgccaatggggtcggttatcaggtaaaggtccacgagattggagaaggggttatctatcaggatgaccgtgtgagtgtggaagcatttttggtcagccacggaacactggaaagctacgcgtacaaatttaccaccatggatggaaaggtaattgtaatcagtggagatactgctccattggatgttgtagcgcagaaggccaagggatgcgatatcctcctgcatgaggtggagtacagcgcaggaattgcctgtcgagaaccgaagtggcagaagtaccaccgtgaggtacatactctgagtacagatcttgcaaaggtagcgcaacaggcacagccaaaacttctggtgacctatcaccggatttaccatatgaatattcaggacaacacacaagacctggaatatgaaatggcatggcgctgtgaggcaattttacaagaaatcaaagatgctggatatgacggtaaggtcgtcaatggacaggatttggacatttttgaagtgtag

SEQ ID NO: 1551 - DNA, 1149 bp, Unknown
  Artificiall/Consensus sequence
gagagaaacgatgacgaaggaggatcttttatgagagaatttacacttaatatgttatcgcacgcagatcgggtaaaaggacagggcgtgctgtcagcttatctggaagaactccatttgattacaggaaatttggaccaaattgaaggcaaggacaccgattttcagatgaaagtggtggtaaattctgcacgtccggcagatattacccatattcataccgtaaacccacagttttttatgcagatcccgtacctgaaaaataaaggagtaaccgtagcttcggttcattttctgccggaaacagtcgaccagagtctgagtattccaaaagtattccgggaattcttttatgattatctgattcagttttataagagtgttgactatctggttacggtaaacccatgttttattccaaagctggcagcctatggaattgacgaaaacaaggtaacctacataccaaactatgtttcctcaaaacagttttatccggtggatgaacagagaaaaagagaattaagaaaagaatatcacctgaaagaggatgtatttactgtggtctgtgccggtcagctgcaaaccagaaaaggtgtgtttgaatatgcaaaactggcagagcagcttccgcagatgcagtttgtatgggcaggagattttgctttcggcaatatgagtgatggctacaaagatattgaaaagctgctcaaagagcacccacagaatctgcatttcaccggactggtcgagcgagataaaatgccgcaggtttatcagatgggcgatgtcatgctgcttccaagctttgatgagctgttcccaatgacggttctggaagcgatgagctgccatgttccgattcttctgcgtgatctggacttgtatccagttattttggatggatattatctgaaagcacaggataatgcaggatttgcagaggagctcaataagctgtcacagcagccacagtattatgaacaggcagttcagatgagccgaaaaggcaatgatttttacagcgaagagcatgtactctcgatgtggagagacttttatcacgggctgcttggggaaagtcaacgacgtcagaataaagcaattttgaaaaaagtattttcagtggctgcgggaggagtacgatga

SEQ ID NO: 1552 - DNA, 1476 bp, Unknown
  Artificiall/Consensus sequence
atggaaaggagaaaaaaagagatggcttttaccagctctatttttttgtttgtattttttccgatttgtctgctcggattttttctggcacatgcagtggaaaaggtcggttctgtttttaagaaacttcgtctgtccgatctgtttttggtcggaattgggctgattttttatggctgggcatcgcttgatggtattttctggatggtcggcatgatttttctggttttcctgctgggaaaactcatcgaaaaagttcctcagaaaacgccggccagactgcttgcagtgctgtgcagcgtccttgtggtaacactagccctgatttactttaaatataccggatttttggttacaaccataaatcagattttttccttttctctatcggttaaaagcattgcggcacctttgggagtatcctttatcaccttttcggcgatctcctattttgtggacatctaccgtcaggatgccaaggcaggaaacttactggatgcagcgctgtatctgagcttttttccaaaggtgatttctggaccgattgctctgtggaaggatttttcggtgcagatctgctgggcagacaggaagcttgacaccgagaattttttgtggggattaaaccggatgattctgggttttgccaaaaaggtcatccttgccgatgtgtttgggctgcttatttcccagatcagcggcaatatgtccggcggcatcgatatcatcacagcatggggaatggcgtttttatacatgctgcaaatctattatgatttttccggatactcggatattgcgctgggactttcggcactgtttggcatccgcttaaaggaaaacttctgctttccttatctctcccagtctattggagaattctggcgccggtggcacatttcgctgggaacctggtttcgcgaatacatctatatcccgctgggaggaaaccgaaaaggaaaaaacagaacgtttgtcaatctgttcatcgtttttctggttaccggtatttggcatggagcgggctggaattatattctttggggtgtaatcaacggtgtgttctctgtgctggaacgaatgagcaagaataagacctggtatcaaaagacaccggcagtgatcaaatgggcggtgaccatgtcaatcgtgctgctcagctggcaggtattccgtttaagcagcatgagcgaaatcggacagtatttccagattttgtttggtgttgtccattttgatactgtcaactttacctggcagtattattttgacctgcgcatggttttcctgatgacagttggtacggtgggagcaattttaccgggattttctccggtgcagaattgctggaacaggatttcaaaaaacaaggcagtattttgtatctcgcagattctgctgctgggtcttggtgtgcttgcggtgatgttcatgattaactctacttacagcccatttatttacttccagtattaa

SEQ ID NO: 1553 - DNA, 2118 bp, Unknown
  Artificiall/Consensus sequence
atgtcagtgcgctggcatttgaaaattcatccaatacatcttgtatttgttttcaaaaaactatataataagaacaaaaataatgtgttgggaggaataatcatgcaaaaaattaccatgcaggaccttgccgaaattcattgcctgtcgcaggtagcctgctcgccggatgcaaagcacgttgcctttgtggtaaccaagccgagcatcgagaagaactgctactgctcaaacatctgggttctggagaccgaaagcggaagctgccgcaagctgaccggcggtgacaaggaatccgattttctgtggctggataacgaacgtttgcttttctccggtgaccgcaaacaacagcacaaaccacagccgggacagaatgtgaccgtctataactgcatcaacatccacggcggagaagcagaggagttttttgtcctgcccaaaaaggcaaaaggtctttatcgtgtaaacgaccacgaatttttgctgactgcgaccgatgacctcaatgctgtcgatctttccggcttggaaggaaaggaacgggaagcagcaatcgaagagatagaagaggaaaaggactacgaagtttttgacgagctgccattctgggcaaacggaaaaggtgttgtcaacaagctgcgcacccgcctttatcattatgacagccaagaggataagcttcatctgttaagcccggaatatatgaatgtaagctcctttgattatgatgagcagaccgaccgcgtactttactacggtcatgactatcagtggatggatgagcagaaggatgacctttatgtccgtttgctgcatggagagaaacaggttcaggtggatctgcagcaccgctacggggtggatgctgcacagtttgtcggcggaaagatcctgctagcaatgagcgaaggaaaacgctacggaacaaacgaaaatccagccttttaccttgctgacccggataccggcgcagtttcggaactttgtgaccttgacccaagccttcgctcgaccgtcggttcggactgccgttatggcggcggaaagggcagaaaggcaatcggggacagctggtattacaccagtacccgcggctacgactcctttatcgtgcgcttttcctttgacaagaccgaaacggttgtttccccgcagcttcacggcagcatcgactgctttgactatgcaaacggaaccttctattatgttgcgatgcgcgataacggtttgcaggaaatttactgctgcaaggaaaatggggaagaacagaaactcacccactttaacgacgaatatcttgccagccacagtgtatcgccgctcaaagagctgtgctttaccgacagcgacggggtggagatcgatggctgggtaatcgaaccggttggatatgacccgaatcagagctatccagcaattctggatgtccatggcggaccaaagaccgtttacggaaccccgttcttccatgagatgcagctctgggcaaacgaaggttactttgtctttttctgcaatccgcgcggcggtgacggcaagggcaacgagtttgccgacatccgcggcaagcgttacggcgtgctggattacaacgacctgatggaatttaccgaccttgtgctggaaaaatacccgcagatcgacaaaaaacgggtgggcatgaccggcggcagctacggcggctttatggcaaactggattgtgggacacaccgaccgatttgccgcagtggcttcccagcgctcgatctccaactttatcagcaagtgtctgaccaccgatattggatattaccacaatctttcggcagtacagtccgacccatggaccagccagccggagatgtgggagcgctctccgctcaaatatgcagaccgctgcaagataccgaccctctttatccagtcggatgaggactaccgctgctggatgaccgatgctatccagatgttcaccgctctgcggatgcacggtgttccaaccagaatgtgcctgttccatggagaaaaccatgagctcagccgcagcggcaagccaaaacaccgcatccgccgcctgcgcgagatcacatcctggttcgaccattatctgaaaggggaaccatcgtgcagataa

SEQ ID NO: 1554 - DNA, 1227 bp, Unknown
  Artificiall/Consensus sequence
atgaagctgcatattgaaatgtttggggaatttaccatctatgtggacggtgaaaagaatttccagtatgagggccgcacccgtaagctgtggaacctgctgcaatatcttttggtcaatcgaaaccgtccggttcctcaggcagagcttttttccatcgcacatctggatggaaaaaaaggaaaaccggaaaattctttgaaaaatctgatctatcgactgagaggccttttggaagaaagcgatcttccgaaagaagactatatcctctgccgccgtggggcatatcagtggaatccggaaatttcggtgacactggatattgaggtttttgaacaggaatatcgggaggccatggctgctgctggaaatatggaaaacagccttgtgcactatatggcagctttggaacagtatcatggcgtttttctgccaaaatctcaggacgaggaatgggtaagggaatattctgcccactatcagaagctgttttttaactgcatgacggaagcgtacaacatcttcagccagaaaaaggatctgggctttatggagcagctgtgccgtcgctccatcgagatgcagccgcagagcgaggaactgtatcagctgtacattcaggtgctgatgcagcagaatcagcacaagcaggcgctggaagtctatgcttcttatgaaactatgctttataaagagtccggacagaagccgtccgaatcgctccagacactctatcgggagatcatcaaggagctcaacaacatgcatgccgatatcagcacggtcaaaaatgacctgcgcgaggcaaatgcaggaaacggcgcttactactgcccgtacgatatctttaaaaatatgtaccgtttgcttgccagaagcgtttcccgaaccggtcagtcggtttatctgctgctgtttaccgtttcggataccagaggcgaactgccgacaatcaaaaggctcaacgcttcgatgcgttcgcttcagctggcaatcggaaagtctctgcgaaaaggggatgtttattcccagtacagcggaacccagtatgtggtaatgctccagtcgatcaacgaagaaaacggcaagatggtcgttggaagaatcctcaaaaactacgaacagctttatcaggaaccaaaagttgtggtaaactttatgctggagccgcttgacccggtagaaaagatccctgagggaattctcctgggaggtagcggatgctga

SEQ ID NO: 1555 - DNA, 1443 bp, Unknown
  Artificiall/Consensus sequence
atgatgcgatttttacaaagattaggtaaatctttgatgctgccggtagcatgtctgccaatcggtggtatcctgatgggtatcggttactggatcgacccagctggctggggtgctaacagcatgctggctctgcttctgatcaaagctggcggtattctgatcgataacatggcaattctgttcgctctgggtgttgcaatcggtatgtccaaagaccaggaaggtacttctgctctggcagctatcatctcctggctgactgtacagaccatgttgggaaccgctgttgttcagctcatcatcggtgctgatgcaaccgttaaccctgcatttggcaaaatcaacaaccagtttatcggtatcctctgcggtctgatcgctgcatggtgctacaacaagttccacaagatcaacatgccggacttccttggcttctttgcaggccgtcgttttgttccgatcatgaccgttgttgttactctgctcatctgcatcccgctgtacttcgtatggccggttgtttacaccttcctggtaagcgttggtgaaggcatcctcggtatgggcgcaatcggcgctggtatctacggcttcctcaaccgtctgctcattccagttggtctgcatcacgctctcaacagcgtattctggtttgacgttgcaaatatctctgatattggtaagttctggggttctgttgaaggcggcgttctcggtcagaccggtatgtatcaggctggtttcttcccagttatgatgtttggtctgcctggtgctgctctggcaatgtaccacactgctaaaccagaaaagaaaaagattgccggcggtattctgctgtccgctgcactctgttccttcttcaccggtgttaccgagcctctggaattcgcattcatgttcctggctccagctctgtatgtagctcatgcagttctgaccggtatctccgttgcaatcgtagctgctctgccaattcgtgctggcttccagttcagtgctggttttgttgactggttcctgtccttcaaggctccattcgcaatgaacccaatcctgctgattccaatcggtctggtattctttgtaatctactatgttgtattccgcatcatgatcgttaaactcaacctgaagactccaggtcgtgaagatgacgatactgctgctgaaatgaatattgaactgagcgcaaacgactacgcagcaatggcaaaagctattctggaaggtgttggcggcgctgctaacgttacaagcgttgacaactgcatcacccgtctgcgtctggaagttaaagaccgtctgctggtagacgaaaagaaactgaaagcatccggtgctgctggtatcgttcgtccaggtaagaccagtgtacaggttattatcggtccaaaagttcagtttgtagctgacgagttcaagaaactggttaaataa

SEQ ID NO: 1556 - DNA, 819 bp, Unknown
  Artificiall/Consensus sequence
atgttggaaaataatattgaggaggaaaagtttatggaatctaaattgaaaatcttaatttctgacgatgataaagaattttgtgcgagatgtacggcaactcttcgttcttccggctttgaaacaaccattgcaccaagagatggacagctgatgcttcagatgattcgtgactatcaacccgatctggtattgatggatgtgtttatgccatattatgatgcaatcggcgtgatcaatcaggtgaaagaatcgggaatgcgcatgccgatttttatggtaattttaaattataacaatgtgatgctggaacgggaactggtaaactcgggcgttgcttattgtttcttaaagccgatcgatccacagttggtagcagagagaatctttcagctgaccggaagaaatggagcagagaaagccgaaacaccaatgataccagcaaaccgtccaaatctggaagtgatggttaccgagatcatccatcagatcggtgtgcctgcccatattaaaggatatcattacttacgggatggcattgttctggcagttaaagatcacaacatgattaactccgtaaccaagcttttgtatccgaccattgcaaaaatgaacaataccacttccagtcgcgtggagcgagcaatccgtcatgctattgaagttgcatgggatcgcggcgatgtagatgtgctcaactcctattttggttataccatccgcaacagccgtggaaaaccgaccaactctgaatttatcgcaatgattgcggacaacttgaagctccagctgaaaaacgatcagaaatttgggaaataa

SEQ ID NO: 1557 - DNA, 1368 bp, Unknown
  Artificiall/Consensus sequence
atgaaaaacgaaagggataaagaggagctcagccgctattttggccatcatcagccctcccagaaaacaccgcgcacttcgcgttcccagcagcagtggtttgatgacgggatggatgatgacgacgaagatatgaaggttgctcccgattctttcagtaaaagcaattttaacaggaacagttctggaaagaacagctttaaccaggacagccagtttggtgattttgaggaaccgccgaaaaaacgtaaaagagcatccaagctcagccgttttgccgaaagctttgtgctgatctgtatttttgtcggcatcgcaatcttccttgcttattttgcactggtgagcgcaagcgacctgctgggcttgggtcaggcagaccgtcagatcgaggtgaccctgaccgaggaggaagcggcatctgtgagcaaaactgcaaaggttctggaagaaaacggcgttatctcccagcgttttgtgtttgagatgtacgcaaaactcaagggcaaggacggaaccttcctggcaaagacctttgttctcaacaataaatggggatatgaccagatcatgtcccatctgtccgacgacagcgaggaatcggatatcgtcagcatcaccttccgtgaaggtatgacccagagacagatcggcgaactgctggaagaaaacaaggtctgcaccgctgacgaattctataccgcactggaagaggaagattttgacagctacaactttgctggtctggttccggacgacgagctgcgtttccgcaagtatgaaggttatctcttcccggatacctacgagttctacaccaacatgaatccaaaagaagtggtcaagaagttctttgacaactttgaccgcaaggtggacaccgaagtgatgcaggaaatccgcaacctgtccaatggtctgggtgagctggacaacctgattaccttggcttccatcattcagaaggaagcaaccgacctggaaaacatgaagatggtttcgtcggtattccataaccgtctcaacaacagctcgacctatccttacctgcagtcggatgcgactaccaactatatccgcgacgatatccgctcctttatgacgcaggataatcaggaaatgtacgatgcttacgacaccacaaaggttgtcggtctgccggtcggcccaatctgcaaccctggtatggatgcgatcgaagcggcaatccatccggcagataccaactactactactttgtatcggatgatgcgggaacctattactttgcagcgacccttgaagaacacgaggcaaacatccgcaaggcaaatcaggtgaacgaacagctgaaatccgaagcagcagtggaagaaaccggagaataa

SEQ ID NO: 1558 - DNA, 1950 bp, Unknown
  Artificiall/Consensus sequence
gtgtcggaaaatagtggaaaattagccaaggttttctgtatgggaaaacctctggaaaggaatgatagaatggaatacaaaatgggggactacgaggttgcggtaatcggtgccggacatgccggaatcgaagcggctcttgcagcggcaaggctgggtgcaaaaacagcgatctttaccatgtctctcgatgcaattggaaatatgccatgcaacccatccatcggcggtacagcgaagggacatcttgtccgcgaaattgatgcactgggcggcgagatgggaaaagcggcagatgcgacctttttgcagagcagaatgctcaatcggggaaaaggtccggcggttcacagcctgagggttcaatcagaccgcgatgagtatcacaaggagatgaagcaccgacttgagcttcaggatggtctggacatcattcaggcagaaatctgcgacatccgcacagatgaaaatggtgcgataaaagagctggttaccaagcttggtgcggtatatgaggtaaaaacagccatcatctgttcgggaaccttcctgcatggaagaatctatgtcggggatgtttcctatgaaagtggtccggatggtctgcatgcagcgatcgggctaagcgaagccttggaacggctgggaatccatctcagacgttttaaaacaggaacaccggcacgagtaagacgggacagtatcgattacagcaagctggaagtacaggcaggcgacgaaccaatcattccattttcctttgaaacaccaagggaaggattaaaaaatcaggtggtctgccacattgcttacaccaatgaaaaaacgcatcagatcattcgggacaacattcaccgttctccattatacggcggtatgatcgaaggtgtaggtccgcgctactgtccaagtattgaggacaaggtgatgcgtttttcggaaaaaccgagacatcagtcctttgtggaaccggtaggactgcacaccgaagagatgtatttgcagggattgtcgtcctctctgccggaagatgtacaggttcagatctatcgttcgattgttggatttgaaaatgtaaagatcatgcgaaacgcttatgcaatcgaatatgattgtatcgatccgctggatctgaaagcttctttggaatttttaaaggtagaaggtttgtatggtgccggacagtttaacggaacatccggatacgaagaagcagcggcacagggattgattgccggaatcaatgcggcaagaaaggtacagggaaaagaaccactgattctggatcgtgcatccagttatatcggaaccctgattgatgacctggttaccaagggctgttctgatccttaccgcatgatgaccagccgttcggaatatcgtttgctgctgcgtcaggataatgcagatcagagattgactccgatcgggcatgagattggtttaatcagtgaagaacgctggcagcattacctgcacaaacaggaactgattgagcaggaaagaaagagaatcgaaaagcttacctttggtccgtccaaagagctcaacgagatgctcgaaagcagaggaaccgctccaatggaaacaggtgcgcatgcatctgatctgattcgacgtccacaggtaagctacaaggatctggaaccgtttgatacagaacgtccgcagctgccggatgaagtgaccgagcaggtggaaattcagatcaagtatgagggttatatccagaaacagctgattcaggtagagcagatgcgcagactggaaaccagaaaaataccggaagatatcaactatgaagaggtaaggggactgcgtctggaagcaatcgaaaagctccagcgaatccgtccgcacagcatcgggcaggcatcccgtatttccggtgtcagcccggctgatatttcggttctgctgatctatatggaaagctgtaaggaaaagtaa

SEQ ID NO: 1559 - DNA, 1980 bp, Unknown
  Artificiall/Consensus sequence
atggatttgataactgccagagagcttgcacaaaagctgagggaacagatcaactattacagtgaactttactatgaaaaagatgatccggcaatcagtgactatgagtttgacaagctgatgcatcagctgattaatattgaggaagaatatcccgaactgctgaccccggattctccgactcaccgtgttggcggcagagcgtccaacagctttgagcaggtggagcatgttgttcagatgggctctttgcaggacgtcttttctgatgaggaggttgtggactttgaccgccgcgtccgggaggttgtttctgacccgatttatgtggttgagccaaagattgatggactttcggtgtcgctggaatatcgggacggtgtgctggttcgtggttccacccgcggtgacggttttgtcggcgaagatgttaccgaaaatatccgcaccatccgctcggtgccgctcagactcaagcgcaatatcccgtttgtcgaggtgcgtggtgaggtatatatgccggtagcaagctttgaaaaggtggtcgctcagcaggaactcaaggaagaaaaaccgtttaaaaatccaagaaatgcagcagcaggctcgcttcgccagaaaaatcccaaaattaccgcacaaagaggactcgatatctttgtctttaaccttcagcagattgaaggtgtgcaggtaagcggtcacaaggaatcgctggatctgttaaaggaactgggattccaggtttctccttcctaccttgcggtggacaccattgaaaaggcgatcgaggagattcgtgccatcggtcagcgccgcggggagtacagctttgatattgatggagcagtcgttaaggtggatagccttgcgcagagggaaatgctgggagctactgcaaaatttccgaagtgggcagtggcatttaaatatccgccggaagaaaagatcacaacactcttggatgttgaagttaaggtcggaagaaccggagcactgactccaaccgctgtctttgaaccgattcagctggcaggaaccactgtcagccgcgcagtgctgcacaatcaggactttatcgatgaaaaacagattgcagtcggcgataaaatcatcgtccgcaaagcaggggatatcattccggaagtggttgctgttgcagaacactgcggcaatccaacctaccagctgccagagtactgtccatcctgtcatacaaaggtagtaagggaagaaggcgaagctgcaatctattgtccgaatatcgagtgtccggcacagctgatgagaaacctgattcactttgcctcccgaaatgcaatggatatcgacggaatgggacctgcggttctggaaggactggtcaatgccggctgggttcattctccagcagacctgtacgaccttaccgaagaacagattgcatccttggagcgtatgggcaaaaagagtgcatccaatctgatgaacgcactggaaaaatccaaacagaatgacctttccaaggttattttcgcactgggtgttccggaagtcggtgaaaagaccgcagccgagcttgcatcggcgtttgacagtatggaaaagctctcttgggcaactttggagcagctcactgcactggatggattcggggaagtggtcgcacagaacattgtcagcttctttttggaagaaagaaaccgggtgcagattgaacgccttgcaaaagccggcgtcaacatggaaagcacaaaggtaaaagcaggcgataccttcgaagggaaaacctttgttctgaccggaactttgcctaccttaaagcgcaatgaggcaaaggaactgatcgaatcgctgggcggaaaggtatcctcttcggtttccaaaaagactgattatgtagtagcgggcgaggaggcaggctccaagcttaccaaagcaaatgagcttggaattaccattctgaccgaagaacagctgctgcagatgtgccagaaatag

SEQ ID NO: 1560 - DNA, 1917 bp, Unknown
  Artificiall/Consensus sequence
atgaggatcatcgacctgattacaaaagatcgtattctgttgggcgcatcggcagcagataaacaggatgcaatcgagaaaatggtagagcttcaggcaaaaagcggaaacctgagcgacaaagaagtttataagcaggcaattctggcaagagaagcgatgagcagcacagcaatcgaagctggtattgctgttccacatgcaaaatctgaaacagtaacagcaccttccctttgtgctatgaccctcaaagaaggtgttgattatggtgcaatggacggtcagccatctgacctgttctttatgattgcagctccattaaatggtgacctccatctggagattctgtcccatctgatggtactgctgatggacccacagttcctggcagcactgcgtggtgcaaaagatgaagcagaatttatctcggtaatcgatcgttttgaaactgaaaaatatggagctgcacaggaaacaaaaccacagaagagtggttatcaggttcttgcagttacagcttgcccaaccggtatcgcacatacctacatggcagcagaagccctggaaaaagctggcaaggaaatgggaatcagcatcaaagttgagaccaacggcagcggcggcgtgaaaaacaaactgactgatgaagaaattcagaatgcagacggtatcatcgttgcagcagataaaaatgtagagacagcacgttttgcaggtaagaaagttctgtttgtaccagtttccgatggtattcacaaagcagaacagttgatcgaacagatcgaaagaggaaacgctcctgtttatgagcacaaaggctccgcagaagatgttgttgtatcgaaaaatgaaaaagaaagcatcggcagacagttctacaaacacctgatgaacggtgtcagccacatgctcccattcgttatcggcggcggtatcctgattgcaatcgcattcctgctggatgattactccatcgatcctgcaaactttggtatgaatactccactggcttccttcttcaagacagtcggtggtgttgcgtttgacttcatgcttcctgttctggcaggttatatcgcatacagcattgcagaccgtccaggtctggcagttggttttgttggcggttaccttgcaaaagttggtaactcgtttgcaaacattaccggagatggcgctgtttcgggcggatttttggcagcattgctcgctggtttcgttgcaggttatctggtactgctgctgcagaagattgcaagcaagcttccagacagtatggacggcatcaaaccagttctgatctacccactgttcggcgtattctttattggtgtattcatgtatgcagtaaacccggcaatggctgcaatcaataccggaattatcaacctgcttaactcgatgggtggcagcagtaagattctgcttggtgcaatcgtagcaggtatgatgagtattgatatgggtggtccattcaataaagcagcgtatgtatttggtactgcttccatcgcaagtggtaactatgatgttatggcggctgttatgatcggcggtatgattcctcctctggcaatcgctctggcaactaccttcttcaaaaagaaatttactgcggatgaacgcaagtccggtgtcgtaaactatattatgggtctgtgcttcatcacagaaggcgcaattccatttgcagcatctgacccgctgcgtgttatcccatcctgcgttatcggctctgcagtagcaggcggactcagcatgatgtttggctgtactctgcgtgcaccacacggtggtatctttgtattcccggttgtaggaaacgttgtaggttatttgatcgctctggcagcaggtgctgtagttggtatgctgatgctgggcatcctcaagaaaaataaaacagaaacaaaatag

SEQ ID NO: 1561 - DNA, 1458 bp, Unknown
  Artificiall/Consensus sequence
atgaaccatctcgatcagagccgcgcaccgatctacgaggctctcgaaaattttcgaaaaatgagggttgttcccttcgatgttcccggtcataagcggggacgcggaaaccctgaacttgtcgcgctgctcggcgaaaaatgcgtcggcatggacgtaaactccatgaagccactggataatctctgtcatccgatttcggttatccgggaagccgaagaactgaccgctgaagccttcggcgctgctcacgcttttctgatggttggaggaaccacctccgcagtgcaggctatgatcctctcagtagcaaaacgcggcgataagatcattcttccccgcaacgtacaccgcagtgtaatgggagcaatggtgctgtgcggtgccgttccagtttatgtaaatccggaatgtgactcccgacttggaatcccccttggcatgaaggtttccgaagtggaaaaagccatcaaagcaaaccctgatgcgaaggcgattctggtcaataacccaacctattacggtatctgttccgacctgcgctccatcgtaaagcttgctcaccagcatggaatgctctgccttgccgatgaggcacacggcactcacctttactttggtgaaaatcttccgatctccgccatggcagcgggtgcagatatggcagcggtttcgatgcataaatccggcggcagcctgacccaaagctcggttctgctcaccggtcctgccatgaacgagggttatgtccgccagatcatcaacctcacccagaccaccagcggctcctatctgctgctctccagtttggatatctcccgccgcaaccttgctttgcgcggcaaggaggcttttgccggtgtagtggaaatggcagaatatgcccgccgcgaaatcaataatatcggcggatactatgcttattctcgagaactcattaacggcgacagcatctatgattttgacgtcacaaagctcgcggtcaatacacttgatatcggccttgccggcatcgaggtctatgacctgcttcgtgacgagtacgacatccagattgaatttggagatctgggaaatctgctggcttatctgtccatcggcgaccgccagcgcgacatcgagcgtctggtcggcgcactgtccgaggttcgccgccgctttggcaaaaaggataaagcaaacctgatgaaacaggaatacatcgaccctcaggttgcggtttccccacaggatgcattttatgcagacaaagaatccctaccgctgcgggaaacagaaggcagagtgtgcagcgaatttgttatgtgctatccgccgggaattccgattttggctccgggcgaacgcatcaccggaccaatccttgactatatcgaatacgcaaaagaaaagggctgctcaatgaccggaccggaagatcccgatattctgcgcctgaatgttctgaaaggagtttaa

SEQ ID NO: 1562 - DNA, 936 bp, Unknown
  Artificiall/Consensus sequence
ttgaaagaaatcattacaacaggaaaaacagttgaactggcaatcgaagaagcatgtcagcagatgaatgtttcccgagaaaaggtagaattcgaaattattgatctgccgaaaaaagcactgttcggactgaaaacctatccggcaaaggttcgggtatttgtaaaagaagaggataaagaggcaattgctgttgagtatgtaacctctatcctcaaggcaatgggtgtgcaggacttcaccgcagaggcaaacaaggatggcgacaacctcaacattaccctcaaaggcgatgatttgggctttgttattggacgccgcggcgaaactatcgatgcaatccagtatcttgcaagccttgcaatcaatcgaatcgatggtgactatatgcgtattaccatcgacagcggcaacttccgtgaaaaacgcgaaaaaactctggaatctctggcaaaaagactggcacgcaacgtggttaaaaccggccgcagcgtaacacttgagccaatgaatccatatgaaagaagaatcatccatgcaacagtttctactgttgaaggtgcaacctcttcttctatcggcgaagagccaaaccgccgtgttgtgatcagctctaccaatccggtaaagaaatacaacaactataaaggcaagaagaaaccatataacaaaggcggttatcgtccaaatggccgcagaccacagggcgaaggacgcggcaatgcagaaggtcaggaaaagaaaccttatgttttccgcaataaggaagatggcgaaaatcgcagacgtgctccaagacagaataacgagtttagagagcgcaagttcgaggaaagaaacgaatcaaacgcagctccaagaaccgatgttccacgcagcacaccaccgcgtgaagcagaggacaaaccgttatatgcaaagattgatctggaataa

SEQ ID NO: 1563 - DNA, 1422 bp, Unknown
  Artificiall/Consensus sequence
atggaacccatgaagaaagtaacatttaccaaagagatgaagcagacacatacaatcctgattccaaccatgctgccgattcactttaaaattttgggaaatgttctggaaaattatggatacaaaattaaagttctggataattttggacagggagtcatcgatcagggactaaaaaatgtccacaatgatacctgttatccagcacagctggttattggacagatgattgatgctctggaacactgtgaccttccgctggacaaggtggctctgctgattacccagactggtggtggatgccgtgcatccaactatatccaccttctgcgcaaggcattgaacaaatgtggttacggtgaaattccggttatctcagcaagctttttgaaaagtgaacagtcgggaggattctctcttccagttaccatgcttctgcaagcagtctatggcgtcctgtgtggtgatttgattatgacactgtataatcagtgcataccatatgaaaacgtctctggagagagccagaaggctgtagatgacagtgtagagatggctgagcagcttttctgcaagaaattgcttcgatggaaagaagtttctgcgctgatggtaaagattatcaagagattcaatcaggtaaatcgcagaaaagaggagaagatcaaagtcggcattgtcggcgagatttatgtaaaatattctccgctgggaaacaacaatctggaggaatttcttctctcggaaggatgcgaagttgtttgcccgggactgtttgactttttgctttactgcacacataacgttgagtttgaccatgatttgtatggtattaacgcagtcaaagcggcagtgatgcgcaaggtaaaccatttcctgcgcggcagaaagagcgacatgattcatctgattgagcaaaacagcgatttccagccgccatgtcattttgaaagcacaatcgaatccaccaaaggatatattggaaaaggcgttaaaatgggcgagggatggctgctgaccgcagagatggttgagctgattcagcattatcacgtcaacaatattgtctgcactcagccattcggatgtctgccaaaccatatctgtggaaagggcgttatgcgcgtcatcaaggagaagaatccgcaggccaatattgtagcggtagactatgactccagtgcttccaaggtaaaccagcagaatcgaatcaaactgatgctggcaaatgcaagactgatggcgtcccagcagaatatggcttcgggcaatacctcgaatcgccagcaagacagcaccttaaaacaggtacaggatgtcaatgaagattctcattcgcagcttcatgcaggttttgcagcgagcacagttggaaataagagcagcgaggaacaattggaactggctgcacagaacggttaa

SEQ ID NO: 1564 - DNA, 966 bp, Unknown
  Artificiall/Consensus sequence
gtggtgccaagtgtgcgggcatgggagtttagggaggaagatgttatgcttacgcaagagtgtcttcaggacgctgttaaatacggagaatgtttcattaagttcggcaaaactgccgaatacatccccgaacttgctcgggtcaacaagtatcaccttggtgcctgcattgtcggcttggacggtactgtgatggaatacggcgacacccgcaccccatttaccatccagagtatctcgaaacttgcttcgctgatccttgccatcagcgaccgcggcgcggactatctgttccatgacaaggtgggagtcgaaccaaccggtgacccgttcaactcgatcatcaagctggaaaccaagaccaaaccgtttaatccgttcatcaatgccggcgcaatcactgttgccagctgcatcgacggcaaggattcggacgaaaaatttgagcgattcttgcagtttatccgcaaagtctgcggcaacgaagaaatcgccctcaatgaagcggtctatctctcggaaaaatccactggtgaccgcaaccgcgctcttgcctattacctcaaagcctccggtattctggaaggcaacgtcgaggaatgtctggacttttacttcaagatgtgctcggtcaatgtcactgcggtggacattgcccagatgagtgcagtgcttgcaaatcacggtgcctgcccatccaccggcgaggtgctcatcgagccggaaagtgcaaaagcaattcgtgcgctgatgctcacctgcggcatgtatgatggctccggtgaatttgccatgactgtcggcttccctgcaaagagcggtgtcggcggcggtatcgcagctgcactggttgaccgcatgggaattggtgtatttggacctgctctggatgaaaaaggcaacagcatcggcggcatcaagattctggaatatctttccaagaagatggattttaatttgttctaa

SEQ ID NO: 1565 - DNA, 1332 bp, Unknown
  Artificiall/Consensus sequence
atgagcaacgacaaaaaaattaaaatcggtgaagtcggcatctacgatgctcgccagctcggaattccccgtatgctgatattgggcatccagcacacttttgcgatgttcggtgctaccgttctggttccaattctgactggtcttgatgtctctaccactctgctgatggctggtctgggtacccttttgttccatctgatcaccaaaggaaaggttcctgcatttctgggttcttctttcgcttttctgggtggatattccgcagtagctcctcgtcttgctgacggtgctgccaatacagagatgctcccgtatgcctgcggcggtgttctggttgccggatttgtttatgtggtgatgtccgctttgatttctgtctttggcatccgtcgtatcatgcgcttcttcccgccagttgtaaccggtccaatcattatctcgatcggtctgattctggctccttccgctatcacaaatgcaagtgaaaactggctgcttgcctttattgcgctggctgtcatcgtcatctgcaacatctggggcaagggcatgatcaaaattgttccaattctgattggtattgtagtgtcctatatcgttgccatctttatgggcgaggtaaactttgaagcaatctcctcctctcaggtttttgctatggcacctttgagcctgccaaaattcagcttcagtgctgttgtcaccatcatgccaattgctctggctaccatgatggaacatatcggtgatatggctgctatcagcgcaaccaccggcaaaaactacctcaacgacccaggtctgcatcgcaccctgctcggtgacggtcttgctaccagcctttctgcactgggaggcggtcctgcaaacaccacctacggtgaaaacaccggtgttctcgctctgaccaaggtatatgatcctcgcgttatgagaatcgctgcactggttgcaatcatcctttccttcttcccaaaatttggcgctgcaatcgaaaccgttccatcggctatcatcggcggcgtttccttcatgctgtatggtatgatttctgcaatcggtatccgcaatgttgtagagaacaaggttgactttacgcagagccgaaacctcatcattgctgctgtcattttggtaagcgcactgggctttaactcgatcggcggcatcaccttccagattggttccttcacaatcaatctttctggtcttgcaatcgctgcaatcgctggcatcgtattaaatgccattatcccgggaaatgattatcagtttggcggagaacacactccagaccacgaagtaaccgtttacgaagaacacaaataa

SEQ ID NO: 1566 - DNA, 939 bp, Unknown
  Artificiall/Consensus sequence
atggaagataaagcaatcaagataaatacaagcaatgttcttccagatgacgcatttgaagacgttgtaaaagaaaaacagccagcaggtacaagttatgaccgaggactatggtatgatatctgccgtagctttaaagaaaacaaggttgcactggtttgtctgattatcctgattattattgcaatcgcttctttgctggcacctttgtccccttatgatccggatgcaatcgatgcaacccagaagcttttgcctccatccaaagaacattggtttggcaccgacgattttggcagggattattttacaagagctctctacggaggacgtgtttcgctgactgtgggtctggcatccatgatctgtaccacgattattggtactctgattggaacattcagtggatataagggtggaaaactcgatatggttttgatgcgatttaccgacattttccttgcactgccaagctttttgctgatggttgtgctcaacaccctgttttctccaggtatggtaacgctgattgcggttttaagcttgttcagctgggcatccgttgcccgtattacccgtgcagaaacaatgtctttaaaacagaaagactttgtgcttgcggcaaaaagcatgggagcaagccataccgagattatttttaaacacattatcccaaatatgagtgcatccattattgtagcgggaagccttggtgttgcgggcgcaattttgacggagtcatccttaagctttttgggattaggtgttcagctgccgcagtcttcctggggaagtatgcttcagcttgcacagaaatatattctggatcgtccgagcatggcagtttttcctggtcttttgattttatttacggtacttagttttaatattatcggcgacgtcctgcgcaatgcgctggagccgaaaatgattaagtaa

SEQ ID NO: 1567 - DNA, 1887 bp, Unknown
  Artificiall/Consensus sequence
atgaaaaatattattattggaactgccggtcacgttgaccacggcaaaaccgccctcatcaaagctctgaccggaatcgaaaccgaccgcatcaaggaagaaaagaagcgcggtatcaccatcgagctgggctttgcttatctggatcttcctgatggagaaaaagccggtatcatcgacgtgccgggacacgaaaaatttgttaaaaacatgctggcaggtgctggcggcatcgaccttgccctgctggttatcgcagcagatgaaggcttcatgccgcagaccagagaacatctgggcatcctgtcgctgttaaacattccggaaggtatcatcgtcatcaccaaaaaggatatggtggatgaggattggttggaggttgtctgcgacgacatccgcaacgaagtaaagggaaccttcctggaaaacgcacagatgattcctgtttcctcttacaccggcgaaggtattgaggaattaaaacaggctatcttccagttgatcgaccagaaaacccagatcaaaaatctggatgttccgttccgtattccgatcgaccgtattttctcggtagaaggcttcggaaccgtcatcaccggtaccctgatcgaaggtaagatgaaggtcggcgatccggtcaccatctacccttcccgcatcgagagccgaatccgtaaccttcaggtacactcccacgatgtagaggaagcatatgccggtcagcgtgttgcggtaaaccttgcaggtctgaaaaagagcgacttaaacaaaggcgatgttgtcgctgttccagattcaatgcacaccaccatgatgatcgatataaagcttaccatcttgaaggactgtgagcgtgagatcctgaacgctacccgcctgcatctgtatcatggtgcaagggacgttctgtgcaaggttgtacttcttgaccgcgacagcatcagcgctggagaaagctgctatgctcagcttcgactggaagaagagatcgccgtcaagacaggcgaccgctttgtcctccgcttctattccccactggaaaccattggcggcggtgtcatcctcgactccaatccattcaaacataaacgtaacgatccgcaggtgctggaatctttaaacatcaaggaaaatggttcggacaaggaaaagatcagcgccgctttgaaggactactcctcccgttttgaaacactcagcttccttcaggtacagactgcaattccaaaagagcagtttgaccagcagattcagaagctcatcaaggacaaaactgctttccgcatcaatgacaatgttgtcatccacagcgactatctgtcccacttaaaggatactgctgtcaagatgctgactgcttaccacgaagaaaatccactgcgtgacggtatgaagcgcgacgaattccgcagcaagttcctcaaatacgaggacatggcggttgtggacaaaattaccgactctctggtaaaccgcaaggtcctcaagattgtaaacggctgtgttgccctgtatgactttgaagcacagaccgacaacaatcaggagctgattgaaaaagccttccaggaaggcggatttgctccggaatccccagatcagattgcagcacgcttcccgaagatcaagaacttcaaagcagtgttggattctctggtcagctccggaaagctgattcgtgttgaggacaaaattttgctgcacatcgactactacaacaaagcacttgagatggcaaaggaatacatcgaaaagaacggtcagatcacactggctgagatgcgcgacctgatgggaacttcccgtaagtttgccgttgctgtactcgaatactgggatcgccgcaatatcaccaagaaggtcggcgacgccagagtattgaaataa

SEQ ID NO: 1568 - DNA, 1146 bp, Unknown
  Artificiall/Consensus sequence
atgaagagaaaaatcctgcccgggattatactggcattggcattaggttcggttggtgtttgggcactggtaacaaacacaggaagctttccaaagtttaaccgctattatcatctggacgactatctggatgatcttgaggcagctttgtcccgaagcattcctttttctgacaacctgtcctcgttggccattgatctgaagatgaagggcggagccagagaatttgacaacatttttatcggggatgatatcctggtggaagatatcggttatccggatgaggcgaaaaccgagcaaaatattcaggcactcactcggttttcggagaacagccgtatcccaacctacgtcatgttgattccgaccaaatgcgcgatcaagcaaaacgaggttccacaggcagctccgctttttaaccagaagcaatttatcgagcaaagttataatcgcctgctgggaaaagcaacagtagtggacgtttaccccactttgttttccaaactggatcaggatttgtattataaaacagctcctgatctgaccgcactgggcggatattatgtctatgaggtgcttgcccaaagactggacaacaccccaaaaccgcaggaagattttgatattcagtatattacccacagctattacggaaaaacctaccagaaatcggcatataaggatatctctccggatattatcgctttgtatcggtatcagaaaaataaccgtaactatattgtcacccataatgaagagtatcagtatacctacaataccctctatccggagcagatgatggaagtgggggaggatgacctgagcgtacttttgggtggagatactggagacatcaccatccgcagcaatctgaaaaatgaaaacacgctgctgattgtgggagatgacagcatccttccggtgattccatttctggcagcacattattctcagattcgttttattgatctggagcagatgagtgcggaagaaatcgaaaaaatcgattgttccgattaccaaagaatgctgatttcctattctgtggatacctttatccatcaggatgttgtacagaaggttgtttatttaaatacccaagatcaggaagagatgaagaccatacagcaggcagtgcagccatag

SEQ ID NO: 1569 - DNA, 816 bp, Unknown
  Artificiall/Consensus sequence
atggaggaatttacgatgaagaaaattggatttattggatgcggcaatatggcaggagcaattattggcggaattatctcttctggtctgctgaaaaaagaagaaatcatgggtgcagaaatttttgaggctgcaagaaaaaatgttgcacagaaatttgagattgaagtaaccgatgataacaaaaaactggcaaccgaaagtgaaattattgttctgtcggtaaaaccacagttttatgtagaagttattgaagaaatccgcccaatcatctcgaaagatacgatcgttctgactattgctcctggattttctctggataagctggcaggactgtttgcaaaaggtcagaaaatcatccgtgcaatgccaaatactccagcactgattggagaaggtatgactgctgtctgcccaaacaagaacattacagcagatgagctggaatggatcaaaaaactgctggcaagctgcggacgtgtagaagtcgtaaaggaatacatgatggatgcggttgtttctgcttcgggcagcgcaccagcttatgtttacatcatgattgaagctatggcagatgctgctgttatggacggtatgccaagagcaaaagcatatcagtttgcagcacaggctgttgtgggtgctgcaaagatggttctggaaacaggaaaacatccagcagagttaaaagatgcagtttgttctccagcaggaactaccattgaagcagtgcgtgtactggaagaaaaaggtttccgcagtgcaatcatcgaggcaatgagagcttgcgcagacaaatcccaccgcatggcataa

SEQ ID NO: 1570 - DNA, 1416 bp, Unknown
  Artificiall/Consensus sequence
ttgaataaatatcggaatcttatatccaatacttttatctttgcaatcggcactttcagttcaaaggtgctggtctttttattgatgccgctttacaccaaagtgctttccgaagcccagtacggaacggtcgacctgatggtgcaggtcggcaactttctgcttccattggtttcatgcggtattgtaaacggaatcatccgctttggactggacaagtattataagaaacgtgatgtattcacgaccggtttcctgaccattctgtttggctttataatcctgctgattctggaaccgatcctggttcatattccatatctcaacgaaaacaccatgatgatctatgttttcgtgctgatgtcctcaatgcgctccctctgttcccagtttgtccgcgctaaaggctatgttaaactgtatgcaattgatggtctgctttccaccgcgacaaccatcttttttaacgtgctgtatctggttgttctgaaatggggaatcaacggatacatgcttgccatgatctcggctgacaccctgtccaccctgtttttgttctatgtcgccggtctgcgccggtatttgcatatccggggactgaatctgtccaccagccaggaaatgctgcgttattccatcccgatgattccaaactccatcttctggtgggtcaacaatatggcaagccgctatatgatcgcctactttatgggagaagaatacaacggtctgtttgcagttgcatataaaatcccaaccatcatcgtactgatgtccaacatctttatggatgcctggcagatgtctgcggtcagcgattcaccggacaaacgcgcttccttctttacccgcgttttcctgttctatcaatctctgatctgcaccgccgcttccggattgattctgttctccaaggtaatcaccatgattctggtttcggattccttctatgagtcctggaaatacattccgcttctgctcctctccactatcttttcctgcacgtccaccttcctaggcagcgtctacatggtggaaaagaagagcatgctaaactttattacaaccggtatcggtgccgttatcaatgtcgttttaaacttcctctttatcccgatattcggtgtaaacggtgcagccttcgcaactttcctgagctactttgtcgtttttgtcctgcgcgtcattgataccagacgatttatcccgatgcacttccatccaatgcgcctgaccttcaacacacttgtcctgttggcacaggccttcattatgatctttgaagtaaaagggtggatcttcttcgagctgatcctcaccgtattgatggtagttgcaaacatgagcgcacttttggctacagtggcccagcttctgctcaaacgccgccctcatccacaacatcatgaagagtaa

SEQ ID NO: 1571 - DNA, 1332 bp, Unknown
  Artificiall/Consensus sequence
gtggatcggaacattttttcagattggcaagagaagagtcatgaaattgtatctgtgtcgcatacaagatatagggatataaaaagaaaaagcccgttatcagggctttttcttttttttgaggtatggtataatgacaaaaacagattatttcgcaagaaaaaaggtcgcaaacaaagcggcctgttttttcctgctttccctagattcaaggaggagatcgctatgaaatttgtttgccagaaggatttgctggtagaagctgtttccaatgtttctcgtgctgtttgcgctaagtcccctattccagcactggaaggtattttattaaaggcgcaggaaggtcagctccaattaaccggatatgatctggaacttggaattgttacaacaatcgaagcaaaaacagaacagcagggcgaattggtgctttccgcaaaactgctgctggatattatccgaagaattccgggtgaaaccgtatcgattgtttcggatgaaaaaaatctggcaaccatccggggaggagcttcggagtttaccattccaggcattttagcagacgaatatccagagctgccaaatgtagaagaaaaatcggatctggttatgaaacagggaactttaaaatccatgattgaccagactttatttgccattgcaactaccgattctaaaccggttcataccggttccctgtttgatatcaaggattcctgtgttactttggtatcagtagatggttaccgccttgcactgcgcagagaagcgattgtttcggatttaaataccaaatttattgttccaggaaaaaccttgtccgagatttccaaactgcttcgggaagaggacgaagaggcataccttgtagtttcccagaaacatattgtgttccgtatcagcggatattatgtagtttcccgactgctggaaggagatttcctcgactataatgcagctattccaaagatcagcaaaaccaccgttaaaatcaatacccgcagcctgaccgattcggtagaacgtacttctctgctgatctccgaccgcctgagaagcccaatccgtctggttgtaacagaaaacaaggtacaactgagctgttccactgcaatgggtaaagcacatgatgaggtggattgcgaggtttcgggagaagcagttagcatgggatttaataacaaatatcttctggatgcactcaaggcatctgactgtgatatggtaaaactggagatcaacggtgcgttgtctccaatgagaatgattccgatggaaggggacagtttcctcttcctggtgctgccagtgagggtgaaaaacgatgactaa

SEQ ID NO: 1572 - DNA, 2766 bp, Unknown
  Artificiall/Consensus sequence
atgaacagaaaagaaaatcgaattgctgcacgtcaggcagcagaaaaagcaatgattcgagaagaacaaaaccgtcgtatggaacatgcggcaaaaagcagcatcaaggacgttttgaaagaacatcaggctgcactgtgtggattggatgaacaggcagtgagtgagagccgcaataaatacggcagcaacaaggtgacacatgagaaaaaacagcctttgctgaagcgtctggctggagcatttgtaaatccttttacggttattttgttttgtctggcaatcgtgtccacaataaccgatatggtattcccatatttttccctgtttggcagcgtgccggaagactttgactgcctgaccgtagtgattattctgactatggttatcatttccggaacacttcggtttgtacaggaatccagaagtggaaacgctgccgaaaagttgctggcgatgattactactacctgtaccgttacccgcaaaggccaggaaaaaacagaaattccgatggatgatctggtggttggagacattgtacatctgtccgcaggagatatgattccggccgatgtacgaattctggaagcaaaggatttgtttgtcagccaggcaagccttaccggagagagtgagcctgtcgaaaaggtaccttttgccagtgcagcaaaagagagcgttaccgattacaataacattgcgtttatgggcagcaatgtggtttcgggaagtgcatccgcagttgtagtttgtgtcggagataatacgctgtttggctctatggcatctgcagtagcgggagaagcggtggaaaccagctttaccaagggagtcaacgcagtttcctgggttttgatccgctttatgttggtaatggttccgctggtattctttattaatggcatcacaaaaggggattggctggacgcattcctgtttggtatctccattgcagttggactgactcctgaaatgcttccaatgattgtgacgacctgtcttgcaaagggcgcagtctcgatgagcaagaaacagaccatcgtgaaaaatttaaattccatccagaattttggtgcgatggatattctgtgtacggataaaaccggaacgcttacccaggatagagttgttttggagtatcacctgaatgtaaacggaaaggatgatacccgcgtactgcgccatgcgtacctcaacagctacttccagacaggatacaaaaatctgatggatctggcgattatccacaagaccgaggaagcagaggcggaggaccctaagttaatcgacctgtctgaaaactatgtaaaggtagatgaaatcccatttgattttacccgccgccgtcttagcacagtggtgcaggacaaaaacggtaaaactcagatggtgacaaagggtgcggtagaggagatgctttccatctgctcctttgcagaatgcgatgggggagtacagccgctgaccgatgaggtgcgccgccgtatcctgtgtacagtggatgaactcaacgataagggatttcgtgtccttgctattgcacagaagagcaatccttctccggtaggtgcttttggggtaaaggatgaatgcgagatggtgctgatcggttatcttgctttccttgatccaccaaaggagtccacagcagatgcaatcaaagcactgaaacattacggtgttaccaccaaaattctgaccggtgacaatgataaggtaacacgtaccatctgcaaacaggtaggaatgaaggtgcgcaatatgctgctgggttctgatgtggaaaaaatgagcgatgctcagcttgcacaagcagcagaatccaccgatgtatttgcaaagcttacaccggaccagaaggcacgtgtagtttcggttttgagagaaaatggtcataccgttggatttatgggggatggcatcaatgatgcggcagccatgaaagctgctgatatcggaatctcggtagatactgcggtggatgttgccaaggaatcggctgatattattctgctggaaaaggatctgatggttctggaacagggcattatcgagggacgcaaaacctatgccaatatgattaagtatatcaagatgacagcatcctcaaactttggaaatatgttttcggttttggctgcatccgctctgcttccgtttttgccaatgatgagtgtgcatctgattttcctcaaccttatctacgacctgtcctgtaccgctattccgtgggataatgtggacgaggaatttatcaccaaaccacgcaaatgggatgcatccagtgtcggtagctttatgatctggattggccctaccagttccatctttgattttaccacctatatttttatgtattttgttttctgtccgctgtttgtatccggtggtgtattgtataacgatttggcaaatcactatcagggagctcagcttgctcagatgcagcaggcatatatgggaatgttccaggcaggatggtttgtggagtcgatgtggagccagacacttgttatccatatgatccgcacaccaaaacttccatttattcagagccgcgcttctgcttctctgaccctgctgaccttaagcggcattaccgcactcaccattattccatttacaccatttggggcaatgttgggatttgtggcacttcctgtttcttattttgcatatctgattccatgtatcttgctgtatatggtgcttgcaaccagcctgaaaaaggcgtatgtacgtcactatggagagctgctttaa

SEQ ID NO: 1573 - DNA, 1203 bp, Unknown
  Artificiall/Consensus sequence
atgttaacgtttctattatcccgaggggttccgacacagaagtattccacctatggtgtattcgaatttgaccaggcacgtgcgctgactcaggcagggtgcaaggtcgtgtttttggcgctggacctgcgctcggtgcgcagagtacgcaaatggggattttcctccttcgagcgtgacggtgtacaggtgcgggttttaagcattcctctgggcaacattccaaagaagattttttatccgatcggtgaatggggattaaagatgctgtatcgtcgggctgtccgggaatttggtcgtccggatgtgctgcatgcccattttaccgattatgcataccttgcagcggagctgaaaaaacaggaacacgttccgcttgttgtaaccgagcattcttcgcttgtcaatcaggatactctgccgtctgacattaagcaggcagcaaaaaccgcttttcagcaggcagattgcctgatcgcggtaagtcctgcccttgcgcagaagatggaagaacacagccatcgaaaggttctgtgggtgccggatatggtggacaccgaactgttttcttacagcgatgaacacgagcgtcagaaagcgctgagagaagaagtggaaatggaagaagaaggcggcgagttttctttcctcagctgcggaaaccttcgcaagatcaagagaatggatgtcctgatcaaagcatttgcaaaagcatttcgagattgtccgaaagttacccttaccatctgcggacagggagaggaagaagcctctttacataaactgattaccgatttgaacatggatggacgcatcgagatgctgggacttcgtccaagggaagaaatcgcccatcgcctgcagcagtgtgactgctttgttatggcatcggtatccgaaacatttggtgttgcgtacctggaagcactgtcctgcggaatccctgtcattgcgacccgctgcggcggaccggagtgctttgtgaatgagcataacggaatcatggtagatccggacgatgtagatgcacttgcaaaagcgctgctttcgatgtactgtaataatggttattataatcgtgcggcaattgcacaggagatacgggaaaactattcctctcaggcagttgcagcaactttgatgaagcagtatgaaaaggttgcagaacaaaaagatgaggttttgcaaggagtttttgcttaa

SEQ ID NO: 1574 - DNA, 885 bp, Unknown
  Artificiall/Consensus sequence
ggtgaggaacgctcttaccggggcatagccccgaacaaaattatgggatttaacgcaagtaatgtgcaagcacgttacttgcgttttttgttttatataaaaatttcaagcaggaggattgcggctatgggcgaaaaattaaagctgtacggctttaacaacctgaccaaagcactgagctttaacatctatgatgtctgctacgccaaaaccccgcgggaacagcgggactacatctcctatatcgatgaacagtacaattccgaacgactgactaaaatcctgaccaccctgaccgacatgatcggcgcaaaggttctgaacattgcccgtcaggattatgacccgcagggcgcctcggtcaccatcctgattgccgaggaaacgatggtccctgtcggcgaaacccagcttgcccatctggacaaaagccatgttaccgtccatacctatccggaatatcatccggaaacctgccttgcaaccttccgtgtggacattgacgtcgcaacctgcggcgcaatcacaccgctttccaccctcgattacctcatcagctcgtttgactcggacatcatcaccatggattaccgcgttcggggattcacccgcgatgtcaacggacacaaactgtttttggatcacaacattacctcgattcaggactatatcgcaccggatacactggcacgatatgatgcggtggacatcaacgtttatgaagcaaacctgttccacaccaagatgatgctcaaagaggtggacctgcagaactacctgttcaaaactgacgtttacgaactgccgcctaaaacaaggcttgccatcatgaacaatcttcgcaaagagatgatcgaaattttcagcggccgcaatatctattag

SEQ ID NO: 1575 - DNA, 1869 bp, Unknown
  Artificiall/Consensus sequence
atgaactctgtcattcgactgtgctgctgcatcaaccgcgtcagcagtacaaaccctgctttctgcggtgaatccattcaggatcttctggaagaaaacagctccttccgtgcagacatcaccttgttccctcgtctggcactctgtccaccttcttccggcgctatgctcaaaagcgccgccatttctcacctgtgtgaagaatcactggatcagctgcgcctttcctctgcacaaaatggcggctgtatcatcgtcggcctggtaaaatctttttacggaaaactcaccgatgtgattgctgtcatccaaaacggggaagttctaggatttttaccagcttgtggatttaacagtcccaacaccatcagctccgcagagggatggtatccggcagactctgcgtcctctctgctttcctgggacactttattctgttgtggagacttaaaattctgcatctgcccatgcccggtaaaggatctcccactccatcttccaagacttgctaaaaccggctgccatgctgttttggttccatattatgaacctgctactgcagaatctgcaaaacgggacagcgagcttgtccgctgcctttccgaaacattcggcattgccattgcctttgtctgcggtggtcagggagatacctctcatccaaatgcatttcagggacacgctgccgtttatgaatccggaaatatgctgtctgaccacaccggtcaaagcatcggaaacaacacctatgcactggaaagtttctccttctgccgcgatctggactgcgatattctcaacgcatgccagcgttttccgtcggcacagcagcctgatattatcatcaccgaaaataccggcaaaaagggattgctgcgggaagttcacaatgatccgttccttcctatgcaacagcaggaagccgaacaatacctttccactttgttccagcttcaggtggaaagtctggtctcccgcgtcaccaacaccggtctgcatcgtctggttctgggtgtttcgggcggtttggactctacccttgcactgcttgtctgccatcaggcattaaaacagctggagctgccttcccagaatctgattgccattaccatgccaggatttggcaccagcgaccgcacctattacaatgcacttagcctgatttctgcgctcggtgccgaaaatcgggatatttccatcaaagcatcggttctccagcactttgaggatatcggtcatgatccttctctgcgggatgtcacctatgaaaatgcacaggcccgtgaacgcacacagattctgtttgatgttgcaaacagctgccgcggtctggtagtcggaactggagatatgtccgaggatgcactcggctggtgtacctttggcggcgatcatcttgcaagctataacgtcaatgtctgcctgaccaaaactatgatccgcaagatggtaacctacctttgcagccggtttgatgatcaagtcagcagcatcctgcatgacattgttgataccccagtcagcccagaacttctgcctccggacgaaagcggaaagattcagcagaagaccgaggatattcttggcagctataccctgcatgactttttcctgtactatctgctcaagtataacttcccgccaaagaagctttactattatgcttgtcttgccttttcggaggaattttctgcaagctatattcttgagaagctcaaagtatttctcaaccgattctgctccggacagtttaaacgaagctgttcgccggacagcgcagatatcaccgatgtctgcctctcccgctacccgattccatctgactgttcggcacaagcattgttgtccgatctttccgatatccgatag

SEQ ID NO: 1576 - DNA, 3012 bp, Unknown
  Artificiall/Consensus sequence
atgacaaagaccaccctgcgcgagatacggcaaagtttgggccgttatattgcgattttggcaattgtcgcgctgggtgtcggtttgttttcgggactgaaagttacccgaagtgcaatggtaaaaagtgcccagcaatattttgatgataccaatttttatgatgtgcgcctgttgtccaccatcggttttgatacggatgcagcaagggaactttccaggggagaacggattttggacgcacagggggcaatctctaccgatgcccttattatggatgaacagggatcacagaacgttctgaaggtgcacagtttgctggacaatcagaatacgccggtactggttcatggcagaatgccgcagtcgccgacggaatgtgtcgtggatgcgcaggcttttgggaaagattcgattggtaccattctgaccttatcagaagaaaatgatgaagataccgatgagatgtttgagcagaaaagcttccggattgttggaacggtcaattctccatactatgcaaactatgagcgaggaactacttcgcttggaaatggtactatccagggatttatgctgattgagcgtgaggcatttgactgcgactatgatacggagatttttgtccggatcaatacaggagatgctcagatttataccgatgaatatgatgacgccattgactcgatggaggattggctggaagagtttgcacagcagaaagcggatgagcgatatgaccggctcaaatcagaaggagaacagcagctggtaaatgcgaaagaacagcttgcagaagaggtaagacagggagaaggtcagctgtacgactccaaaacagagcttgacagtgcaaaaacggagattcaaagcagcagagcccagattcaaagcggacagatcgaactggataacggaagaaatcagctcaatcttcaggaaaaggatcttctttcccaaaaaacagatctgattttaaagaagcaggaagtgctttctggactggatcaggttgcagctttaaaaaaccaggcacagtatgatgcttcttcttatgcacaggtcttagcgcaggagcaggaactgaaagccagccttctggagattgaatcgggactaaatgagattgaagctggtctggcgcagattgaacagagcaggcaggaattaaatgatcagcaggcacagttgaccgattccagtatgcaggtggatcaggcgcagcgggagtatgatgcaggatatcaggagtatcagcagggtattgccgatcttaacaccagcacagaggatgcgcaggaagaattggatgatgcacaggacgacctggatgagatggaagagccggatgtttatgttctggatcgcaacaccaatattggttatgcaagttttgataacgactccgcgattgtaaacggtattgcaaatgttttcccaatcttctttttcctggtagcggctctggtctgcatcacgaccatgaaccgaatggtagaggaacagcgaacccaaattggtgtactcaaagcgctgggctacagtgaaggggtcatcatgggaaaatacctcttttattccggaagtgctgcaggactgggatgtctgctcggattttttggcggctccattattttcccatttgtcatctggcagtcctatgcgattatgtacacaatgggagatatcctgtttgtgtttgacaaaaaacttgcactgatttcgatggcggcatcgatgctttgttccatgggtaccacctatttcagctgtcgatatgagctggtaagtgttccggcacagctgatgcgtccaaaagcaccaaaggcaggaaaacgaatccttctggaatacattccgattttgtggaatcagctttctttcttggtaaaggtttcgatccgaaatgtgcttcgctacaaaaagcgtttctttatgatggtcgttggtatcagtggttgtacagcattgctggtaacaggatttggtgtcaaggactcaattgctgatgtagcgggacaacagtttggtgaaatccagacctatggtatgagcgttttgatgaacgaagactacacacaaagtgagtgggaagaagtggaagactatctgcgagaagaaactcaaggatatactcgggcggcagaacgttcgatggatgttcagctggaagatggaacgacaaaatccatcactttggtcatgccggagaatgtctctcagatttctgattattggaaccttcatacagaagatggaacaccaattgcatatccagaggaaggtcaggcggtactcaatcgtgaatttgcccgtcgaaatggaatcgaaatcaacgatgtaatttcgctgagcgatgaagacggacacgaattatccctgcgggtaaccggcttgagcgaaaactttgtttacaactatctgtatctgacagcagaaagctgggaagctcagacaggggaagaggtagagtatcgcagcatctatatcaatactcagggagtagcggatgaacatgtgctgctcgctcgtttgatgaactttgacgcagttagcagcgttaccgtcaatgcagacactctggataaatttaacagtatgatgtcaagccttgactatatcgtgttgctgattattatctgtgcaggttctttggcatttatcgttctttacaacctgacaaatatcaacattaccgagcgtatccgtgagattgcaaccatcaaggtgctgggattttatccaagcgaaacggcatcttatgtattcagggagaatatattcctgacagcaatcggaggaggagcaggccttttgcttggtaagtggctgcactggtttgttatggaacagatcaatattgatatggtaagctttgcacaggtgattcgaccacagagctatctttacagtattgcactgacctttgtctttgcatgtattgtaaaccttgtcatgtttggtaaactcgaaaaaatcaacatggcagaatcgctcaaatcgattgaataa

SEQ ID NO: 1577 - DNA, 690 bp, Unknown
  Artificiall/Consensus sequence
atgggcaagaggcgtttgataggaaagatagttatattgatgctgggcttggcagcggtggtgatattggcggcaaacagcgatactatacccgtcagcaccccaaaaaagggatatagggtagttatcgatccgggtcacggtggcagcgactgcggcgcggtgggagtatcgggagtaaaagaggcggggctgaaccttgccgtaagcctgtacctgaaggaggagctggaggcgctgggaatggaggccatactcacccgcagcgacgaaagggcgctggcagagggcaagaaggcggacatggccgccaggggcaaaataatgaacggagaaggggtggatctggtggtgagcgtccacatgaacaagttcaccgacccatcggtacacgggccaatggctttctacatgaagggcagcgccgagggggagaagcttgcaaagaccgttatagacagcataacagacgaactgggggcgccgaggcgcatagccaatcccggcgactattatgtgatacgggagagcatgccggtatccgtgctggtggagtgcggtttcctctcaaacagcggtgatgaggcgcttttgcagcaggagcagcatcaaaagaagctcgcccacgccatagcgcgagggattttcagctattttgagggggatttggggcgtaagccgctggactaa

SEQ ID NO: 1578 - DNA, 618 bp, Unknown
  Artificiall/Consensus sequence
atggataacgataaaaaaggacttttgtttgtgatttccggcccttccggcgtaggaaagggcactatctgcaaaaagctgctggagaggcggaaggagcttaagctttccgtatcggtgaccacccgtgcgccgcgtcccggcgagatagaaggcgtgaactactttttccgctcagaagaacagtttcaggatatgatagagcgtgacgagtttctggagtacatgtgcgtgttcggcaagaaccactacggcacacccaaagcttacgttgcagagcagagggctcagggcaacgacgtaatattggagatagacgtcaatggcgcgctgaacgtcaaaaagcgctgccctgacgcagtcatgatattcatagcgccccccagcatggagacgctgaaaaagcgtctcgtaggccgcggaacggaaacggaagaggcggtagagcgccgctttgccgaggccgtgaaggagctggccgcagcgggcgagtacgactatatagtagttaacgacagcctggataaggctgtgaacgatacggagagcatacttgtatccgaaaggctgcacgtatcaaacaatcccaagctgatcaacattcttaaaggagaataa

SEQ ID NO: 1579 - DNA, 762 bp, Unknown
  Artificiall/Consensus sequence
agaactataacggcaccggactctttacagggcgggcagcccggaaaaggaggaaaagcattgaacatcatagacgcggtatcaatatgtatactggtgttattcgtgctcttcggcatatacaagggatttatttccacgcttcttaacataggcgcgtactttgtttcggtggtgctgagctttctgctcaagccccttggggccagcgccataaagcacagcgacaggatattcaacatgatgctgtactacaccgagggcagcgagtttatcgccaatccggaatacgttcgaatggaaatatcctccctctccacggccgagataaacgacataatcgcctcctccaatctgccctttcccatgggcagggagatagccaaaaacatcgcccgggaggccttcgcggatcagggcatagtgacgctgggggactacttcaaccagaccatagtgggcgtattcataaacatactgatgttcctcgtatgtttccttataatacgcgcgatactctcgctggtgataaacggggcggactatgccgatcccttccccatgctcaagagccatgacggcatattcggcggcgcgctgggcctgttgcgggggatgctggcgttgctgctggtattcatgctggtacccatagtgctgacgatgctgggccagttcgatcttataaccaacatggtggacgactcagccatggcccgggtgttctataagcttaatctgcttatcagcatcgcggcgtaa

SEQ ID NO: 1580 - DNA, 1182 bp, Unknown
  Artificiall/Consensus sequence
atgttaaacaaaaagagcctgcgggctcttttttgtgtaccgaaacgtgggatatcatggcaaaaagtgcttttaatgggggatggtttaatatataattacaaatatacggcatcggtcaaacgcatacatataaaccgaatctatcgaacagctacggaaggggataaaatcatgggcaatatcattggcatgctggcgggcgagcttatgtccggcagctcggtaaagcaggtggcaaaggctgctggcgtgaacgaaaagcaggcggagaacctgatgggcaacgccataccgctgctggtgcaggccatgtcggacaatgccggcacaaaggtaggcgcggagtcgctgtatgaggcgctgggacagcatagcaacggcctttctgccgccgagcagctggacagagcagaccttgaggacggcgacaggataatcggaaaaatattgggcgacaacaagcagggcgtgaccgaggcattggcgaagcaggccggcattacaaagggcaacagcgcgaagatactggcgctgctggctcccgtaatactttcccttataagcaccgagacgaatacaaacaatacctcctccggcggactgtcatcactgctgtccctctttacggacgacgacacaggccacagcaacacgcagactacctccagctctggcctcggagatatcggaacggcacttctcatgggggcgctgcttggaaacaacaataacggcaatagcggttctgcaggaggcaacctgcttacctccctccttggcggcggacagcagcaggtgcagccccagcagcagtccggaggacttcttgaatcattgttcgggggcggcatgagcggtcagactatacagtccggcggcagtggcctcgacggagcgctgctcaacaataacaccaatcccaacagcataaaccagggcagcatgctgtccagcctgcttggcggcagcaataacgatacctccaatatgctgggctctctggcaggatcgctgcttgcagacgctttcaagggcatgccgcagcagaaggcggctccaagaaagacagcggcaaagaaaaccacgacagcaaagcccgccgcgaagaagaccgcagctgtgtccaagaagactacgtctgcgaaaaagacgacggcaaaaaaaccggcggataagtaa

SEQ ID NO: 1581 - DNA, 1047 bp, Unknown
  Artificiall/Consensus sequence
atgtctattcaaattaagactatcgccgtaaccggcgaaaaacagaccgagataatgaacctgaccaccccggatcttcgcaacggcgaagcattgataaaggtacatgccgtagcgctctgcacccttgagcagcgcatattcaggggtgaagtaaagatgcctctgccatgcaccggcggccacgaggtatcaggcgagatagttgctctgggcgatggcgtgaacaagaaaatgtgggcgccaggagaccgcgttgccgtacgtctgctttacaactgcggcgagtgctattactgccgtaccggacatgctaatctctgcgaaagggcgcagaaaaagcccgtacgcgagggactgcttataggacccggcggcctttgcgattacgttatagtaaataccggttatctctttaagatacccgacactctgagctatgaagaagccagcctgaccgagcctcttgcatgtgtggtgcatagcgtcaccaaggctaacattcagctgggtgaagacgtggtagtaataggcggcggcataatgggtcagtatcacgtaatgctggcgaagcgcaggggtgcaagggtcataatgagcgaggtagacgagagccgccgcactctggcccggaagctgggagccgacattactttcaaccccatggagaaggatcctgttgagtatgtaaagagcctcaccgagggccgtggtgcagacgtggtgttcaacactaccgccataccttccgtggtacctcaggctatcgccatgacaggcaaggccggccgcatgatacagtacagttccatgcatcccgatgccccggcgccggtaagcccccagatgctgcatggcaatgagcccatactcaccggctccatcagccccgacgtgcacgacttttttaccgctaaccgtctgctttccggcggcataatagactgcaagccgcttattgcaaagaagttccccttcgagcaggcacagcaggcctttgaggcggcgattgtgcccggcaccttcagggtaataataacagactga

SEQ ID NO: 1582 - DNA, 663 bp, Unknown
  Artificiall/Consensus sequence
atgtgcccgccatgcgggcacctttatgtatgggagaaaaacaccttgataatagacactcaccttcacgaacgcacattttccggcgacagccgaatgaacctgcttgagcttgtttcggaagcaaggcgcaagggtctcgacggcatatgtattaccgatcatgaccagatgggacttacacaatatgccgcaaaaatagctgaacaggaaaattaccctatatttgttggcgtggagtaccttgcctgcgaaggggatatcgtggccttcggcattgaccggcttccagagccccaccttatggcgcaggaattcatagattacgtcaccgcacgcggcggcatatgcatatccgcccacccttaccgggccaacagccgcggccttggggatatgctgttcacgctaaaaggcatgacaggcgtagaagtgctcaacggcagcaccacgccccttgagaaccgtaaggctctggatacctgcataaagacaggcctcaagcagttcggcgccagcgatgcccacagcacggtgcaggtcggcatttacgccactgaaatacaaggatatttcaccaccgtacccgaacttgtggaggccataaagacccgggaatgccgggccgtatacctctccggttttaaacctcttgaagtatga

SEQ ID NO: 1583 - DNA, 966 bp, Unknown
  Artificiall/Consensus sequence
atgaataacccttataaggtacttggagtaaacgagggtgcttcgcaggaggagataaggtctgcataccttaaactcgtcaagaagtaccacccggacaagtataccgattccgatctgaaggagcttgcaaacgaaaagctggtggaggtcaacgaagcctatgagatgctgacaaagaaaaacggtcagagctcaagctacgccaacaggaacggcaatggcacctatgactcctacagcggcggatataccggctccggaagctcatattccggcccgaatgctcaggaattcaacagggcgagggctttcatcaaccagaataaccttcaggccgccaaggcggtgctggacgccatatccacccgcaacgccgaatggtactatctctacggcataatatacctgcgccagggctggtacgataaggcccgggaatacctgacgatagcctatcagcaggagccccacaacccggagtacgccgcggcgtacagctcgataaaaaacagcggcggcgcctataccagaagcacaggcaactacggctcctacaattgcagcccctgcccgctctgcgccagtatgctgtgctgtagctcaatgggcggtatgccctatattttctgctgcttacatataaataagaaaaacttaatatttttacgccgatttggattttattcttctgccgctctggcgatactaatgtcaggaatacgatggagggataaggaaaatgaggttcagaggattaaagatactgctgctggccgttactgccgcggcagttttgtttttgctttgcggcgcggtcaagacccttggtatggacaggtgggtggatttcgacgtgtacagaataacaggctgcgacaggacctcgataatatacgatgggcaaagcgatgtggttacccgcttacacggagttcaggacaggacatgggtgagcatcagtga

SEQ ID NO: 1584 - DNA, 2097 bp, Unknown
  Artificiall/Consensus sequence
gtgtcaaaaaagtggctgaacgccacttttttgagttttacgggttttgcctctcgcattcgctcccgggcggcaaaacccgcaaagaacgaaaacctctgggttttcatccgttctgacgcacatgtcgtcagagccggattaaacataaggggctgcggccccttatcaaccccggggtttttcgacaggctgatatttcgtgggatcatatatggtgcatacagggcaaaaaaatgtgacaatgttgcgaagtgcggtactaacgaaatattttatgctaaaattttaattatgatgaaattcgaccagcgatacgagaaatacaaagccccctttggcgcggtggaaacgggcagctcggtgcgcttctttatggaaaccgacagggacgacagtaaaataacactcaggctctgggtagacggccgggaggagctgatttcaggcgcccgggaagagggcggcgtaagctttacctataccccggcccacagcggtatcgtatggtactattttctgattgacggtccggaaggcaggcggtattacagcggtacagagggcgagggaagtatatacacagagcagccggattcctaccagctgacggtctacgacccctatgaaacgccggactggtttaaaaatactatcgtttaccagatatttccggacaggtttagaaggccaggtgaaatactcggtatagaggagcataagtcgctgttcggggcgccaaggattcatgggaactggagcgacagcccggactacctgccgttaaacgggcaaaggtactatgtgccggaggactttttcggcggcaacctgtacggcgtaaaggaaaagctgccctatttaaaatcactgggcgtggggtgcatatacctcaaccccatattcctttcctccaccaaccaccgctacaacacggcggattacatgacggtggatcccatgcttgggggagacagtgcgttagccgagcttgcggcggccgctaaggaatacggcatacggctcatgctggacggtgtgttctcacataccggcagcgaaagcgtttatttcaaggaggctcagagcaatccccattccccctgccgggactggtacgattttaccgagtaccctgacaaataccgctgctggtggggctttgagacgctgcccgaggtgaaggagcttaccccttcatacatggaattcataggcggcgtcatggaaaaatatgccaaaatgggaataacctcatggcggctggacgttgcggacgagctgccggacggatttatagaattcctgcgcaaaaggctcaagagcatagatcccgatggggtgctcttaggcgaggtgtgggaggaggccaccaataagcacagtatgggcggccggcgtaaatatgtggacggccatgagctggacagcgtgatggattacccattccgcaggctgcttatggatttcttcctcggaaggatcgacggcgaagggctggcaagggggctgctccggcttatggagaactacccgccgcagttttacgaaagccttctcaatctcatgggcagccacgatgtcgtcagggccataaccgcgcttgcgggggcgcctgacagggattcccttacgagagagcagcaggcggcgtattcccccactatagagcagctgaaggcgggcagaaagcgcttcatggcggcggccgcggtacagtatatgatgcccggcgccccctgcctctactacggcgacgaggcggggcttacaggcatggcggaccccttcaaccggggcacatacccatggggtcaagaggatacagagctcatcgcatatttccaaaagctgggagagctgcataaacgcgccaaaggcggctgcgccttcgcggggcgcggcgatgtattcgcgctgtaccggccggaggtcatatgcgtggtaaacaggagctgcgagccggtaacggcctgctttgcggataaggatttttgcggcaatatcagggccgagctggaaaacggctgtatagaaagggaactgcccccatacggcgcggcgatacttataaaaggacaagaggagcgggcataa

SEQ ID NO: 1585 - DNA, 747 bp, Unknown
  Artificiall/Consensus sequence
cagcttataatgccgcccataccggaggaaaacattttgagtattaacattaaaacctacggctcctttgtaaagctgccggtaaaccatcttgcggggcataccgtaatttccatagacgtgctgcgctcgtccagctgcatagtatggggccttgtgaacggcgcaagcaagataatccctgtagacgacctgggcagcgccgtatccatagccagccgcatgggagactgcgtattggccggcgagcggggtgcggtgctcattcccggctttgacataggcaattcccctgcggagtacaccgaggcaagggtgggcggcaaggccgtcgtcatatcaaccaccaacggcaccggagccatctgcaaatccgagtccgcctccaatgtgctcataggctccatgctaaactgcaccgccgtagcaaagcgcgcggtagaattgggaaacgatgtcatactcatgtgtgcaggtacaggcggggagttctccgcagacgacatatacgcagccggcgccattgcctccgccatacagacactgaccgacgcggagctctgtgaccttacccgcgtctcctgtctggtatacgatcgctggaaggaggaccggaccgagctttcaaagacaaagcactataagcggctggtatccctgggtctggagagcgacataaatttctgcctcacccgggatcttacggatatagttccggagtacaaaaacggcgtgatagagctttaa

SEQ ID NO: 1586 - DNA, 963 bp, Unknown
  Artificiall/Consensus sequence
atgaagcgcataaccgcactgtccaccattgctgttgccgtgatagcacttattataggccgcacattctcggcaagcgtaatgagcaacgaccgcgtcatggcggacgtgcgtcagagttatcgcagcgcctcactggtggtgtcgggtgaatgcatacaaaagataaattccggcgacaatgcccagagccgcattctcatagatgaggtaatagccggaaacgcccgggaaggctccaagatacttgtaaagggcagttataccgtaggcgaaaagtatctgctctatcttacggagggcaacgaggtgcagtatgccgaggacgaggcagactattgctccacctccgcggataactttgtgatccgggacggaaatgtggaatacggcggctcgcggataaagatcagcgagttcaaaaaggaaatggacgcaatctcaaaggtcatcactgcgccttcaaagaactactactacaatgatatcagatcgcttgtaaacgcctcggagaatatattcataggccgtgtaaacagcgcgtctcatatgcgcagcaccaaattccgcacccaggacggcggaagcacagtcgaaaagaaggcgccatccgcaaatcttaccatcagtgtatacggaaacataaaaggcgatataggctacggtcaggaaataaatctggtatatgttccttcagccagcgaaaacatgacggatgccggcaccctccagcccaagccggtgagcgccgacaaagcggtaaagctttccgagggcgatacctacctgttcttccttgcggaggatcctgaccccaagcaggatcactgcttcccggtaaactccatacagggttggataaaggtggaaaatgataagctgaccgtgtccgatgagaacggcgtggcgaggggatacacagacctctctcagctggtagccgatataaacaaggtaaaataa

SEQ ID NO: 1587 - DNA, 792 bp, Unknown
  Artificiall/Consensus sequence
atgaacgaattaaggaacaaaaagggttttatatgcgatatggacggcgtgatttaccacggtaacaagctgctgcccggcgtaaaggagttcgttgactggctgtacagggaaaacaagaacttcctcttcctcaccaactcctccgagcgctcacccaaggagcttcagcaaaagctcaagcgcatggggcttgatgtggacgagagccatttctatacaagtgcgttggcgaccgcacgcttcataagctcccagtcgccggaaagcagcgcctacgtaataggcggcgcaggcctcataatggctctgcacgacgaaggcatcaccatgaacgacgttgacccggattacgttataatcggcgagggtaatacctacaactacgagaacatcctgaaggcggtacacctggtgatgaagggcgcaaagctcatcggcaccaacagcgaccttacaggcccttctgagaacgggataatccccgcatgccgggcaatgatcgcccctatcgaaatggccaccggccagaacgcctatttcataggcaaacccaaccctcttatgatgcggacaggccttaggatactgggcgtacactcagaggacgcggtaatgataggcgaccgcatggataccgacatgatcgcgggaatcgagactggccttgacacctgcctcgtgctctccggtgtgaccgaccgcgccgacatcaataagttcccctaccgtccgcggctggtgttaaacggtgtaggcgatatacctgacaagccaaatgaaatagtgtga

SEQ ID NO: 1588 - DNA, 1017 bp, Unknown
  Artificiall/Consensus sequence
atggagtacactaatctcggcagcaccggcttgaaggtttcccgcctcggcttcggcggcataccgatccagcgcatcacacaggaagaggccactgccctcatacacaagctcccggagtacggcgtcaactacatagacaccgcccgcggctataccgtaagcgaggaatacctcggcatagccatggaaggtatccgcgataagttcgttctcgccaccaagagcatggcccgcacaagggaagccatggaaaaggatatagagaccagccttaaaaacctccgcaccgaccatatcgacctgtatcaggtacataacgcaccccctgcccagatggatatagtcaccggcgaaggcggcgcgctggaggccctgctggaagcaaaggcggcgggcaagataggccatataggcgtcaccgcccatgaggtagccacctttgagatggcccttgatatggactgggtggagaccataatgttcccctacaacttcgtagagcttcaggcggctgacctaatcaaaaagtgcgccgaaaagggcaagggctttatctgtatgaagcctctggccggcggcgccatagagaacgcgcctctcgccatgcgctttatagcctccaataaggacataaccgtcaatatacccggcatggcaagcgaggacgagcttaagcagaacgctgccgcagcctgcgatcccacccccatctcggaggaggagctcagggaagtgcagaacatacgcgacaccctgggcaaccagttctgccgccgctgcaattactgccagccctgcaccatgggcataaacatctccttctgctttactatcaacggctatctcacccgttacggcctgaaggactgggccataggccgctataagggaatggccgtagagcctaacgcctgcattgaatgcggaatgtgcgagagccgctgcccctaccacctccccataatcgaaatgctcaaggacgtatacagcaacttccagaaggaaatgaagtaa

SEQ ID NO: 1589 - DNA, 615 bp, Unknown
  Artificiall/Consensus sequence
atgatgacgggaaaatgcggcataatatccggcggagagcgggataccctaagcggcatagaggactgcgggctcatcatcgcctgcgataggggatacgaatacgcaagggctgcagacgtgcgccccgggctgctggtaggcgatttcgactcatataccggcccattgcctgaggatatcccccggctggaactgcccgcagaaaaagacgatacggacaccatggcggcggtacggtacgccatagctcagggctatggcgagataaggatatactgcgcccttggcggcagggcggatcacctgttgggcaacatacaggcactctccttctgcgcggagcggggcgtaagggcctccatagtgggaggctgctgccgcatagacgtgataaaaaattctgttatttcccttgaagaacaaaatgggtatttttccgtaatatccctgagcgacgtcagcaccgtcaccatagagaacgcaaaatatgagctctctgacgcccgcctgaccaactccttccccataggcgtgagcaaccggtggaagaatggcgaagcacgggtgaaggttaaggacggaactgcggcggtgatcagggtaaaagaatag

SEQ ID NO: 1590 - DNA, 1611 bp, Unknown
  Artificiall/Consensus sequence
atgactaaatacatcttcgttaccggcggcgtggtatccggccttggtaagggcatcaccgcggcatctctcggcaggctgctcaaaaaccgcggtctcaaggtagcggcgcaaaagctggatccatatataaacgtggatccaggaaccatgagcccttatcagcacggcgaggtatatgtaacggcggacggcgccgaaacagaccttgatctgggtcactacgagcgttttatcgatgaagatctgaataagtattccaatcttaccaccggtaaggtatactggaacgtgttgaataaggagcgccgcggagaattccttggttccacagtgcaggtcataccccacataaccaacgaaataaaggatttcgtataccgtgtgggcaagcagacagacgccgatgtggtcataaccgaaataggcggcaccataggcgatatagagtcccagccctttatagaggctgtgcgggagatatccctggaggtaggcagggagaacagcctgttcatacacgttaccctcgtccccttcctccgcggctccgatgagcacaagtccaagcccacccagcattccgtaaaggaacttcagggcatgggcataaaccccaatataatagtcctccgctgcgacgagcctctcgaggattccatattcaaaaagatatccctcttctgcaacgtaaagctggactgcgtcatagaaaacatcactctcccctgcctttacgaagcgccgctgatgctggagcagtcccacttttccgacgtcgtctgccgggagcttggcatagacgcgcccgcgcccgaccttgcggaatgggagaacatggtgcggcgcataaaatcccgcgagaaggaagtacgcataggcctcgtaggcaagtatgtacagctccacgacgcatacctttccgttgcggaggccttgcgccacgcgggctatgccctcaatacacatatccgcatacgctggatagactcggagacgctcaccgaagccagctgtaatgagatgctggacgatctggacgggataatcgtccccggcggctttgggggccgcggcatagacggaatgatacttgcggcaaggtatgcgagggagaacggcatcccctatttcggcatatgcctcggcatgcagatagccgtaatagagtacgcaagacacgttgcaggcattgcagatgcaaattccggagaatttgatgagctttgcagacacaaggtcatagactttatgcccggacagagcgaaaatatagataagggcggcacgctgcgccttggggagtatccctgcgaaatagcccccggcaccaccatggagcgctgctacggtacaagccgtatatccgagcgccaccgccacagatatgagttcaacaatgactatcgggatgtccttaccagggcggggcttaccctttccggtatgtccccggacggcaggctggtagagacggttgagcttaccggcaggcccttcttcgtgggcgtgcagtaccacccggagttcaaatcccgccccaacaaagcccatccgctgttcagggggttcatcgcggcggctctggacagagcggagcataagcggtaa

SEQ ID NO: 1591 - DNA, 942 bp, Unknown
  Artificiall/Consensus sequence
atgagcaaaatatacgatgtaatagtgttgggagctggccccgcagggcttaccgccggcctgtacgccggccgcagcagactgtccacccttataatagagaagggtcaggacggcggccagatcgccatcaccaacgagatcgagaactaccccggccagcagcttgagggcgaatccggccccagcctcatcgcgaggatgaccgagcaggccaagaagttcggctgcgagagagtgagcgacaccataaagtccgtggacttctccggcaagaccaagaagatggtgggcaccaagggcgaatatgaggccaggaccgtcatcatcgccaccggcgcacatccccgccccataggctgcaagaacgaagagaagttcgtaggcaagggcatttccttctgcgctacctgcgacgccgccttcttcgaggatttcgaggtgtatgtggtcggcggaggcgacgctgccgttgaggaggccatgtaccttaccaagttcgcacgcaaggtgaccattatacatagaagaaacgagcttcgcgctgccaagtccattcaggaaaaggcattcaagaacgaaaagcttcatttcatgtgggatcacgtcgttgaagaagtggacggcgacggaatgctgagcaagatgatcgtaaagaacaccaagaccggggaactgaccactatcgaggcggacgaggacgacggcatattcggcctgttcggcttcattggcctactgcccaacagtgatctgttccagggcgtcatagatatggagaataactacatcctgaccgacgacaacatgcacaccaacattgagggcgtgttcgccgcaggggatatccgcaagaagtccctccgtcaggtagtcaccgcagctgccgacggcgcaatagctgcgatgcaggctgaaaagtacatagctgatttaaactaa

SEQ ID NO: 1592 - DNA, 1215 bp, Unknown
  Artificiall/Consensus sequence
atgactaaaagggcttattacgaaaacggcgcgctggagtgcgaggctacagtgcttaggtgcagagccgtggagaacggctttgagatacttaccgatgttacctctatttttccggaaagcggaggacagctgtcagatacgggctttattgggaattcccgcgtgacccacgcccgcgaggagggcagcgaggtatggcatctctgcgataaggccgtagaagcgggtgcaaaggtaaagatagccgccgatgccgggccccgcctggaccacacacagcagcacagcggagaacatatactttccggcatggcaagtaagctgttcggagccaagaacgtaggcttccacatggcggaggactatgctaccatagacctcgacacacagctcacccatgagcagataaaggaacttcagcgagaggctaaccgcgcggtgcagcgcaatgttcccgttacatatgagacggttcagggcgaggagcttgagaatatcacgctacgcaagcaggccaagggcctcaagggagatatccgcatagtatattttgacgggggagaggtagattcctgcacctgctgcggcacacatgtagctttttccggcgaggtaggatacataaagataaccgcccatataaaatacaagggaggcacccgcatatggttcgcctgcggcatgcgcgccgtcgaggattcgctgaataatcaggatatcgtggattctcttgcagttcgcttcagcgcaaagcaggaggacgtgctcaatgcagttctgcgtcagggggacgagctcactgccgcaagacatcagctcaaggagcgcaccgagaagctaaacgaattcatagcggcggaattgctcggtaaggcggaggtgataggtgccacaaaacttataatagatatgcagaagggcagctccatgaacgagctgaagaaccttggcgatatgctcataagggacgaaaacgtcctcgcgatgctctttggcgagaacggggacagcctcgtatatcagctggcacgcggcaggaacgtcaagatcagcatgagggagcttataaaggcggtgaacgcagcggcaggcggcaagggcggtggaagagacgagtacgctcagggcagcgctaagataactagcgcaacggatgccgagggcagcatagaaagcctcagaggttattgcaggagcatgctgaaggcataa

SEQ ID NO: 1593 - DNA, 696 bp, Unknown
  Artificiall/Consensus sequence
atgtatggtatagtaaatatatctttgttttgccgttatctggcggcgtttcaggaggaaaaaatgcagaatctcaccgtagatcttctcaagcgcatagccgctgccatagccgcacagttcggcaacaactgcgaggtcgtaatatacgacctcacctgcgaaaacccggaggatatgatactttacatagaaaacggccacgtttcaaggcgcagcgccaatgccggccccagccatgtagttcttgaggccatgcgggacggacgcaaggatatccccgaccactacaactaccttaccaagacccacgacggccgcattctccgctccagcacggtatacataaaggacgaaaaagacaaggtcacaggcatattcgccataaactacgacatgactgagcttatgatgacgcagtccgtcataaacgccatagtgcaaaacaacccgggaggggaaccggagcgcatacccaccaacgtgaacgagctgctggacgatctcctcgagcagtcggtacagctcataggccgcccggttgccatgatgaacaaggacgacaaggttaaggccatacgcttcctcaacgatgcgggcgccatgctcataaccaagagcggcgacaagatagccaagtacttcggcatcagcaagtacaccctatactcctatctggatatcgccaaccagtga

SEQ ID NO: 1594 - DNA, 1155 bp, Unknown
  Artificiall/Consensus sequence
atggaggaattaaaacttccagaacgctttgaggaatactcagaaggacggaaagccggcttccttaagatgaaggcggcaaaggaaagcggacgtaaggtagcaggctacttctgcacctataccccgctggaggtgctggatgctgcgggcatgctttcggtgagcctttgcggcatgagcaacgaaactatcccggcagcggagacggttcttcccaaaaacttatgcccccttatcaaatccagctatggttttgccattacggacaagtgcccgtatacctattggtccgacctgatcgttggcgaaaccacctgcgacgggaaaaagaaaatgtacgacctgctcgggcagcgcaagaaaatgtacgtgcttcagataccccaggggatagaccgcacatattcccgccagctttggatcagtgaggttcgtcgctttatcgattttataagcagagaagccggcgttgaaataaccaacgagatgctgcgcaaagccgctgacaggcgaaatgagctgcgccgcgcccgatcggagcttatggagcttcagcgcctttcccctgtgcccatctccggacagaagctttataaattcttggaagggcttaattataattttgaccttgaagatgccatagcttccacccgcgcccttacagctgaaatacgcaaggcatatgaggaagctgacgatataagaaaagaagaaaggcggatactgattaccggatgccccatcgggggagtgttggaaaaagtcgtgggcgccgtggaacgcagcggcggcgccgtcgtctgctatgaaaactgcagcggcattaaggccgcccgctgtttcgtggatacggaacgggaggatatggcggaggccattgccgacgcgtatcttaatatcggctgctccgtaatgtcgcctaacaccagacgcatggaaaacctgcctgagttgatccgggaattcggcgcggagggcgtaattgacgtaacccttcagacctgcaccacttacatgatagaaacacgggccatccgcaagctgtgcgaaggactgaacataccctacatgtcgctggagactgactattctcaggaggatgcggggcaaatcgacacgcgcatatcggcgttcattgagacgctatgctga

SEQ ID NO: 1595 - DNA, 1026 bp, Unknown
  Artificiall/Consensus sequence
atggacgacagacttataacctcttccatgacaatggaggacgagcagatagaatacagcctgcgccccaggtttcttaacgagtacataggtcagcataacgtcaaggaacacatgcgcatatacatagaggcggccaagcacagaggggagcccctggaccatgcccttttctatggcccgccgggtctcggcaagaccacgcttgcggccatagtcgcaaacgagatgggtggcaacctgcgggtaacgtcaggcccagcaatatcccatgcaggtgaccttgcggccatacttacaaatctcgcccccggcgacgtgctgttcatagatgagatacacaggctgaattccagcgttgaggaagtactgtatcctgccatggaggattattccatagacataataataggcaagggtccatccgcccactctatacgtctggatcttccaaagtttaccctcataggcgcaacgacgcgtatgggcatgctcacatctcccctcagggacaggttcggcataaaggagcagcttgagctgtacaacccggaggagctgaaggaaataatcgagcgcagcgcggatatactcaacgttaagatagacacagagggtgcccttgagatagcctcgcgctcccggggtacaccgcgaatagttaaccgcctgctaaaaagggtgcgtgattacgcacaggtgcggggcaatggcgagatagatcttgagacagcccgggctggcctggatatgctggccatagatgagatgggccttgacgctgtggacaggcgcatgctcgccaccatgatagaaaagttcggcggcaggcctgtaggccttgataccatagccgcggccacaggcgacgacgccaccaccatcgaggatgtgtacgagccatatctcatacagctgggcttcatcgcgagaacgccccggggccgcgtggtgatgccgctgggataccggcatatgggttacgcgccgccggctgatgtgggccaacagaagatgaatttttga

SEQ ID NO: 1596 - DNA, 1128 bp, Unknown
  Artificiall/Consensus sequence
atgggaaacaacgacgtattcggccttatatacacgggcgaatccagtatgcagctccgcgatctgacctactcaaggtcggttgccgcggtgccctttgcgggcagataccgctgcatagactttataatgagcaaccttgtgaacacgggcatttccaacgttggcataattgcccagaagaactaccactcgctgatggatcatctgggctccggcaaggaatgggagctgcacaggaagcgggacggcctgttcatactgcctcccttcgtgaccagagacaataccggcatataccggggtaccatagacgcataccattccgtgatgggctacatacggcgcagctcccagaagtacataataatctccggcagccacaccgtattcaataccaccttccacgacatgatagcccagcacatacgcaccggggccgacataaccttcatgtacaatgaagtcggcatacatcacccggacgaccagttcaacgagctgcgcttcaatctggcggaggacggcagggtgaccggcatacagctcaacccaaaccagcccgcaacgccccattcctcctgcgacgtggtcatgatggaaaagacgacgtttgaatacctcatcgaggacgcatacagcaggggggataccgactttctcagggatgtgctccttcgcaaggtaggagagcttaagatgtacggctggaggtacgacggctacgtgggctgtataagctcgctgcccggctacttcaaccacaatatcaacgtgctcaaaagcgaggtgagacgggatcttttcaatcccgagcaccccatatacaccaaggtaaaggacgaggtacccgcccgatataagggggactccagggcccgcaactgcctggttgcagacggctgcgtgatagagggagaggtggaaaactgcgtgctgttccgcggcgtgcatataggcaagggaacaaagataagcaactgcgtagtgctgcaggcctgcgacatacaggaagactgcgagctatcgtatgtaatactggataagggctgcaccgtccgccagggacgccgtcttgcgggctacgacagcttccccataataatcagaaagggcagtacggtttaa

SEQ ID NO: 1597 - DNA, 909 bp, Unknown
  Artificiall/Consensus sequence
gtgcggcaaaggaagaacgtcttgaaatgcgccggcatttgggggataataaaactaaaaaataaaggagctggccccatgagcatcgcagacaggatattcatagaaaattgcagggatataatatcaaacggcgtatgggataccgataggccggtgcgcccgaggtgggaggacggctcccccgcacataccgtaaagctcttcggcgtggtgaaccgctatgatctgtcactggagttccctattatgaccctgcgcaagacaggcttcaggaacgcaatagacgagcttctatggatatggcagaaaaagtcaaataacatacacgacctgcacagccacatctgggacgcctgggcggacggcagcggcagcataggcaaggcctatggctaccagctgggggtaaagcaccactatcccgaaggggatatggatcaggtggacaggatactttacgacctgaagcacaatcccggctcccgcaggataatatccaacatatacaatcacgccgatctttccgaaatgcggctgtatccctgcgcttacagtatgaccttcaatgtatctggcaatcggttgaacgccatattgaatcagcgctcccaggatatgctggtagccaacaactggaacgtatgccagtatgcggtattggtttacatgatggcacaggtgagcggcctcgaggcgggaatgcttatgcacgtgatagcagacgcacatatttacgacaggcatgtgccgctggtggaggagctcatctcccgtgagcccctggacgcgccgaggttcattatcgataagagcatagacgacttttacaagttcaccgtggacagcttttcccttgaagggtatgagtctcacggcagtataggtaagataccggtggcggtgtag

SEQ ID NO: 1598 - DNA, 909 bp, Unknown
  Artificiall/Consensus sequence
attaaggggctgcggccccttaataaccccgtggcttttcgatatatcgaaaaacaggaaataggagaattaagaatgtcctttgaatttacccttcgtccccggactacagaaagccagcgcaggctgctggagatacccgttgaaaagatagtgccaaaccccaaccagcccagggtcacattcgacgacgatactatagccgagcttgcccagagcataagccaggtaggcctcatacagccgctggtggtgagaaggagcggctccggatatgagctggtagccggcgaacgccgcctgcgcgcctgcaagtctctgggaatggagaccgtcacctgcatagtagaggactcaatgcaggaggaatcctccgccatggtggcactcatagaaaaccttcagcgggaggacctgcactacatggaggaggcacagtgctactacgccctgctcaacaactacaacctcacccaggaggagcttgcaaaacgacttggcaggagccagtcctccatagcaaacaagctgcggcttttgcggctctcgcccgatgtggtgtccgccattcgtgagaacggcctttcagagcgccatgcccgggcggtgctcaagctaaaggacgaggaggtacagctggccgtcataaagcgcacggcggaaaagaacctctccgtcaaggacaccgagcggctggtggagaagaccctggataagatgtacgacgaaaagcgccccggcgcggccccccgccctgccataatacgccaggtgcgggactaccggctgtttatgaacaccgtcaattcggctatcgccgtgctgcgggaatccggcatgaacgtggaggtggagcaggaggatcttcaaaacggcgtggatatacacataaggataactaacgaataa

SEQ ID NO: 1599 - DNA, 948 bp, Unknown
  Artificiall/Consensus sequence
gagacaagagctaatatgtccttttcatctcagacaaaagatgagcttgtggaaagctgcaagctgggaagcacagaagagaaacgctccctgctttgcggaataacccatgcggccggctccatgacgctggggcgtggcggcataggcctgcaatatataaccgaaaacagcagcgtcgcggcgcttacggtacgcctcggccgggagctttacagcgtcaccgccgaaacctccataagtgaaaaggagaggctcaatgcggtgagcaacgtagtgaagttcacgggcgatggcgtgaggaatcttctgaacgacgcgggatacggggtagacggcgacgaggattttgagctgggatacataccgccgcgacttaccgatgacgaaagcaaggcaaaggcgtttttgagaggtgtgtttctgggcgcaggctcggtgagcgatcctaataagggataccatttggagctcgtgtgcagatacgaaaagtttgcagcgacactgtgcgacataatggcgggccttggcataagcgcaaagttcttgccgagaaaatccagctatatagtatatctcaaggatggggagctggtttccgacttcataaccctaataggcgccatgaacagcaccatggcctttgaggaggcgcgggtaatgcgcagcgtaagcaaccatataaaccgccaacagaactttgaggacgccaatatgaacaaggcggcagcggcagcggcgcagcagcttttggatattgagttcatacggctcaatgccggcctggacagcctgccgccaaagctcaggggagcggcagagcttcgcataaacaacccggaggccacattatccgaccttgcggaaatggccgagataagcaaatccggccttaaccacaggttagccaagctttcaaccatagcgcaggagctcaaggacaaatag

SEQ ID NO: 1600 - DNA, 930 bp, Unknown
  Artificiall/Consensus sequence
tcggagttttataatgagtttgtatatagcggccgtgggaagtttttcccgaggcgtaacgataaggagcaggtaatgcacgatttttttcgcagcaagggctttttgataatactgataataatagctgtgctgtctatattcatagcggccacataccgggacagggcaaaggtgtcctttattgaggatacggtaaactctgtggtcaagccggtacagagcttttccgttaaggcgtccaattccataatacacttttttgagagggttttcagctctacggatcttgataaggaaaacgagcagcttagggtaaagctggctcagtacgagataatcgaaagcgagctggagacgctgcgggaggaaaactcgcgcctcaaggatcttttgaattacactgatattaccgataactacagctatataacctctaccgtaataggcaaaagtcagggtatatggttcagtgaatttacggtaaatgccggccgtaaggacggcgttgaggaaaatatggcggtagtaaactcgcaggggctggtcggccgcgtaaacagcgtcagcgcaaatacctgcaaggtgaccgccataatcgacagcacctctgatataagcgccatggtggagcgcacacgcgactacggctttgcgcggggtatacttaataccgacgaaaaggagacgctggagctttactatctgccaagcggctatgacctggttcccggcgataccatagttacctcgggcataggcggcacctttccaaagggcatagccataggtacggtgaccgaagtatcccgctccagtgatgacgcggaggaaaggaacgccataatcgagccggcggtggattttctcaggctcgaggaggtaatgatagtaaaggtcgataccaaagaggaggaaacgacagagtaa

SEQ ID NO: 1601 - DNA, 690 bp, Unknown
  Artificiall/Consensus sequence
tcagtaaataatcgcgattataatctaaatcaaggaggggccctcatgcgagaggatcttacccaaaggcgtttcatcgaggagacctaccgtataatatcgaccgaaggccgtgaagccttgagcattcgccgccttgcgcgggacatgcgctgcaacagcgccaacatctaccgatacttcaaggatcttgacgagctggtgacgtacgcctcactgcgctaccttaccgcgtatctgggcgacgttgcggtgtgttacgccaaatccgaaactacataccagacccacgtagcggtatgggattgcttctcccaccacgccttcgcaaacggcccaatcttcgataacctgtttttcggccgccacagccgcatgctgaacgatattatcaagaactattacgccatgttccccgaggatctttccggtctctccccctccatcgccaacatattcagcgaaggcagcttcaacaacagggactatctcatgatatcccgctgcgtagacgagggatggttcacggaggaagacgcaaagtttctcaacagcttctccatacacctttttctcggatacctcaaggagctattgcagaaggaaccttcggagaagctttcaaagagttaccatgacgatttcatggctactcttgtcaagatcatggattatttccggctgaaatag

SEQ ID NO: 1602 - DNA, 924 bp, Unknown
  Artificiall/Consensus sequence
atgattgattccctatttattaagaaaatgaggataaaggccatgaagacaagcgaaggttatatgccttttatgggacaccatacctattacaggactgtcggcgagcgtacagacaaggcgccgctgatactcctgcatggaggccccggttctactcacaattatttcgaggtgctggacagggtggcggaggaggacggccgtatgctcgtcatgtacgaccagataggctgcggcaactcatacgttgacggaaggccggatctatggacggccgagacatgggtaaatgagcttatcgctctgagaaagcatctggggttggatacatgccatctgctgggccagtcctggggaggcatgctgctattgacctatatctgcaactatgagcactcaggcgtaaagagcggcatactttccagcacgctgcccgcaagctggctgtggggcattgaacaggcacgcatgataaaggagctgccggaggaataccaggaggccataaaaacggctaccgagaccggcgactattccagcgatatataccagagggcagaggaagagtatatgctgcgtcacgccgcgggcaagcccgatcccaatgggcctgagtgcctgctgaggaagaaaaggacaggccgggagagctatgtcgttggctggggccctaatgagtacaccccaatgggtacgctgaaggattacgatgtaatagacaaactcaaggacataaaggagccctgcctcgtgatcaatggcggcaatgacctttgcacaccgtatatagccaaggtgatgtacgacaatataccaaactctagatgggagctgttcagggagtgccgccacatgtgcttcgtagaggacaacgaccattatgttgaggtgcttaaagagtggctcaacgagaaggattga

SEQ ID NO: 1603 - DNA, 828 bp, Unknown
  Artificiall/Consensus sequence
atgtacggatacatccagccgaatcaggacgagcttagaataagagaatataccgaatacagggcgtattactgcgggctgtgtaaatgtctcagcgccgaatacggcgaaatagcgcggagcgttctgagctacgactgtacctttatagctctcttgctttccggtctcgacggtactgacaatgtgcaaaagcgccgctgcgtatataagcctttatcaaagccgcgccttaccgcagccgccgacgatatgctgcgctttgccgctgatatggatgtgctgctggcgtattacaagctggaagacgactggcgggacgacaaaaatcccgcggctgtctgtgcaaaagctgcccttggcggcgccatgaaaaaggcggcaaacaggcagcctgaaatggatcgtgccatatcccggggcctgaaggagcttggcgagcttgaaaaagcgaactgctccgagctggatgccccggcagacgcctttgcccgaatgatgaaatccgtaggcctttctgcgcccattgagaaccggggagacaggatagccctcgcacacacgctgtatcacctcggccgctgggtatatttaatagatgcctgggacgacagggataaggataaaaagaaaggcagctacaatccgttcatcgcgtcaggcgcagataaggacagggcggagttcctgctgaactgttcccttaatgaggcgataaatgcttatcagcttttgaacttactatctcatgagggactgctggataatataatccttgacggctgccctgcaaaaaacagagaggttcttggaggaaaagatgaataa

SEQ ID NO: 1604 - DNA, 942 bp, Unknown
  Artificiall/Consensus sequence
aatatgaaaaagatagttatcgcacttggcggaaacgcccttcaggaagcgggcaagcctgcaacggcagaggctcagcttgaagtagtcgaaaagacctccgagtatatcgcggacataataggcgagggatataaggtcattattgcccacggaaacggccctcaggtaggccgcatagtgctccagaacgagtatgccacccctgtaagcccggcaatgccctttgatgtatgcggcgctatgagccagggctatataggataccacattcagcagggccttacaaaggtactgcgttcacgcggaaacaagtccgaggtggctactgtggtaactcaggtgctggtagacaggaacgatcccaagttcaaaaacccctccaagcctataggcccattctataccgaggaagaagccaagaagatagccgacgagaagggctatgtaatgaaggaagacgcaggccgcggctggaggcgagtagttgcgtccccaatacccgttgagatagaggagctcagcgcagtaaaatgcctggttgacaacggcttcgtagtcgtcaccgtaggcggaggcggtatccctgtaatacgcaacgataagggtgagctggaaggcacagccgccgttatagataaggatcttgcaagcgagaagctggcggaggatctggatgccgatgctctggttatacttaccgctgtagaaaaggtaagcatcaactacaagaaacccgaccagaaggatctggataagcttaccgtatcggaagccaggaagtacatggccgaaggccagttcgcccccggctctatgctgcccaaggtagaggctgctgttaagttcgtggagagcaagcccggcaggataaccataatcaccagccttgataaggcggtagaggctcttgacggcaaggccggaactaccatagcataa

SEQ ID NO: 1605 - DNA, 765 bp, Unknown
  Artificiall/Consensus sequence
atggaaaacacggcaaagcgaaaaagaaaaaagcgcgccttaaagcgcggcattctcataacggcgggggttatggcgttcctcgcgctgtgctatctggtatggacggggctgggagccataccgcttaagggcgaggcggagaatacctcctccgcagcggagcccatcatacccgaccttacgccggagcctgccgccgccccaacgccggacatagcgccggccggccgcaccgacagcctgtacgccgcctctctatacatagacaccaagggcaggcgggcagaagggcaggtgctcatagactacgtgagcaggcaggtggagacggtatactcccttgatatcggcctttatccaaacgccgtggctcccggatgcatggaggtgaccggtgtagcgctcaatggggaaatggcctactataccctggacggcccggtacttactctgccccttttgaacgagctggaccccggccaaagctgccggatatacataaggttctccatagaccttaccatgggctatggcaacggcctcgacctcatatgcccgttgcccctcgtggctgaggacagggacatgctggaggagccgggcgcaccggagtacggcgcgcctgcggagtaccgcgtgcggctctatggggatacgatgctcatcaccgagacctctttcgagcagctggaggcttccaccggctacatgttcggcgcggaaaaggcggtaaggttcgatgtgaaggtgaaacgagggtaa

SEQ ID NO: 1606 - DNA, 783 bp, Unknown
  Artificiall/Consensus sequence
atgaaacgcagaatgaataatttctttaaaaaggacggcaagtccttcgtgttggctatggatcacgcggcaatgatgccttctcccgatttgaaggatccgggacatgttatccgcgaggctgtggcaggtggtgctgacggatttctgactacctatggtattattaaggccttccagaatgatttcggcaatgccggtattataatgcgtgcggacggaggaatttctgcactccgcaaacctatgaatccccttagcctgctgtacacccccgaggatgcggtgcgcgtaggcgccgatgccatgctgtgcatgggttatccgggctctaccgacaatgagcacaccctggagtaccttgctaacctctgcgccgaggctgaaaagctcaacattccggtaggcgccgagatgctgccttacggctttgaaaagcacgatggcattgatacccgttctgttgagaatatgagctttgcctgcaggcagggcgcagagctgggcgctgattttatcaaggccgagttcgttgggggcgagcgtttccgcgaggtcgttgacggctgctacgcgcccatactggttctgggcggcggcaaggccaagagcgaggaggagatattcgccaacattcgcggcgctctggacgctggcgcaaagggtattataatgggccgaaatatctaccgtcacgagaatatagccgccgtttgcgcggccattgccgcgatagtgcatgacgatgccaccgttgacgaggctatgaagatgcttaaataa

SEQ ID NO: 1607 - DNA, 1122 bp, Unknown
  Artificiall/Consensus sequence
atggcggagtttagaatacccataaggatactttacggcgacggcacattggagcatatatccggcctccggggcgaccgaatgctgctggtacatgactgcgaggccgcgtgcaggatagcacagaagcaggcaaggcgcaccggcatgcacatacgggtattcagcgtgcccgaaggcccggtagacggcccgacggtactggaaggggcaaaggcgcttatggagttcaagccgggctggataatcgccataggaggccatgccgccatggactgcgcaaagctcatgcggatattctacgagcgtcccgaccttactccggacgatcttgtcaggtccgatataccaagaatgaagctggggcgcacacgtcttattgccgttcctgtcctcggctcaaacggcggcgaggccaccggctacgcggcgctatggaatcccagggaatgccttgagcaggttatatactgccccggtctcatgccccacgccgccataatcgacccgctgctgctcaacgccttacctcacacccataccggcgaagcagtattgtccgcactggcgctttccgtggaggcggccgtctctcccgaaggcagctttttcagccgccccttcgcaatgcaggccatgcataccataataagcagcaccatcgcgttttcctgcctgccatttccatcagagccgctgctcaacgcccagatactcagcggcatagcccactacaacgcctcccccggcctttgctctgcaatggttcacggatctatggggctgtttggctgtgtatccttcgggacgctttgcgccgtgtaccttcctgccataatacggcgttcaaccggccaatactccgagggctacgccgccatagcgtcggagttgggtctgaaggatactcccgaggctcttgctgcgctcattgaggaatatgcggacatgctggggctgccattgaagctctgcgagctggaacgggataaaaacgcttttttaaaaaagctcccccgccttacggcgagggtagcacagtgcggcgaagttgcccaaattatcccggatgacactcaaaaaaaggtagaggagctgttccgtcacgcctattccaaatag

SEQ ID NO: 1608 - DNA, 1461 bp, Unknown
  Artificiall/Consensus sequence
ggcaaagtaaaaacacagggggaaaacttaaaaatggaaaacaacaagggacaatggagctccaatttcggcttcctcatggctgccataggctctgcagtaggactgggcaatatatggggcttcccgtataagatgggtgcaaacggcggcggcgccttcctgatgatatacatcatgctggtagtattcgtaggcttcgccgtaatgctgggagagctgacaataggccgcaagaccggcaagggcgcggttggcgcatacagggcgctgaacaaaaagctcccatgggtgggctacatgggcgtaggctccgcgttccttattctgggcttttacagcgtgctgggcggcatggtaatgcgctatatgctgggcttcctcgttaatatgttcggcggcgcgggctttgcggcggagggcttcttcggctcatggatagccaatatgcccggcatggtgggcttttacgcgctgttcatgctgctcaatatagtgatagttatgggcggcatatccggcggcatagagaagttctcaaaggtggcgatgcccgccctggcggtgatgctggtgacggtcatagtatacgtcgcctgccagcccggcgctatggagggctataagttcatgttcgtgccggacttctcggttttcgacagcctcaagtccttcttcgacgtgctcaagtccgcggcgggccagatgttcttctcactgtcccttggcatgggcgcaatgataacctacggctcctatctctccaaaagcgaggatcttaataccaacaccataataatccccgtggcggatacaatagtggccataatggccggtatggcggtaatgcctgcctgttccgccttcggcatggattacggtcagggccccggcctgctcttcaataccctccagacggtattcgtggacggcatgggcggcttcataggcagcctcatgggcttcctgttctataccctcgtatttatagcggccataacctcgtcaatatcgctgcttgaggtaaacaccgcgtatatcatagacaagaaacttgaaaagggcaagaaggtcaaccgcaagagtataaccgtaataatggcggcagtgatattcatcgtgggcctgcctacggcgctggacggactcggcacaaacgtagcgggcggcgccctcatagacaaccccgccataaccttcggcctgcccacggtgggcgccacggcggattggctggacttttacgacatgatcgcggagggcatactcatgcccttgggctccctcgccatgagcataatcataggctgggtgttcgggaacaggatggtaaaggaggaggtcgcctgctccggccatgtataccgggcggaagggttctacaatatttgctttaagtacatcgttcctgttataatggtgatagtgctttacgcgcagatacagacattctttggctaa

SEQ ID NO: 1609 - DNA, 378 bp, Unknown
  Artificiall/Consensus sequence
agggtgaaacgctgtttttctttgaaacggaataagaccttccggtatgtctaccgcaagggcaagtcggtgccctccagaatgcttgtcatgatatacaataagtcaaagacgggcatggtaaaggtgggcttttccgtaagcaaacggataggcaacagcgtcacccgcaaccgcatcaagcgcaggctcagggaagcctttcgtccctttatacccgacataacgccgggctatgacattatcttcattgcgcgggacgcggttaaagaagccgatttcggccacatttcagccacgatgcaaaacatgctaacaaaatccggccttatgggcaacaataagaatgccgataaggcggccagggtacggcaatga

SEQ ID NO: 1610 - DNA, 672 bp, Unknown
  Artificiall/Consensus sequence
ttaaaaaggaaaaatagcctgagggctttggctttacggaaaatgaaatacggatacgttgtatttgacatggacggtaccctcatagatacctgcgaggcgatacagcagtcgcttagggataccattgtaatgcttaccggcaaaacgcctgcaaaggctgagatgcgcgccaccttcggcacgccgagcgatgtagggcttaaaatgctgggagtgagggacgaggacatccagcggggcatattgctctggagcgaaaatatcaaaaagtacgaggatacgccgagggcgtttcccggcgtgcgggagcttatggacgggcttaaggcgggaggctgccggataggcatagccacctccaagaacgcggcggagcttgagcacagccgcgaacagttcggggatattgtatcccgtgcggactgcgtaatatgcgcggacgatacggcagagcacaagcctgaaccggggccgctgctcaagtatatggagcgtaccggcgcgaaaccgtcagaggtgctttatgtgggcgatacggtgtacgacatgcggtgcgcccggggagcgggcgtagatttcgcccttgcgcgctggggcaatccggacggcagggtggatgcggattacgacgagccgacgcctctggcactgctggaaaaactcagataa

SEQ ID NO: 1611 - DNA, 1500 bp, Unknown
  Artificiall/Consensus sequence
atgttcagtgacggaaggttacttataggcaagggtgaaaaggaagtatatttagagcctaagatggccaacaggcacggcctcatagcgggcgctacgggtacgggaaagaccataacgctgaaggtcatggcggaatcattctcggatatgggcgttccggtatttctggcggatataaagggcgatctgggcggctgtgtaaagaagggcgccgagaatgagaacataacaaagcgtctggattccatgggaataagccgcgatgaattcatattcacaggctaccccgtaaggttctgggatgttttcggagagggaggccaccctgtgcgcaccaccgtaagcgagatgggctccacgctgctttcgaggctgctgggcctgacggatgttcaaagcggcgtaatggatatagtattccgcgtggctgatgataagggctggctgctcatagactataaggatcttcgggcaatggtgagctatgtagcggagcactccaaggagcttctgaatgactacggcaatgtcaccaagcagtccgtaggcgctatacagcgctcactcctgcgtctcgaggatgaaggcgcggaagctttcttcggtgaaccgagtatagatataagcgactggatacagaccaacgagaaagggcaggggtacataaatatactgcattgcgttaggctgtaccattccccgctgctttactcgaccttcatgctgtggctgctgagcgagctgttcgagacgctgccggaggttggcgatctggaaaagcccaagctggtgtttttctttgacgaggcccatctgctgttcaagggcgcgcctaccgcccttgtagacaagatagagcaggtggtaaagctcatacgctcaaagggcgttggcgtgtacttcataacccaatccccttcagacgtgccggatacggtccttgcacagctcagcaacagggtgcagcatgcgctcagggcatatactccctccgagcagcgtgcggtaagagctgcggcgcagacattccggccaaatcctgcattcagcacggaaacggcgataacagagcttgcgacagggcaggcgctggtgagcttcctggacgcaaagggagtacccggcatagttgaaaaggcaatgatacttcctcctcagtctgctatgggtcccatagacgatgagcgcaggaaggccgagatagaggcggacgatctctacggcaagtatgaggacgaggtggataacgagtccgcatacgagataatcaacgccgagcgggaggccttgctgaaggaggagatagccgcggcaaaggagcagcaaaagcagaccgccaatgaggcaagggaaaaagaaaagaaggcatccacaggcggaagaaagaaaaaaactgctactgagaagatagccgataaggccatgaacaccataggccgcgagataggcaaatccatatcccgggggcttctgggttcgctcaaaaagtttatgtaa

SEQ ID NO: 1612 - DNA, 951 bp, Unknown
  Artificiall/Consensus sequence
atgaagaaaacgattataacagccatattggcggctatgacacttttgctcataggctgttccgccaacaatgaaaggatagacctgactgacccgcttagcggcagttcaatattgtccgcggcggatcttgaggccttcttcaaatacggcgagaacgacacggccgtgcttgcggcctcattcagcatggaggataccatgctcaagcttactgcacagcggggttccattacgatagatggcaatggttataccctaagcggcactggggactgcataatacgccttgacgagggctgcaagcttacgctcaacgatattacggtacacagcggatcaacggctatcggctgccttggttcagctgagataggcggcgaaaacgccaacataataggcgtgtcggacggaatactctgcgccgatgagcttatcgtatccgagggaagcagccttgtatgtaagggcagcaacggccggggaatagacgccgaggatataacaataaaggccggagccagcgtatccggggagggagtactgggcggagtcaactccagatcggatataactctggaaaggggcgcgtcccttgcggcgtataccgatgaaaactacaatgcactgaaatgcgatggacagctttcaatggcggacggctctgcgcttaccgtagaaaatcgcggcaggtatcacggcgctgaaatttatgaattcgcaattgaaggtgctgtgagcataaatgccgccggcggcagcgaagcaactggacttttcataaccgagcagcattccaatatgtacgctgtcggcagctgcaagccggaagctcgcgttgagaatggcaagggcaggataacctttgtggacgatgcttcaaaaatacctgccgagataccccaaccggacggctatattgaggagacggcggaaacagaagaacagtag

SEQ ID NO: 1613 - DNA, 711 bp, Unknown
  Artificiall/Consensus sequence
aacagagcttttaaacggataaggaggttacacatgccgcttactatagaacatcatgccgtaatgttcgcgctgctggcaaagcacgccatagagatttcaggtgaaaagggaaaagaagccatactcgccggaatgacccgttacggcaacgagcgtggccggcgcatggcgctgaacgcccttgagcggggcgataagctcaccgtactcaacagccaggtatacggcgaatggaagcctgactttccgggccagatggaattcggcgtaacctgcggcatgcctgtcctccatacctacatagctaagtgcgcctggtgcgacgcatgggcaaagcacggcctcacagaatacggcaagtactactgctgcaacatagacaacgcctggtttcagggcttcaatccggaattcacctgcacccagctgaacccgcccatgagctggggcggcgactgctgccggttcagctggggcgaggggctgacccacaagcagataaaggcgctgaacaaaaagaaaaagtccctgggcaatgcctgcataaaggactttacctttcacaccgcccacatactgcatactgtaggagacgtgcttatggaagagctcggcaacgacggcgctatggctgttagccttgccaagtccgactattcggatatgttcgggaatgacgcccttgactgccttgacggcatattctaa

SEQ ID NO: 1614 - DNA, 1017 bp, Unknown
  Artificiall/Consensus sequence
gtgataaacatgagcgaaaatactacacatcttcttagcgtaaaagacctgcacacctccttcaccaccgaccacggcgaggtgcaggcggtaaacggcgtatccttcaacctggacgccggaaaggtgctgggcatagtgggcgaatccggctccggcaagagcgtcaccgcctactccatcatgcagatactggccgacaacggccgtataaccagcggcgagatactctataaaggcgaggatatatcccgctggggcgaatccaagatgcaggatttccggggcaagtgctgctccataatcttccaggatcccatgaccagcctcaacccggtattcaccataggcagccagatagccgaggcggtactgctgcacacaaagagcagcaagcatgaggccatggaaaaggcccttgagatgctgaagctggtcggcataaacgaacccgaaaagcgcctcaagcagtacccctacgagctgtccggcggtatgcgccagcgtgtcatgatagccatggcgctggcctgcgaaccggatatacttatagcggacgaacccaccaccgccctggacgtgaccatacaggcacagatactggagctgatgcagagtcttcagaagaagcttggcatggccataataatggtcacccacgacctgggcgtaatagcggaaatgtgcgacgagatagtggtcatgtatggcggccgcttctgcgagcggggtactgccgacgagatattctataatccccgccacgagtacaccaggggcctgctccgcagcatacccaacatcaccaacatgaaggagcgcctggtgcccatctccggcacccccataaacatgctgaacatgcccaagggctgcgccttctgcgcccgctgtgacaaggccatgaagatatgccttgaacaggtgcccgaggaacgcataatcaacgagtcccacagggcgtcctgctggataaacacccgcgataatatcggaactgttgaggaggctgaataa

SEQ ID NO: 1615 - DNA, 1128 bp, Unknown
  Artificiall/Consensus sequence
atgcaagataaattcgacttcaaatacgagcttctgcacgtttgcaagcagtccggcgcccgccggggcaggctgcacaccccgcacggagtaatagagaccccctgctatatgccggtaggcacacaggccacggtaaaggccatgcttccccgggacgttaaggaagtaggctctatgataatactttcaaatacctatcacctctttgagaggcccggccatgagcttataaaagaggcgggcggcctgcatgagttcatgcggtgggacaagcccatacttaccgacagcggcggctttcaggtgttcagcctcgcctccgccaataaaataaaagaggacggcgttgagttccgctcccttctggatgggcgcaggcatttcttcacccccgagcttgtaatggagatagaggaagcccttggcgcggatatcgccatggcgttcgacgaatgcgccccttatccctccgaccgggaatacaccatagctgccatggagcgcacccatcgctgggcggtgcgctgcaagaaggcgcatacccgcccggatcaggcgctcttcggcatagttcagggcggcatgttcgcagacctcaggatagagagcgctaagtttctcgcttccctcgacctgccgggctatggcatcggtggtctttcagtgggcgagcccaaggaaatgatgtacgatatgctggagcagatgatgccctatatgcccgcaaacaagccccgctaccttatgggcgtgggcagccccgactgtctggtggagggcgctgtacgcggcatagacatgttcgactgcgtactccagacccgtatagcaaggaacggccttgcgctcacgggaagcggcaaaaaaatgctgcgaaacgcctcctttgagcacgacttcacgcctatcgaggagggctgcgactgctacgcctgcaagaacggcttcaccagggcatatatacgccaccttgtaaaatgcaaggaaatactggcggcacagctcataaccacccacaacctgcgcttctctctgaggctcatggagcaggtacgcgaggccatagagcaggacagactgctggacttccgggaagagcttaaagcgaaaggaacattcgattga

SEQ ID NO: 1616 - DNA, 963 bp, Unknown
  Artificiall/Consensus sequence
atgaagcttggaaagctgagcaacgataaactggatagtctgatactcagcaaattcggacatatgaggaaagaagtagtctgttccccccatgtgggagtggactgcgcggcggtagaccttgggggcaggatagctgtgctgtccaccgacccaataacggccgcagataaaaatataggcagccttacggtacatgtgagctgcaacgacgcggcggcggccggcgccgagcccataggtctgctggtgacgctccttataccaccacatggcacggaagaggaggtagagcatatagcccaagagctggccgaggctgcgaagcttgcgaatatagaaataatcggcggccataccgaggtaaccgcttcggtgacccgctatgtcacctgtgctgcagtaatagcccgggcgggtaaaaacggcattatcactcccgccggcatgaaggcagggcaggatataatcatgaccaagatggcgggcatagaggggacggcagttatagcctcagacgctgccgggcgtaccgggctgacagatgccgaactggaggaagcacggggctttatgtccatggtaagcgtagtcaaagagggactttacgctgcagagcacggcgccaccgccatgcacgacataaccgaaggcggcgtgttcggcgccgcgtgggagatggccgaggcttccggctgcggcatggtgctgtatcccgaaaaggtgcttatgcatccaataacccaaaaaatatgccagaagttcggcatcgacccttacaggctgatatccagcggcagcatgcttattgcctgcgacgacggcgaaggcatggtgaagggccttgccgccataggcatacctgccgcggttataggcaaggcggtagagtctggcgtgagcaccgctgacggaactgagatactggcccctgaggcggacgaattatataagattatataa

SEQ ID NO: 1617 - DNA, 1446 bp, Unknown
  Artificiall/Consensus sequence
atggcaaagaaagaaaaccagttcgttcaggagattacccctcgcgacgtggattttgcgaagtggtataccgatatcgtgctcaaaaacgatatgtgcgactataccgatgttcgcggctgtatggccattaagccttacggctatgccgtatgggagctcatgcagaaggaaatggatcagcgcttcaaggatacaggtcatcagaatgcatacttccctctgctgatacccgaaagcatgctgatgaaagaggcggagcacgttgaaggcttcgcgcccgaggtcgcatgggtaacacagggcggcaacgaggtgcttcaggagcgcatggctatccgacccaccagcgaaacgataatcggaaccatgtattccaagtggatacagtcctatcgcgacctgcccgtgctgtataaccagtggtgcaacgtaatgcgctgggagaagagcacccgccccttcctccgtacttccgaattcctctggcaggagggccataccgcccatgaaacccatgaggacgcgcaggaagaaaccatccgtatgctcaacgtatactatgattttatggtaaacgtgctggcgatccccgtagtacgcggccgcaagagcgagagcgaacgctttgcaggcgcagaggccacatataccctggaagcgttgatgcatgacggcaaggcgctgcagatgggaacctctcataacctgtcggatcactttgcaaggagctatgatatcaagtacctgagccgcgagggcaagcaggaatactgctatactacctcctggggcacttctacccgcatgatcggcggtatgataatggttcacggcgatgaccgcggcctcaagctgcctcccaaagtagcccccattcaggtagtcatactgcccatcgccatgcacaaagaaggcgttctggagaaggcaactgagctgtataacgagataaaggcatcgggtcttcgcgtaaagctggacgacagcgagcagagcgcgggctggaagttcaaccagtgggagatgaagggcgttcccgtccgtatcgagataggccccagggatattgagaacggcgtggtgaccgtagtgcgacgcgataccctcgagaagttcaccatgccgatccaaggcataggagaaaacctcgtaaagctcatggccgatatacatcagaccatgtacgatatggctcttgaacaccgcaaggctcatactactcacgccgaaaacttcggcgactttatggacggtgtaaagaagggcttcgtaaaggccccgtggtgtgctgatccggattgcgagatggaaataaagtgcgttaccggcgcgtctacccgctgcaagcccatggatgaggatacgactgtaaagcccggctgtaagtgcgtattctgcaaccgtgaggcaaagaccatgatgtatttcgcaagagcgtactga

SEQ ID NO: 1618 - DNA, 483 bp, Unknown
  Artificiall/Consensus sequence
aacaagcctttcgggcttgtgtgctcttgtcaactgatggtaaaggagaaattaaccatgatatctaccaggggaaggtattccatacgcatacttttagatctggcggagcacaacacaggggcgtatatccccataaaggacgtggctgcccggcaggatatatcacttaaatacatagagcggataatgccgcctctgaaggccgcaggttttatcgaaagctctcacggcataggcggggggtatcgtcttgtccgggatccggataggtataccctgtgggatatactcagagtggcggagggggatcttgctccggtggcctgccttcaggagggggcggctccctgcaaaatggctgcggagtgcaagacgctgcccgtatggcagggctattacgatatgacaagggattacttctcaaatataaccctggcggacctcatgaaggcgccgatggcagacaattatgtgatataa

SEQ ID NO: 1619 - DNA, 711 bp, Unknown
  Artificiall/Consensus sequence
atggtaagggtccctgataaagctttggttgcaaagtatagcactatgatgctaaaattaacctttagcagggaaataacaggaggaactgtcatgcgaagtatccaaaccagaacgatagtgctttacgggctgtttatcgccgtgatttttcttctgggacttacgccgcttggctatataaaccttcccatagcagccataaccacggtgcatatcccggtgatagtgggcggatatgtgctgggcaaaaagggcggagcggtactgggattcttctttggccttaccagcctcatgcgctgctttaccacaccggacgccacggcggcggtgatactcggaacaggcacaggatttggagcgtataacctgcttcttattctggcggtcatatttcttccacgtatactcaccggactgttttcctccgcgctgtatgagcttataggcggtaccggcaagaggcagatagctgccatgggtgtaagcgctttcgcaggcagtatgacaaatacggtattttacctcggcggcctgtatcttctggccttcgaacagaccgcaaacataatgggggtggcgggcagcgcgctgctcaaggtgcttctgagcatagtggctttcaacggcgtgcttgaggcaatggccgcagtgatactttgtactgcggtaggcaaggcgttgagcgcgtacatcaacaaaaaataa

SEQ ID NO: 1620 - DNA, 522 bp, Unknown
  Artificiall/Consensus sequence
ggcggcgcaagccggctgcacgcggcgtctgacccgcgccgtgataacccacaaggcgggtgctcatacgggcgcccctgcaaaggcgaaagccttatgcacacagctcgccatagctgtgaaaccaaatttattacggaggtaagtaaatcaatggcacgtatttctggcgttgacctgccaagagacaagcgaattgagatcggcctgacctacatttacggtatcggccgcaagaccgcttcggacattctcgcagctaccggcgttgaccccgacattcgcgtacgcgatctgtccgaggatgacgtgagcaagctcagagagtacatcgaccaccacgtaaaggtagagggcgacctcaggcgcgagacttccatgaacatcaagcgcctcatcgagatcggctgctatcgcggtgttcgtcatcgtaagggcctgcccgttcgcggtcagagcaccaagcagaacgctcgtacccgcaagggtcccaagcgcgctgtaggcggaagaaagaagtaa

SEQ ID NO: 1621 - DNA, 1914 bp, Unknown
  Artificiall/Consensus sequence
atgaagaatataatagttggcacagccggacacatagaccacggcaagaccaccctcataagggcgctcaccggccgcaataccgaccgctgggaggaggagcagcgcaggggcataaccatagacctgggctttacctggttcgacctgcccagcggcaacagggtgggcataatagacgtgccggggcatgagaagttcgtaaacaacatggtggcgggagtagtgggcatggatcttgtgctgctggtcatcgccgcggacgagggcataatgccccagacccgggagcacgtggatatactggggcttttgggcatagaaaagtgcataatcgtattgaacaagtgcgaccttgtggacgaggactggttagagatggtaaaggaggacatacgggaggagctgaagggcagcttctgcgagagcgcgcccatggtggaggtttccagcgtcaccggggcgggtctggacaacctggtgagcctgatcgagcacatggcagaggaggaggtcacccccaaggacatagacaccataccccgcctgcccatagacagggcattctccatatccggattcggcaccatagttacaggcacacttatttccggccgaatacgcaaggaggatcagcttgaaatatacccggtggataaaacctgcaagatacgcagcatacaggtacacggcaaggatgcggaggagtgctttgccggccagcgggtagccataaacctttccaatatcaagaagaatgaaatacaccggggctgcgtgctggcccccgtcaacagcatgaagaacacaatgatgctggacgtgcggctgcgggtgctgccctcctcaaacagggtaatagacaaccgcacccgtctgcacctttttaccggcaccagcgaggtgctctgccgggcggtgcttctcgataaggacgagataggcccgggcgaaagcggccttgcccagctccgccttgagggcgaaatagccgtgcgccgtggggacaggttcatagtgcgcttttattcgcccatggagaccatcggcggcggcgtagtcatagaggccaaccccgcaaagaagaagcgatttgacgaaagggccatatccgagatgaccgtcaaggaagagggcggccacggggatatgatagaactgataatcaagcagcacagcgattccgccataaccgcggcggaggtggcgaagctcaccggccttaccgccgaggagaccatggcggaggtggaaaagctcgcggagcaggggcttgtcgccacattccccatgaagaaggatatctatcttatgcacgcctcctaccgggacaaggtggctgacgatatggtggcataccttgaggatttccataaaaagaacccgtacaggctgggcagccgcaaggcggagcttagggtgcggtttttgagcaagctcaagcagaacgtatttgacgaattcatgcagcgccttgaggacacgggccgcataaagcgcagcggcgagtttatctgcgaggggggctacgagataccccacgacgaggtatataagcaattcgaaagcgccctgaccgccatgctggacaaggcgggctttgagtttataaggcttgccgacatacagcttcccggcatacagcctgccatggcggaggatcttttgcagcttttagccgccgagggaaaggtggtgctgctctctgacgaccttattaccctgcccaagtataccgacatggttgcggccaaggcaagggaaatactggccgccgagggcaagatctccatcgccatgatacgcgacatgataggcaccagccgcaagagcgccaagccgctcctcgagtacctggacaatatacgcgtcaccaggcgaaacggcaccgagagcgagagggtggcgtattaa

SEQ ID NO: 1622 - DNA, 1038 bp, Unknown
  Artificiall/Consensus sequence
atgggtaaactgatacgcagaatgggtatacctacctttgccgtttccgcgctgctcctcgttgtgcttatagcggcttacgtcatgggtcagtcattacccgtgcttttcaccgatatactgcgccgcgtaggcatgaacggcatactggtgctggcaatggtaccctctatcaagtccggcgtgggtccaaactttgcgctgcctatcggcatagtcggcgggctgttcgccctcatgtgctgtatgcagatggaccttatgggctggagcctcataggctgctccatactgctggcgataatcatctgcggcctgatgggctgggcctacggcaagctgatgaacgccgtcaagggcgccgagatgaccatagccacctataccggcttctccatcgtggcattcttcaacatactctggctgtcgcttcccttctccaaccgcaaaatgggctggatgctgggcgacggcctccgcgagaccatacagatggacggctttgccgcggacaagatagtttccaacttcctgtccttcaatataggcgaggtcaccatacccaccggtatgatattgcttctgctgctgacctgctttgtagtcagcgtgttcttcaagaccaagaccggcctcgctatctatgcgggcggcgtgaatccaaagttcgcagaggctgccggactcaacatcgaccgcagccgcgtaatagcgaacataatctccaccgtgcttgcgggcattggtatcataatctactcccagggctatggttacgctcagatatacaacggcccgctgaacatggcgttccccgccgtggcggccgtgcttatcggcggcgctactgcgactaaagccagctgcgtgaacgtcgtagtcggcgtgtgcatattccagggccttatgaccgctgcaatgcccgtggccaacgcgctcttcaccggcaccgacctttcggatatcatgcgtcaggtcatacagaacggcgttatcctctacgccctcactcaggtcaagaaaggaggcgacaggtaa

SEQ ID NO: 1623 - DNA, 975 bp, Unknown
  Artificiall/Consensus sequence
atgaagcgaattgccgtattagccgttgcgctggccgtgctgctatctgtcggctgtcaacagcagcctgtggataagcctcaggcggaggctacggagagccctgaggctactcccgatcctactcctgtagttactcctacgcctgtcccggaggagacagaggagccgtatgtatttccctatgagtcaaggctgatagaggcaaaagacaaaaataacgacgtggtaggctatatatgtatcccgggtacaaacatagattatcctatactatatggcagagactggtggttctatgccgaccatgatataaatatggagaagaacggcgtagggtctgtgtattcccatttcaacatggcctcctatgaattctttaatacgcagcagaatctggttatagcggcggcaaacgcacgcaccagccgcaccctgttccatgagctgcaccatatacaggaagtgaatctcggcaagacccattgcgcctataagcagtgcaacgcggagcttgaccccaccgtgctgccggatttcagcaagcccgaggggcgcacatgggatatcgctatatgcggcatagaggcacagtgggagatatgggccatgtacgaggccggcggcgacaagggacaggtgaattataatacctggtaccccaagaagaacgaaaagaccggcattatggaatacgtgcctgcggacgaggaagatgtccagaagtggatagatacccagctgaaaaacagccagtatgattttggcgtagaggtgacaacggaggatcagttccttaccatatatacatcgggcgacgagcacgaccccacggatgactccgcacggctgtattttttcctgaagcaggtgaatccaccttctgagaggttcaggaagcagagcggcaacgcgggagaggccgctgaaaccccggttccggaggcagagaccacgacagcgccaacggcataa

SEQ ID NO: 1624 - DNA, 477 bp, Unknown
  Artificiall/Consensus sequence
atgaagaagataaggataagcgcggtgaccgccggcatcataatcgccactgttgcggtagccgcccaggtaatattcggcttttcccaccccgaggcatacggcgtctgtcttgtgtgccacggcagggatatgctggcacagctataccagacggtattccataaggctatggatatgtcggtatccgcccgctccggcccggtgctgaccgtcataggcatacttgcgggcgcgttcataggcgcagtatccagcggtgagttccgctggcagtgggtggaaggcaagttcgcttcctttcttcgcggcatagtcgtggccatttgcgcccttataatttccggctgcccaatgcggctgatgatacgctccgcatacggcgacgtaaaggcgctgctgggcgtcatagcccttatgctgggctgcgtggtcggcactctcatactcaagaagcgcagccgcagaaaggactaa

SEQ ID NO: 1625 - DNA, 1209 bp, Unknown
  Artificiall/Consensus sequence
atgaattacaccgcagacgaagtgatgcagtacgcggcagaagaggacgtaaagttcgtgcgccttgccttctgcgatatccgcggcaggcagaaaaacatagccatactgcccgacgagctgggacgcgctttcaggtacggtatagccatcgacgcctcagccatagcgggctttggcggcgaggtgcattccgaccttttcctgcacccggacacctccaccctaaccttcctgccctggctttcagagcagggcaaggtaataagaatgttctgccacatagcttaccctgacggcactcccttcgaggccgatacccgctccatactcgccaaggctgtagattgcgctcatgaacagggcgtgtccttcgccttcggctccgagatggagttttatctttttaagctggatgaaaacggtgagccgacgaagctgccatacgacaacgccagctatatggacattgcccctgaggacaagggcgaaaacgtccgtagggaggtatgtttcaccctggagcagatgggcataaaaccggaaagcgcccaccatgaggaaggccccggccagaacgagatagacttccgctactccgaccccgtgatctctgcagacaacgcggtgactttccgcggcgtcgtgaatacagtcgccgcccgcaacggactttgcgccgacttttcgccaaagcccctcgaaaatcgccccggcaacggcatgcacatcaatatatccgtcaggtcggaggacggcggcgatgcgctgcctcaggtgatagccggcatactatcacacatatccgatatgacggcatttttaaacaccaccgaggattcctacctgcgtttcggcagcaataaggctccccggtacatatcctggtccagcgagaaccgttcacagcttatacgtatacctgcggcagagggcgaataccgccgggcagagctgcgctcccccgatcctgcctgcaacccttatctggccttcgcgcttataatatacgcagggcttgacggaattcgtcaggatatggcgctgcccgaggcggcggacattaacctctatacagcacctgaagatgtcagggcaaaatttgcaatgctgcccagcactcttaaaaaggcgcagtcagccgcagcgcgcagcagctttatagcggcgagcctgcctcaagctataatcgacttttacacaaaataa

SEQ ID NO: 1626 - DNA, 1332 bp, Unknown
  Artificiall/Consensus sequence
ttggaggatgatcttactgtaatgaaaagacgactgctctcacttgccctgtgccttgtaacgctcctttccctcacgccgtctatcgcccacgctgaggtcctgtccggctttaccagcaaggtggattacgataataccgatcccaacaggtacagcatagagatagaccttgtgaatcaggtcataaccgtatacgaccagagcggcaacgcagtgttgcaaagcctctgcaccaccggcagcgagaaaacccctaccggcagcggcaggttccggctgggcgacctcaaggagcgctttggctacttcgtagcttacggcgaatacgcccagtactggactcaggtagtgcgaggcgtatacatccattccgtaatgtacaagtccaagaagctttcctccatgtccaaatccgcctacaaaaacctgggcaagaatgtctcccacggttgcgtcagggtgctgccccacgtcgcccagtggatatactacaactgcccaccgggaaccctctgcaacatagtaaagaacaaggcggcaaacccctaccttgtaagccggctcaagagcaccatacccgattacagcagctaccagcagccttccgattcccacgccaccccttccgaggtgcccgctaccgttaagctgaacgatgttcccgtccgttccggcttctccaacagcaaggataagactgtagccaagctcaactatggagaccatgtagagcttttacagataggcgccgaatggtgtaaagtacgcacccccgcgggcaagctgggctatgtcaagaccatgtatctcacctgcgaccctgacaacgtgcgcaccacccaatcctatgccgccacaggcaagacctatatctactccagcgccagccgctcctccagtacccttaccaccataccaaagggtaaaacggtaaatgtcaccgagcaggccggcagcggctggctgtacggaagctataacggcgtatccggctatatgcgcacaaaatacgtaaagctcacagatacgctgctctaccccaacccggacggcagctatcccgacgggacctccgtcgccgccgcgcctcaatcccagacacagactcagaccggtacaggatcagcatccgctccctcctccggtgcgcgtgtaaaaagtggcatcattgccaatttccgctccggtcccggctccgagtacggcgttatagccgagctggaacccggtacccctgtaaggatcatctccgtagccggcaactggtacttctgcgaggtaaacggccttcagggctacctgcatccaagctgcgtagtgggcttctaa

SEQ ID NO: 1627 - DNA, 1326 bp, Unknown
  Artificiall/Consensus sequence
gagctgctcacggaaaaggattaccgctccgtaaagacgctgctgaccgcctgtacgccgcaggatatcgcactgctgctggatgacgtggcggcggacgatgttttgctgttgtttcgcctgctgcccaaggagcttgcggcggagacttttgtggaaatggacagcgatctgcaggaacggctccttcaaagttttaccgatacagaactgcgcggcgttattgccgagctgtttgtcgatgacatggtcgacatcatcgaagaaatgccggcgaacgtggtcaaacgaatccttgccagcgctgatgctgagacacgtgcagccgtcaacgagatcctgcactatccgccggacagtgcggggagcatcatgacgaccgaatatgtccgcctgagcgaagagatgacagtagaggacgcttttgcccgcattcgccgcgaaggcgttgacaaggaaacgatctatacctgctatgtcacggcagcggacaggcgtctgatcgggctggtcacggtgaaaacgctgctgttgagcgataaagccacaacagtgggcgaaataatggagcgcaatgtcatctccgtacgtaccgacaccgaccgtgagctggtggcacaggagttaagcaaatacgattttctggccatgccggtgaccgacggcgaaaatcgtcttgtcgggatcgtgaccttcgacgatgcaatcgacgtcatgcaggaggaggcaacggaggacatcgaaaagatggccgccatcacaccgaccgacaagccataccttaagaccggcgttgtggaatcgtttatcaaacgcattccctggctgtgcctgctgatgatctcggctacctttacgggagccattattacctattttgaagacgcgcttgcaaaagcggtgatcctgacggcgttcattccgatgctgatggacacgggcggaaacgcgggcagccaatcctcggtgaccatcatccgcggtttatcgcttggcgaaatctcgatgcgcgacatcctccgtattctctggaaggaaatgcgcgtagcgctgctgtgcggcgttgccttaggcatcgtgggcttcggaaagctgatgctgctcgaccaggtgggcctgcgggtggcactggtcgtgtgcttcacgctggtcgtaaccgtattgacggccaatctggtgggcgcgacgctgccgatgctggctaagcgtctgggattcgacccggcggtaatggcaagtccgttcatcacgacgattgtagacgcgctgtcgttgttgttcttctttaacattgcttctatgctcattcccgagctgcggatgtaa

SEQ ID NO: 1628 - DNA, 1746 bp, Unknown
  Artificiall/Consensus sequence
ctccggcttggaggttatatccttcaatactggccgctgttcctgctggctgtcttgctgacgcttgcctccaaccagctttcgctgatggggccaagctattccggcgaggccattgatgccattgcggcggaaagcggcgtcaattttgaagcagtctggacgaatgtcggccggatgctggtctgctacgccgcatcggccgttttatcctatgtgcttgccattttaatgatcctgctcagccaacgtattgtttatacaatgcgaaaacagcttttcgaaaaactcacctcgctgccagtcagttacttcgatacacataccaccggcgacatcatcagccgcatctcttacgatattgataccgtcaacgcatcgctttcaaacgacttggtacaggtgatgacgagtatttataccgtgattggatcgctgatttttatgtggcagatttcaaagccgctcatcgcggtatttgccattacggtgccgatttccatctttttcaccaggttccgtgccaaacgtgtgcgtccgctgtttcatctgcgttcgcaaaagctcggcgagctcaacggttacgcggaagagatgctttccggcggcgcaacaatccgggcttacggacgtgaggatgaaatcagcagccgcttcgctgcgcggaaccgtgaagccatggacgcgtattacaacgccgaatattacggtgccgcgctcggcccgtcggtcaattttatcaataacctgtcgatctctctggtgatgatcttcggcggtatgctttatatgttttcgcagagcggtacagccgttcccggctcactgttcttcattacgctcggcggcgtggcgcagttcgtacagtattcgcgcaaattcgccggcccgatcaatgaatttgccaacattcttaatgaattccagtcggcattcgccgcagcggaacgcattttccgtattatcgatgagcagcccgaaatcgcggatgttccgggtgcgcttccgttgtccaatgcagagggaagggtggaggtggaagacgtcaacttcggttatacgcccgaaaagcccatcctcaaatcgctttcggttcgtgccaatccgggccaaacaattgccatcgtcggcccgacaggcgcaggcaaaacaaccatcatcaatctgctgatgcgtttttatgatgtcaacagcggccgtattctggttgacgggcacgaaatccgtgaggtgcagcgtgattcgctgcgccgtgcatacacaatggttttacaagacacttggctgttctgcggcacgatttttgaaaatatcgtttacggccgcgaaaatgcgactatggaggaagtacgtgcagcagccaaatccgcgcggatcgattcatatatcgaacgcctgcctgacggttataacacaatgctgtccgacgacggcgtaaacatatccaagggacagcgccagcttatcaccattgcgcgcgccatgctgtcgaatacgagcatgctcatccttgatgaggcgacctccaatgtcgactcgcggacggaaatcaaaatccagcaggcgatgaacgaattgatgcgcggccgcacctgcttcgtgattgcacaccggctctccacagtgcgggatgccgatctcatccttgttctaaaagacggccgcgtgatcgaaagcggcacgcatgatgatctggttcgtctcggcggattttacggttcattgtacaattcacagtttgaataa

SEQ ID NO: 1629 - DNA, 1368 bp, Unknown
  Artificiall/Consensus sequence
gtacagaacaactttgaatatccgttttaccgcctttacggaaaccgcgatgcgaccgatatacatggccagacgaacttcgtcaaccggctcaacgcacgtttccagcttgcggctgccaatacgaagcatttgtatatccacgacctgaactataccgcctcctgctacgggctggaccgctggaccgaccaatcggtatggtatatgtacaaatacgcaatggctctggaagcgatcccgtcgctggcgcatcaggttacatcaatcatcaaatccattttcgggcggaataaaaaggtgcttgcgctcgatatggacaacactctctggggcggcgtggtcggcgatgacggcccggaagggctggagctgggtgaagaaacgcccaacgggcaggcttacctggagttccagcgctatatcaagcggcagaaggacatcggcgtactgctgacggtctgctcgaaaaacgatccggagaacgcgctggccggtctgcggcatcccgattccgcactttcgcccgaagattttcaggtcatccgcgccaattgggagccgaaggatcgcaacattgcggaaacagcgcgtatactgaaccttttgaccgattcggttgtctttgccgacgacaatccggctgaacggcatatcgtggcgtcttcgctgccgtcgacggcagttccggaaatggagggagtggagaattatatccgcattctcgaccgcaatgcatacttcgaagtcacttccctgtcggctgacgatctgcggcgcaacgagatgtacaaggaaaatgcgctgcgcgaagcagagcggcagagctttgcggattattccgattatcttcgctccttggacatgcagggtgagattcttcccttttcgcagacctatatgcagcggatcgcacagcttaccaataagtccaatcagttcaacctgacgacaaaacgttacaccgcagcggaaattgaggcagtcgccgccagcccgacgcacatcacgctgtatgggcgactgaccgaccgattcggagacaacggcgttgtagcagtcgtaatcggtgaaatccgcggctgcgagctgcacatcgacctgtggctgatgtcctgccgtgtactgaagcgggatatggaatatgcgatgcttgacacgctggtcgaaacggctgtctcacgcggtatcacaaagctgatcgggtattactaccccaccgcgaaaaacgggatggtgcgcgagctttacgccgatttcggctttacaaaggtggccgacaatgacggaagcaccgtctgggagctggaaactgccggctatcaaaagaaaaaccggttcattactgtaaatggaggaacgaaatga

SEQ ID NO: 1630 - DNA, 1251 bp, Unknown
  Artificiall/Consensus sequence
atctgccgcggcgtccatatgaccgcactgcggacggacaaattcaaattcggcctgctttccctctccttcattctgccgctgacagccgaaaacgcctcggcggcgaatctggctgccagagtactcaaccgcggatgtgcgaagtacccgacgcttcgcgacatatcgctcgagtgcgaccggctctactccgcttccattacggcgggctgcagcaaagcgggcgaagcgctgatgatgtctttttacgtcagcacgctcgacaacgcctatgccttcgacgggacggacgtattcggcggcgtgacggcgctgctgggcgagctgctgcgccggccgcttttggaaaacggcggcttcaagcgcgaatatctggaaagcgaaaagaagaacctcaccgacgacatccgcgcgcagatcaacaacaaaacaagctacgcgatccatcgctgcattgcgctgatgtgtgaaaatgaacgctttgccgtcaacgggagcggagacattgacctcatcaacgcgctggacgcgaaaacgctgtatgaaaaatatatcgatatcctgcaaaacgcacccatcgagatctgctatatcggctcgatggaggcggaggaagtggcggaaaagctgcaaaacagcctcgcgctgaccgaccgcgcagcggaaattcccaagaccgatgtcatccgcaaagccgaaaaagtccgcgaaatcacggagacgatggacatcagccagggcaagctgtcgatcggtttccgcacggggagctgcatgtacgacgaggactacctttccttttcgctcttctgcacgctgttcggctccagtccgacgtcgcggctgtttctgaatgtgcgcgaaaagctgtcgctctgctattactgctcgccggtgccggacgggctcaagggcacaatgatcgtggcctgcggcattgactgcgcgaacaaggaaaaggcgaccgaggccattctgcgtgaactggaagaagtcaagaacggacgcttcaccgatgaagaactggcaaacgccgtccgcgcgatgcagaattcgtaccgggaggcgatggacagtcctgcgtcgctttcaagctggttcacggtacgttcgctggccggcatcaccgagacgccggaggaatacgcagtgaagctgaacgcctgcacacgggaggacatcgtccgcgcggcaaaccggctgacgctggacaccatctacttcttgaaggggaaggacgtccaatga

SEQ ID NO: 1631 - DNA, 1062 bp, Unknown
  Artificiall/Consensus sequence
gtgaccggcctgctgctggccatgctgctcgtcctgagcgtgctgtttgcctgtacgccggcggagagcggggcggagagcagtcagcccgcaccggccgaatcctcggccgaggaaagtgaggaaccgaaggtgcccgatgaaaacgcaaagctcgtctgggacgaactgtatgccgatgaagcgaacggaatcgtttcgccgtccgatgtgtacggcgtcgattattacttcgacggcgaaaagatcgaggattatgcgcgcgaccctgccgagggcgacgccaagctgcttctgaccggggagagcgcgacccgtgcggtcaatttcgcatatggttatctgttcaccttcccgtataccggcgtcatgctggataactcgctcagcgcctaccgcaccaagtacatatccgaaaactccgtcctgaccgtttcatatgaggacaaaaacccctacggcgacaacgagaacggctggaacatctatctgaccgaatggctgaatatccatatcagttcgcttgatttcttggccgctaacgagctgagccgctcgcgcccgctgccggacagcgaatcgctgctggaaggctataccgtgcttgaatacgacatatacatgcgcaatcccggcgatgtcgagtatccctattacaacattgctatcctgcgccgcaccggtgaatacgaccatttcgtactgatggtgatgaagtccaagacgaagaacgacgaacaattcgataagattgtcgcctccttcgccgagaccgagcaggtcggcgaggcgaaaaatcccgaaacggccttcgagttcgagctgcccgaaaactggtcggacgagacgcgaagctattacgagctgttttccgctgcgcagaatgtgtcttggggggcttttaccaaaaccatcgtttccaagcaggacagctcctatgccgtccgccgcggagaaatcatcaccaaccttgaccgcctgcagggcgagaacggctgggattataactttgacatcctgcctacctattccgcgctgggctggtacggcaccgagtcctac

SEQ ID NO: 1632 - DNA, 606 bp, Unknown
  Artificiall/Consensus sequence
gtcggagatgcgcttgctgccgttgaggatgtggagattgtcgggctggattcctacataaccacggtgaatggcctggaggccggcctgttcggcggctgggacggctggaattaccgtgtcaacggaaaaagtcccagcgtcggcatcaatgattacgtacttacggacggcgacgcaattctgctttattacggtatgttcgatatgcagattcccgaggtttcgtatgcggacggcgtgctgacctttacctccaccgatacgacttatgacagcagcggcaatcccactgagcaggtcaacccgattgtcggagcgactgtacgatgggacgacgcggtttataccacggatgagaacggacaagtgacgatcgctgaagaactccgaacagtcggcgcgcacgcggtttccattgagaaaaaggccgagaacgaacctgtcgacgggaaatacctctatgcagtgctgccgttggaaagcggctacaccgttaccgtcgaagctgctgacgtctccgattccgtgtctgaagcggaaccttccgaagccgaatcctctgcggccgtatcttccgaacctcagacgccggataccggcgac

SEQ ID NO: 1633 - DNA, 690 bp, Unknown
  Artificiall/Consensus sequence
attaagccggaaaaggacaaatcaactatggacacaaaaacgcccgagctgctctcccccacggacacgccgatgcagatattggaaaaaatgcgcccgttccgcgaactgatgatgcaatatgaatgtgcaatgcgggaagtgagcaccaagtttgaggtgctcaacgcagagttttcggttcgctacaatcacaacccgctcgaagcgatcaaaacgcggctgaaaacgcccgtcagtatcgctgaaaagctcaatcgcaacggaaagccgctgagcgtcagctcaatccgcgaaaacctatttgacgtggcaggcgtccgcatcatttgctctttcccggaggacatctatacactcagtgatatgttccttcggcaggacgacgtaaaactgctcaagcggaaggactatattgccgatccgaaagaaaacggctatcgcagcctgcatctaatcgtagaagtgccgatttttctgaccgagcggacgatgatgataccggtcgaggtgcaattccgcaccattgcaatggacttctgggcaactcttgagcataagacgcgatacaagcagaacatcaaggacgaaccgttcatcgcatcggagctgaaaacctgcgccgatcaaatcgcaaagctggacattcggatgcaggaaatccacaaatacatagagcacaaggaatga

SEQ ID NO: 1634 - DNA, 858 bp, Unknown
  Artificiall/Consensus sequence
atgaacgaaaaacggaattttcataataaaggtaaaaaggtaggggtaaaggttatgaagtttatcaaaaacggccggcttattctcaaggacaggattctgaccggcaaagcgcttgcttatgacggacgcatcgtcggattcgtcgataacgacgatgttcccgcaggcgccgaggttatggacgccgccggcgcatatgttgcgcccggactcatcgacgttcatatccacggctatctcggccaggatgtctgcgattgcaatcccgacgggatccgtaaaattgcagccggcattgtggaaaacggcgtcaccggcttccttcctacgacaatgactgtcgataaggccgtcatccagaaggccatcgacgtctgccgtgagctgcaggaggaatcgaagacatggaagggcaccgccattctcggtgtgcatgcggaggggccgttcatcaacccgaagaaaaagggcgcccaggacgaaaagtatattctcaagccggacgcggcctttgttaagaaaaatgccgatatgatcaggatcatcacgatggcgcccgaaatggacgaaaatttcgccgctatccgtgagatcgtgagcgatacggacgtcgtcgtttcgatgggacataccgacgcgacttacgagattgcggctgctgccgtcgccaacggcgtgcgcagtacgacgcacctgttcaacgccatgtccgcactcggacaccgcagtcccggcgtggtcggcgcggcgctgaaatacgatgtttataccgagatgatcgtggataccttccatgtggacaagagcctttactccattgtcagcaagcagaagggggaaaagctcgtctttatc

SEQ ID NO: 1635 - DNA, 2049 bp, Unknown
  Artificiall/Consensus sequence
gcctacacgagcgcctataaggaagcgatcgatccgaacaaattctacaaatttaccgtacgcgcttatgacggctacgtctccgagagcatcgacgacgagctgctcatttacgggcgcgagctgaccgaccgcacgcagggccgcgtaggtttccaggcgaacaactgcacaatggtggtcgacagcatcaagatcacgcttcaaaacgacattcccgaaggacctccgcagaagccggcactggttgacgtgcgcgacttcaacagcaacatcgtgactacgccgacgatggtttcttttgtcgagaccgaggccgattacgaaagcatcacaaccgacgcgcccgcaacggcgattttccgcctcaatgacgatggcaatgtgaccgacgccgaaggcaacgtactcgccacgctcgatgcgttgtacgccaagctcgaaaacaaggtcatcgccgcattcaaccccgcctccgaaaaagcaatcgacgtactggccgcttattgtgaagaaaaggtgatcgaggacgtggcggtcgcttcaaccgacgttgagcttatcaattacgcgcacgaacagaactatctcatccgcggcattgtgctgtttgaggatgcagactattccgaagagggcctgctggccatccgcgagaaggtcaactccaaccatgcgaagatcgcggtactgccttacgaagggatctccaaggagatcgtttcgtatctgcaaaagctgctggtcaccgtctgggtaagcggtcccgaggaagaaagcaatacgacgtatatgacgcagattctcagcggcgccaacggcatcgtcgtttccgacagagctgcagccgagaaatgctataccgaatacttcgaagagaattcgtttacccgccagatcctcatcatcgggcacagaggcctgccgtcgcaagcgcccgagaactcgattgagggcagcaagatggccttcgaagccggcgcggacatcgtagaaaacgatgtgtacatctccaaggacggcgttgttgtcgtaatgcacgacggcacgctcgaccgtacaaccaacgggacaggttatatcgaatcgatgacctacgagcagatccagcaatatacccttaacgccgtcggcggaatcgagggctgcaaaatcccgacattggaggactacttcaaggaattcggttcactcgacaagcatatttttatcgagatcaaaaccggcaaccagaatgtgcttcagcctatgatcgacctgatcagggaatacgatatgacttcaaaggtcaatttcatttcctttgacgccaaccagctcacgcgtgtaaaggaattggcacctgagatttcagtcggctatctgtgcagcgggctgaccaattcaaacgagccgctggaaagcgtgcgcgccgcaattgccgcgacgcagcgctacggttccaccttcaatcaaagcggctcgggaatctccgaggaattcgtaacggaactgggccatcgcggcatcaccttctggccctggacctacaacacgcagcagacctttttggatcagtacttctggggcatcaacggcttcacgaccgactactccatgtgggtcagaaataccgccaagtcggtgaaattccagtccgatattgattccatcggtgcgggtcagagcgtgcagctcgacttttcggccttcacctatgccgataaggaaaccccgctgggcgacgaagcagagatcgttatcattgacggcggcgacaatgtcacgctcgagggcaatacgatgacggccacgggagaaggaagcgtttcgttctactgccgttacaagtcctcgctgagcaaccgcagcctgtatgtctgctcggacattgtgacgctcacgacaggcggcgccggtgctgcggacaacagcacagacgtctccgacagctccgaaacgcctgtaacctctgacagcaatgtcgttatctgggtcgtggtcggtgtggtcgcggtaatcgtgattgccggcgtcgtgtatgcagcggcgaagaaaaagaaggcttaa

SEQ ID NO: 1636 - DNA, 1077 bp, Unknown
  Artificiall/Consensus sequence
atggagatcgtaatcgcgatctgcgccgtggcggcgggcatcgtgattggtttttttgccggcttcgtctaccgcaagcgcgttgcggaaaaggccatcggctccgccgagtctgaagccggacggatcatcgaagatgcgaagaaacaggccgaaaccaagcgcaaagagggcgtgatcgaagccaaggaggaagcgctgcgcattaaaaacgaagccgaagccgagctgaaggagcggcgcaacgaggtgtcccgtctggagcggcgcgccattcagaaagaagaaaatttggacaaaaagctggaaagtttggagaaaaaggagaacacgctcgaaaaaaagatacgtgacaacgatgcgctgcgcgaagaaatcgaacagctccgccagtcgcaggtggacgagctgcagcgcgtctcgggtatgaccgtggaggacgcgcgcacgaccctgctggagcgggtcgaaaccgacgcacgccacgagatggcacagaagctctctgaaatcgaacagcagtacaaggagacagccgacgaaaaggccaaaaacatcatcaccctcgccatccagcgctgcgccgccgactcggtatcggaggcgacggtctcagtcgtcgacctgccgaatgacgagatgaagggccgcatcatcggccgcgagggccgcaacatacgcgcgattgaaacgctgaccggcgtcgacctgatcatcgacgacacgcccgaggccatcaccatttccaccttcaacccggtgcgccgcgagattgcgcgcatcgcactcgaaaagctgatttccgacggacgcatccacccctcgcgcatcgaggaaatggtggaaaagagccgcaaggaagtcgaaaatacgatcaagaaggagggcgaacaggccaccttcgaggttggcatccacggcatcaaccacgagctggttaaaatcctcggccggctgaagttccgcaccagctatgggcagaacgtgctcaagcattccatagaggtcgcgcatatcgccggaatgatcgccagcgagctgggcgtcgacgcaacgctggccaagcgcgccggcttg

SEQ ID NO: 1637 - DNA, 756 bp, Unknown
  Artificiall/Consensus sequence
gcagccgaagcgggcggacgaaacatccgcacgcgttcacaggcgctcatcaatgatgatttgctcatcgattttccttccgattcctatcatcatgtgcttcattgcgggctggatttgtcggcctgccgttatttgctggtcacgcattcacacaccgaccattttgccccgaccgatctgctgatgcgcatcaaaggcgtattcgcgcatgatctgacgcaggaaacaatcaccatcgccgcaagcgaagcggtgctttcagtctgggagcactacaaatccttttacaaagaggaccccgggaaatacgtggatacatacgcaatgtccctctacacgccgacacagctcggccgctacacggtcacggcgctgcccgccaaccatatgccgcatgaggtgggccatctctacctcatcgacgacggcagtgcgaaggtgctgtatctgcacgacacggggcttttgttcgacgaggtttacgattacctgcaaagcatcaaactgaaggcggacttcatttccttcgactgcacgttcggacagctcaagagcagcggcggccatctgggactggatagctgcgtggtgaccaaggaacggctggaagccgtcggcgtcatcgggaaggacacaaagctatgtatcaaccacttctcgcacaacagcggcctgattcacgacgaattggtgccggtagcagaaaagttgggttttatgactgcctatgacggaatgcagatcgatctgtaa

SEQ ID NO: 1638 - DNA, 627 bp, Unknown
  Artificiall/Consensus sequence
ttgtaccgctttgacctgcgtttacgtatccaaaagaaaggatctggtaaaatcatggacgcaacaacgcgcaaacacctgctctgcgtctgcgaaacggcgatttttatcgctcttgcattcgtactcaacttcgccaagctggaatttgcctggctgcagggcggctccatctccctgtcgatgatcccgattctgctgctgtcgctgcgccgcggcgccgcctggggcattcctgccggtttgattttgggcatcatcgactgcgcgatggacggcggcttcggctggggaatctggtcggtactgctcgactatctgctcgcctacgcggcggtcggcacctgcggcttcttctacaagatgcgcaaggccggcccggtggtcggcacgctggtcggctgcctgcttcgctttgtggtacactttatcagcggcgtgacaatttataaaattgcggttccgaccgatgtctacggcctcactttctctcccgacggtcttggaccggtgatttattcgctggtgtacaacggcggctacatgcttttcaacaccgtcattgccgtcattgtcattttcatcctgcagaaggctgcgggcaagctccttgcaccgcagaactga

SEQ ID NO: 1639 - DNA, 1425 bp, Unknown
  Artificiall/Consensus sequence
cccgaattttctttcctgttctctgagggatttcctgcctatgtaaacaataaattcgtggtttcttctcttgaggatgaggcgctcaacgcctactacgcaatgattgcaaaatacaattcgctcgggtatctgcaggaggatgttgacgagaaccagcgctttgccgttacctttgtcaagggacagcagtcggacattgatgcgctttcggaaaaaatgggttatgaatacacctcaaacgtatatgccttcccgacggccacggaggacaacactctgcagaatctgttctgcatcagcaaatactgcgtctccgacgacttgacgaatgtcgtcaaattccttgcgttgctggaaaccgaccccgaagtacagaacatccttacttacggcgtcgaagggcagcattatgagctggttccctatacggccgacgataacgagacctacgaccaggttcaattgcttgagggctccaattacatcaccagacgcgaatacacaggaaactccttccagacctatacaatggtcggcgaagacccgctgatgtgggagaagatgaagaagcagaatctggaatcggtttctgccgttgatctcggcttcggatttacctatgtcaccttcaccgctgatgaagagaccattcaggagccggattacatccaaatcctcgagtcggtgatttccgagcattacaacgagtatatgaccggtattgccggcaagcttgattacgacgagtaccgcgcggaaaatgacgccactgtccggcaggcccttcgggaacagcttgccgaagaatacagtgatatgctctccacgcagtatacggatgaaatccgtgcttcttatgaagaaggcaccgcgaattacactgcgttgatggcagaagcagaggaagctgcgctggattctctcgccacctccctcaaacgcacactgcgtaccgagctcacggcgcagttccgtgaagaacttggtgaggacgcaaccgatgaagaaatcacggcaagggtcaacgagttgcttgacgatccggaatatatgcgtgaacaggttcttgaacgtacggatcgtgaggaaatcgatgcggaaacgctcgagcagtttaaccgcagattggacgcagtgctgaacgaggaactgagcaacattaccgaaaccgcggaatatcaggccgagctgaacgcgctgctttccggaagccagtttgcggccgatttggaggcattgatcgcttccgattacgacacgatgatgctttcgatgtttgaggaagaaatcctggccaaagtcaccgccttttcgctgaccgtgctcgatgaatgcgaggccgaactgaagaaagccatagatgactttatttccgcaaatgccgaaaagctggatatgaccgaggaagaaatcctgacagag

SEQ ID NO: 1640 - DNA, 1104 bp, Unknown
  Artificiall/Consensus sequence
atgcggcggttttccaaagcaatcgaagcgcggcgccgattgctttggcgttggaatttcggtttggaaaggagcgacgatatgacgctttccgaatgtattgcgcgcgaacggcgggtgaaggcaggcttccgcagacggtttatgttcaccgtgtcggcagtgctgctgttttcaacggctgcgctgcttttgctcggttacgagcgcatctatatgggcagtattctgcgctggatcatcgatgcgctggcgccgctcggtgaatcgattgccgcaggctttgcggagggcgacgccgccgtgctctatgagaactttatgctttccgagccggtactgctggtgctgcagatggtcgtctacgttctcacgctcggaattccgtatctgtgctgcaaaaaagccgttgtgcgcaaggctgtctctcggggcggctctgcgatgccgcgcaagccgtttgcggtgatgctgctggcacttggtatgggatatatcgccagttttatcggcacgctcctgttttcatggatgcctcaggggcagactaccggcggtttgcccgaatcgccggccggcattgcgctttatttcgtcagcgtggcgatcttgccggcgctggtggaggaatgggctttccgcggcgtggtgctgcgggcgctgctgccttacggccggacgtttgcggtctttttctcctctgcgctgtttggcctgatgcatctggacccggcgcagtcggtgttcgcctttgcgtttgccgttgtccttgcgctcgtttacgcttcgaccggttctttgtggatgtgtgtgttcctgcacgcggtgaataacgcaatctcgtttctggccggttatgtgacgctgtacggaagcgaattatcaatgacgcttctttccggttatatgattgtctgcatcgcctgtgcaggcattctgctggtttattggtttgttcgccggcgtgaatcgcctttctttgcagagccggtcccgtcttccgcgccccggcttcgggcgggcagtatgctttcttccgctgcactgaacgcgtttgcggtggtgtttctgctgctgtatgtgtattttatttatctgcagtat

SEQ ID NO: 1641 - DNA, 915 bp, Unknown
  Artificiall/Consensus sequence
acgctgctgctggcattcgtgttttacggggtatatacaggctatctgtcgctgtttacattagcgacggttcttctgtttccgctgttttcgctgctggtcagtctttggccgatgcgcgcggtacgggtttttgaaccggtattgaaaagcaaatgcgtggcgggagaccgcccggcgccgcttctgcatatccgctccgcttcccctttcccactgcctcggatagatgtagaatatactgccgtcaacgccaccttcggaaccgagggagcttttcggacgctgacggtttacggccgtatggaggctgccgttccgctggaagcggatttcgcgcatatgggcatcctcaagctgcgctacggcaaattgagagtgtatgatttatccggcttattcttccgcagtctgccgagaccggctgaccgtgacatcctgctgctgccgcgtccggaacgccctgttccctttcccaagctgcctgacggcgaaacagcgggcaagcgactgcgtcccaagcatggcggcggcttcgcggaggagcatgatattcgagaataccgcgccggcgacccgctcaacgccgtgcattggaagctgagcgccaagctggacgaactgctcatccgcgagccgctcgttgccgaccgcggcgagctccggctgctgatggatcttttcggcagcagagacacgctggaatcggttttcggtaagctgacatacatcggaggcgaattgctcagacggatgctgcccttttccgtttatttctgcgaccgcgaaggaacgccgcagggcgtacgcatcgactcgcacgaggcactggaggcatttatggccgccgcatttgcacagggcttccccgaaaacgggaaatcaatccgcgacagcggcggaaacgcgctgtac

SEQ ID NO: 1642 - DNA, 639 bp, Unknown
  Artificiall/Consensus sequence
gcggcgttatttgccgttgttctggtcgccgggatgacggcaatgctgccgacagcggcgtttgccgcagcggagaccgttactgtagataacggtatcaacttcgctcctgacacaactttgcaggacattgaagaagcgtggggtgaagggaccgcgacgatcgaggcgaatgacgacggttcctgcaaagtgaccctgctgaaaaacattacgctgaagcagggcgccgtaaccccggtcactttcggcacctatagcgacggcgcggatcagccgatgatgatcctggacttgaacggctgcgttttgtcagggaagacaattgtcatatcgaactacggcaatttgaccatagcagacagcgccggcggcggtaaagtcgtttacgacggcgggcattatttaactgctgttcaaaatgcgggctataccctgatcatcaacggcggctcgtttgtgtgcgacggtgcgtccactgcaacgaacggcggcgcgatatccggcgcaatgacgacgacgacaatcatcaacggtggctcgttccatagcaaacagagcggcgcgctgacgacatacgggaaattggtgatcaacggcggcagcatcagcggcgcttatggcatcgtggcgaagcag

SEQ ID NO: 1643 - DNA, 963 bp, Unknown
  Artificiall/Consensus sequence
gaggcacaggaagcgctcgagcagttcggaactgccggccagttcattgaaatcaatgcgccgcttcaggaaatcttcacgctggtgaaaaatgcgattgtcgttaaagaatactgcgatgcgtacgatctgacggtggagaaacaggttgtcaacagcagcgagaccgacccgtcatttgcatttacgctgtctttcaccaaaaaggatggaagcccgctgaatggccgatacgactatcggatcacggacgcaaacggcaaaacagtggataagggtaaagcggtcctgaaagccggtgcgtttaacgtttcgcttaaaaacggacagcgcgtaatcgtcgaggatttgctccccggcacacgctatacggtggaagaaaagctgaccgaggcacagaccgagatataccgttcctcgattgccgttaatggcgaaccggtcgaagcggctgcgggcacgatcgatggccatacctcggtttgttttaccaatctcggaccggacggggtcacgcttcaagtccgtaaggaatgggtcggagatgacccgtcttcacgtcccgattcggtgtttgtcaccctgtacggcaacggagagcctgttggcgagccggtttgcctgtcggacgataacggttggagctatacatggtgtgatctggataacaccgtcaggtggacggtagatgagcttgatgtgccggaaggttatgaaaagaccataaaagccgaaaaagacggtttcgtcattgtcaatatggcgatttttgatacgtcgtcggatacggaagagtcggatgtgccttcctcgtccgaagtcccttcagaatcgtccgaggatatttcctcggggacttcgtcacagacgccgccgaccggtgatgcggggatcgcaggagccgttctgctgttggcagcggcgttgtccgtgttctgcctgcgcgcacggagacaatattaa

SEQ ID NO: 1644 - DNA, 1098 bp, Unknown
  Artificiall/Consensus sequence
gccgaggagaaggctgccgcccgcaagcgccgcctgtcgctctccggccgcatcgcccgcagcacgctgtggtatccgcttcggatcaccctgttcgtgctcgtcaaggcgctgacctatctgctgaatatctttttcaccgtcctcattgtcgggatgatcaccggcgtggttgtcggctgtgcgttcctgctgtatatcaagggcaacatcgacccgaactatgacgggctggacaatctgaaatttgacagcagcctgaacacaaccatcagctatatcgatcccgatacgggattggaggaaacggtggtcacgcttcatggcagtgaaaaccggctctgggcggagtataaggagattcccgaaatgctcatcaacgccttcattgccatcgaggaccagcggttttacacccataagggcttcgacgtcaagcgtacgctcggcgcggtgctcaacttcattatgcccggcggtgactcgtacggcggatcgaccatcacccagcagctcatcaaggtcgtttcgcaggacgatgacgctaccattcagcgcaaggtgcaggagattttccgtgccatcaacgtcgaaaccaagttctccaaggaagagatcctggagatgtatctcaacgtcatcaacctttcgcagaactgtaacggcgtcaaaacggctgcccagacctatttcggaaagtctctcgatgagctgacgcttgtcgagtgtgccgcgctggccgcgattccgaaatctcctacgagatacgaccccatccgtaaccctgagtacaacctccagcgccgtaatctggtgctcaaggagatgctcagccagggcaagatcacgcaggaggagtttgacgacgcgtacaaccagccgctttacctcaataccggcagcgaggaggacaccacgagcgatccggtctattcgtacttcatcgatgcgcttatcgacaatgtcaccgaagcgctgatggaggagtatgccgtcgaccgcgcggtcgcttcgcggatgctctactccggcggcctgaagatcgtttccaccgaaaatccgcttgtacagagcgcgctggaggaggtctttacggac

SEQ ID NO: 1645 - DNA, 1023 bp, Unknown
  Artificiall/Consensus sequence
atgatgaaaataaaaagaaaggacacaaacatgacagaaaaggtactcggatcccttcagatagattttgttctctccttgttcggcgcgctcgattcgcataccgacacaatcgagaaagccttcaacgtccgcattgccgcaggtgaaaacggcattgttatcaccggcgaaaacgccgacaacgtacagatggccgcgacggtcatcgagcaattggagcggatttcgtcagtcaacggcaatatcgacatcaacacggtcaactatgtggtgtcaatggtttccgaacgcaagcaggatgagctttcggctatctataacgactgcatctgtctgaccagccgcggcaagccgatcaagccgaaaaccgtcggccagcagaattatgtggacaggatcaaaaagaacacgatcgtgttcggcgtcggtcccgcaggcaccggcaaaacctttctggccgtagccatggcggtgacggccctcaagcagaagcagatttcgcgcatcgtactcacccgtcccgctgtggaagcgggcgaaaagctcggcttcctgcccggtgacctgcaaagcaagatcgacccctatctgcgtccgctgtacgatgcgctcggcgagctgctggggaacgattcgtttcaaaaatatctggaaaaaggcaccatagaaatcgcgccgctggcctatatgcgcggccgcacgctggacgatgcgttcatcatccttgacgaggcgcagaacaccacgcccgaacagatgaagatgttcctcacccgtctgggcaacaactccaaggttatcgtcaccggcgacgtgacgcagatcgatctgccgttcatcaaaaaaagcggtctgattgaagcggtggacatcctcgacggcatcgacggtattgcgattttccatttcacgcacaaggacgtggtgcgtcatccgctggtgcagaagatcatcctcgcttacgagaagaaccagaaagcgcgcgcgcaaacgcccgcgcggacgttcaggcgaaaataa

SEQ ID NO: 1646 - DNA, 756 bp, Unknown
  Artificiall/Consensus sequence
gagagctcgggcggcgcttccggcaccgttgcgccgggcgaaacgcgtatcagctttctcgcctgcccggataacattatccatccctccgtctattacgacgccatccggaaggccgcgcaggcagacggcagcacgccggtttatacatcgcttgccaccgggaagtacgactttgcagatatgtacgaatatgtcgccgatgctatccgcgatgcggatatcagttatgtgaacgttgagacgctcatcggcgggaacgataacaaaatctccggctatccgatgttcaatacgcctgagcaggccggtgaacagcttatcgcgctgggattcgatatttataaccttgcgcacaaccatatgctggattccaattcggatgaatatcttattaactgcaaccgcttttttgagtctcgcggattgacgacgctgggatattataaagaccaggcagacgtctccaatatcaagatcattgagcacgagggcgtgaagattgcgtttctggcgtatacctattcgaccaacggactgtcgctgcaggccggatcgagcacggtaatcccctatatcagtgagtcgcttattacgcagcagatggagctggccaaagcgcaggccgatcttgtgtttgtctcgatgcactggggggacgaggaccgctatgaagtcaacgcgcagcagcgcagcactgcgcagcttctcgtcgacctcggcgcggatgtcatcatcggcatgcacccgcacgtc

SEQ ID NO: 1647 - DNA, 1503 bp, Unknown
  Artificiall/Consensus sequence
aatcttgaggaagattatacgctcgtttgggcgacggttgacggcgcattcgacgagagcttctggtccgaggactgggtcacggtagacggcgaaaacgtcggccagtggcagacctcttcgacgacgccgaaagaaggctttgaatatgattatcaggtgtatttcggcaccgagtacctttatatcggtgtgaagtataatcaggcgccctcgtatattgcgcttacgcagaccgaggcgtccaacatccgtatttggtacgcggatctgcagacgaccccgaccggtaagttcggcgcgctcgtcgatgtccgttatgacggtgaaaaggccgtcgtgcccgtccgtgatgtggccgaagacctgatgcagattgatgagtcgaaagtctttgtcaaggatacaaaggacgaaaattcgtggtctgtcgaggttgccattccgctttctgagctggggctgctcggctgggacaatgacacatactgcgcgcttggcatcacggcgtccgatccgttcggtacggaaaatgacgatctgtacggtgccctgcactcctggtatggctttaacaataacgaccgcacgacctgggaggtcttctacccgaacggctcgaaatatccgcagtacaacggtacgcccgttctgcctgaggactctactgcggagaatatcgcgctcgaagaaggtgtgacgaagtcatatcctgacggatacgaaaatcgcactggacagtggcccgcttggtatatcgccgatctgtttgacggagttgcttccgatgataccggcggttataacgacaactggtacggattttatgaaaatggggacaatccgctgaataatatggtcaacggtatcggtaccgttacgattgatttcggcaaagtggatacaggtgtcggcgccgttcgcgcgcacattatgggcggtaaggacggcatcgcaatgcctgaatcgattacggcatatgcctctttggacaacgtgagctggctgaaaatcggccagttggaatatgacgcttcgatcgttggtgcgacatgggctgaattgatactggatgaagagatcgatgcacagtatattcggcttgatttcaaaaagggcagtggcgtgttcgcatttgtcaacgaaatcgaggttcttcattatacgcctgtcgtgaagctggaatatgccgcagccgagggcagcaccatcgaggtgccgacgggctacggcgcgattgatgttctgcttgacggtgataagacggaaatcacaggctatgaaggaaatcagagcaagattttcgctcttaagaatcagaccaatttgggtggggacgatggcaaaacgccccagggttcgatgacctatacgctgacccgtcggtttgccaaagacaccgcgatttccaagatcacaatgtcgctgttgaattatacggcaggaaatgtcggtctgcccgaatccgtgaccgttacgatcaacggcgaagattatacggct

SEQ ID NO: 1648 - DNA, 1365 bp, Unknown
  Artificiall/Consensus sequence
ggcggcgaggataccctcaccttcggcgaggatttcgatatgaccaccatttataagggtgacggaacatacgttatcgtcgacagcgagagcgaagcggttgccggcgcaattttgaacgagacgaccggcgcctactatgccgatattcagagtgccattgacacggcaaatgccggtgacgtgattgccattcccgagggcgagttttccggcaatctgacggtggacgtagccgtgacgctcaagggcgccggcgcggataaaaccaccattaagtttgacaaaaccatgcgcggtaccggcgtcgaatatttcgacggcagaatcgcatatccgacgatttatgccactgccgatgtaaccatcgagggcctgaccattgccggcccgaccgacgagcatcatggaatcgacggcattctggccaaggctgctttgaccgttaagaatgttgtcatcaccgatatccgctgcacggcggacggcgccgagatctgcggcgtgcagtacggtcgtccgattatggtggacggcgaaggcgatgtaaccatcgagaatgttgagatcaagaagttccagaagcaggccattgacctgaatacgaccggcgacattaccatccgaagcgtgacgatcaccggcgccggcgagcagggcatcatcgctcagaatggtatcgttctccgcaagggcaatgccgttatcgacgatgtgaagatttccggcttgatttacaacgcggataacgaatggaaaaactgcagcgaagggcttgatctctccgcagaggcgaccgccacggttaccaacaccacatttgagaatgtggacaacaattacggcgtctgggatgacgcggttatgaccattaccgaagggaacatcgtttacaaggtcactgcctcgtcggatgggaacagctatggtgataaggaacagattgcggttcttgcaaccggaatcacgctggataagaccactgctgagctggaggtcggcggaaagctgacactggctgccacactttctcccgagaatgtaaccgataagactcttgtctggacaagctcggatgagaccattgccaccgttaaggatggcgaggtcactgcgctcaaggccggcgaggttacgatcactgtgaagaacggcgatgtcgaagccacctgcacggtcacggtgaaagccgcttcaaccccctctgaggatgaatcgtcggcggtgtccgaaacctcttcggaggatgaatcctctacgccttcgacttctgacagttcgctcaccttcgttgcgctgatgctgcttgttgcggctgccggtgcggttgcgatgatcctccgcaagagaacggctgacagataa

SEQ ID NO: 1649 - DNA, 1260 bp, Unknown
  Artificiall/Consensus sequence
cctcctgcgtccacaagccgagatgagagcagcgccacttccaccgaaccggacgacgagtcgtccgccgcttctgaggatacatcgtccgaggaaagcgatcccggtcccgagcttccggcgtatctggcgaactttgtatcgtttgcagatactcttggcgttaatttgagagcaacggacaacacctctatccgcttgacgaagattaacgaagcgcctgtcgagggcgatatcgtgctcttcaatgccgagtatggcgatacaatcgctgccggcgacgagacctatgccgacttcacgatcgttgtgtttgagtacgatcatgatgtgttcacctatgttgaaaagtcgcgtgcagatgtgggcgaggatgacacaaaggctgacactgccattcctgcggacggctttgtccttgccatttccgaactgcagacgcaggcgcttgccaatctggaaaatctgaacagtgatagcgttgtccatgtgcacggcgtgcctgcgctggcgcctgatgctgtagatgagaataataatacctacggcatcacggttcagaagatcgacaccgctcctacgatcgacggcattgtcgacgaggacgaatacggtgctccggtctgggtcgtgaacgaaaacaaccacttctggtcttatgcctcctttgaaaaggatcagtattatgccactgcggatatttacgcaagatgtgatgacgaaaacctttattttgcggttgtcgtagattcgccgtatcactactgcccgctggatcagaaaggagccagcggtatgtatgactatgaatgcattcaggtcgacatactggatcaaagcccgtcgagcgattatatgcttgagcattttgattggttcagtagtaccaatgcggttgcatctcaggaaggccatttcagacagtacggctttgcggtgagcagcaatgagggcaacgaaacgctttcctgtgtttgggtttccgcaggcggagacgcagctgcgtttaccggcgaatgcaaggttcttcgcgacgacgaagcgcagacaacaacctacgaggtttcgataccgtgggcggagatcggtattgaaaacgttgatgccggcactgagttcggcttctccgtttcgatcaactcgaccaatgaggaagacgatgctgccggtacctggaaaaacatcacgctgcgtgacggcggcggcatcattggccgcaacgacctttccaaggttcccgtagcgaccatcgaaaattaa

SEQ ID NO: 1650 - DNA, 1764 bp, Unknown
  Artificiall/Consensus sequence
atgaagctgctttctttcaccgtcaacgaatttacaaaaatattcaagcgccgcggactgatgttcttttttgtcctcgtcattctcaactgctttttggccgggctcaatgtttacgattcttccaacatagccggcggcagcttctcactggaaacggagcttgacgattatcggaaaagtgtgatcacataccaaaatcagcttctcgaatatgaggaagaactgacgtcttcggatgaaagtacggtatccggggcggaaagcgacgacatcagcgacacgcgaagcaccgattacaagacctacaacgaactgcggtttgcgcttctggaggctgagacctacgtctccgtatacgaaaaagcgctcgaactgaatattctttcgcgggacgactggcgctactcggtcctgtacgacatcatcaacggtgaaatgaagatcgcctgctaccgtgtgattttagacgccgagccggacgacgaggattacatcgccacggtgatttgtccttacctggagatcagttccaactataccattaccgaaatcaccgtcaagctgcgcaatcagcttcagaacatcgaaacgctctggtcgggcgtcgaagcgctggattacggttcctactgcaaaaaccagatcaccacgcttcaatacgatcaggcagccaagcaatccgaactggaagcaatcaaccgccaactggaggacaacccagccagcatcgagctggcaatgtccaaacgcaaggcagaaggcgtcaaggcggccatagaaggcaagatcgagattcagacgtaccgttacgaaaacggcattgaattccaaagctgggtggaccgcacgctcgacatcatgctcgataaatacgacgcatatatctccaagctcaacggctttgtcacagaggaatacttccacaaaaacggcgattattacgaatgggcctatgccgattacggcgaatacgccacactgctcaacgctgagctgcaggatcagctcgatgcggttgccatcggctggtattccatcaacaacggcgtagaggagctttcggtcgccgattcgacacgatccaatatgctcggattttcggatatgttcacctttttcgccttttttgccatcgtcatcgcaggcgtttcggtttcgagcgagcatgtgacgcgtacaatctatctgctgctcatccggcctgcaaaacgatataaaatactgctgtcaaagtatctctcctgcatcctgacgacaatggtgctcattatcctgtccttcggcgcctatctgctggcaagcatcctgatctgtggtgcgggcgacctgggcctgccttatctgttcgtgtccgaaggagcggtagtggaatttgattttctgcactggatgctcttccgtgtgctctactgctcggcttccattctgttcctgctgacgctgacgttcaccgcctcgacggtgttccgcaatacggcgtttgccgtctcgtcgggactgttcacgttcttctcatcgatcctgctgtcgtcatttttccgcaacagcacactgtacggttatttgcctttcccctatttcaacatttcctccttcgtgttcaacgatctggtcacgctcgcgcccgagacgatttcacgtgtgaccggcgagatcgtcgtatatccgacttttgcatgcatctggttgggcggactgacggttctgtgcctgctgattgcttttgcaacatttacaaaaagggatgtgacgaatacctga

SEQ ID NO: 1651 - DNA, 1038 bp, Unknown
  Artificiall/Consensus sequence
atgaacattttgaaattgtttgcagactatccgttttttccttcctttctggacagcggaaaagaaatccgagacattgtctatgactcccgcaaagcgaaaccgggtacgattttcgtggcgatgcgcggcgccagccacgacggtcacgaaagctgtatggacgcttacgaacgcggatgccgcgatttcgtcgttgagcacagagtaccccttcccaacgatgccatcacctatctggtggccgactcacggcgcgcactttcggttatgtcgcgcagcctgttcgaactcgacccgaaaacggagagtcagctcggcgcgacccattgcattgccgtcacgggcaccaagggcaaaacaagcacctgtatgatcctaaaatcgatttttgaagccgcagggcgcaaggtaggatacatcggcacactcggggttatgtacgacggaaagacaatcgagacgccgaacacgacgcccgaatcctacgaaatattccgctatttaagggagatgcggctgagcggctgcgaatatgtgctgattgaagcatcctcacagggcgtaaaaatgcaccgcacggccgaccttttctttgatctgggcatattcaccaacctttcgcccgatcacatcggaccgggcgagcatgagagcttcgaagaatacctcgcctgcaaacgagagttatttttccaatgcgcactttcaatcggaaacgtcgacgacgaatactacgatcaggttgttgccaatcgcttcgggcggctgactttcggaatggccgaaaaagctgactaccgcgcggaaaatccgcaatttaccatatctgcagacggtttttccaccgttttcacctgccgcgagaggggcaagcgacacgagctgttcctgacgctgcccggcctgttttcggtttacaacgcgctcggcgccgtcgctgccgcgcggaatttcggcgtctcctacgagacgatacaagccggccttgccgccgtcaaggtaaaagggcggacagagattgttcccggcacgggc

SEQ ID NO: 1652 - DNA, 918 bp, Unknown
  Artificiall/Consensus sequence
atggctctgcttttgattgttatgctgagcgtcggttttttttcgggcctgaagattacgaaggacgcgatggcatacaccggtgaaaaatatcttgccgaacagaatttctacgattaccggttgctttccacattgggctttacggaaacggacgtggacgagctggaaagtctacccttcatcgagtgtgcagaggggatgaaaagtgtggacgcattggtcgcggaggaggacgtcagcaggcctttccatctgctttctctgccgaaaagcgtcagtcttccttcccttacggccggaaggatgccggaagcggaaaatgaatgccttgccgattcggatgcttttacggaagcggatatcggctccgttcttacgattaacggagatatggacgggctgctgtcgcagaccgaatacattatcgtgggccttgcagactcacctctgtatttaggatatgaccgcggaacgaccgatataggcagcggttctctgagaggctttctctatttgcacgaagaagcctttctaagcgagccttatacggaaatccaactgacccttaccgagacggcgccgatttacagcgaggaatatgaggcgcttgttgaagagcatgaaagtgagctttcacagctttgcggtaaattggcggaacagaggtacaacgatttgctggcgcaattcggcctgcccgcggaaatggcggaacaggcgggactttcccgaccggaaacctatgtgctgacacgggcggaaaacgccggttatgtcagctttgaaaacgactcctccatcatcagcggcgtcgccaatattttccccgttttcttcatcctgattgcgatgctggtctgcatcacgacgatgacccgtatggtggatgaggaacgtacccagatcggcgtgctc

SEQ ID NO: 1653 - DNA, 951 bp, Unknown
  Artificiall/Consensus sequence
atgattgagatagaaagaccgaatattataactgtcgatctcagtgaagacgggaaacacggcacttttgtcattgaaccccttgaacgcggttatggcattaccctggggaattcgctcagaagggtccttctcagctcgcttcccggcgtggccgcgacctcgataaaaattgaaggcgttttacatgagatatcaaccgtccccggtgtacaggaggatgtgaccgagatcgttctgaatatcaagggcgtggtcgcaaagctctacacccagtctccgaaaacggttttcattaaaacgagaaccggcggcgaaatcaccgccggcgatatcgtctgcgattccgatattgagatactcaatcccgagcaccatatagccaccgtcgaggaaggcgctgagttttatatggagatcacctttgatcacggcagagggtatgtttcctcggataagaacaagcagctcggcacgagcgtaatcggtctcatttataccgattcgatctatacgccggtctacaacgtcaactacaaggttgagaacacgcgtgtcggtaatattaccgattacgataagcttacgctcgaccttgtcaccaacggtacgatcaatgccaaggaggcggtttcgcttgcagctaaaatcctcagtgagcatctgaacctgttcattgagctttcagatgaggcgaagaacaccgagattatggtcgaccgtgaggaaacgattaaagagaaggttctcgagatgacgatcgaggagctggatatgtcggtcaggagcttcaactgcctgaaacgcgcagggatcgataccgttgaggatttgaccaaccggaccgaggaggatatgatcaaggtcagaaacctcggtaaaaagtcgcttgaagaggttatccagaagcttcagtcgctcggattgtcgctgaagaaatcggaagactaa

SEQ ID NO: 1654 - DNA, 669 bp, Unknown
  Artificiall/Consensus sequence
atggaggcgatgaaagcaatgacggacaggctgctggtctattacgatgacctccgaaggctggccgaatccaagtgcgcctcgcgcgaggaggccgaagatctggtgtccgagacttttcttgccgcctatgcctatatacgccgcggcggcgtcatcgagtacccgaaaacctatcttgccaatacgctgatgcataagcggaacagtctcctgcggaaagcgtaccgccgtccgccggtcgtgtcgctggatacgctggaggctgtaccggaggatattgtcgacgaaagctctgacgaagatgcggcggagctgcgcagaaggattctttatttgtccgagacgaccagagaagttcttatccgtcattatttcaacgggtattcgattgcggacatcgccaaacagatcggtatccctgcgggtaccgtcaaaagccgcctttcggcggggcgggaaaagatcaaggaaggatggatgaaaccgatgcctgaaaagaaaacctgtatccccggttttctgaacgtatcctacagcggctctgacggagcgaaccatgagccgaccagtcttgtggaaggtgaccggattgcgcagaatcttctgatcaccgcttatgaccgtccgctttctgtcgccgaactggctgcggccgtttcgatcccc

SEQ ID NO: 1655 - DNA, 723 bp, Unknown
  Artificiall/Consensus sequence
atgaaaaaaactttgctttgtcttgtaacagcggtactgctgactgcgctgcccgtgtcggcagcggaacgtttcgaggtcactgacggggtgtatgtggaactgccggacgcattcgttgcttacaccagagattcggtacaggataagcagagcgattatctcggcatagacgtatcgatgctgacggaatttctggaggaaaacggatactgctgtatgatgctgcatggaacacatttttcgcagtgttattttttggttatgagcagcatatatcaggacttttccgacatgacagattcgcagcttgaggaacagaatgcccttatccgggaggaaatggagcacatcggttatcgtgtcgagccgtatgcactgccgtcggacggtgatatccgctggattgcgctgcgtttgtatcccggcagcggatatgaagcttctctggcggcgacggcgatgtatatcacggtcgagcagggaaggcagattgttgtcagcgccgcgtttccgaatgcgtacttcaataccggtgaactggaggcatatgatcggatcgtcgcagggatgacggttgaacgcgtgtcgcccgggccggtgctgatcattgccgtcgcggtcatcgtaatcattctgctgggcgcgggcgtcatcgtcgcacgttcgatccgtcggcggaagaacgggcccgattctctgccgccggaggcatatctgtaa

SEQ ID NO: 1656 - DNA, 543 bp, Unknown
  Artificiall/Consensus sequence
atgctccccgtgacgaaaattcagcatttctgcaccaaggacggcccgggtattcgcacgaccgtatttttgaaaggctgtcctttacgatgcatatggtgtcataatccggaaacgcagtcgatggccgatcagttcttttatgcggagcatttgtgtatacgctgcggtatttgtgaagccgcttgcccttcccgcgtgcatcatatcaccgacagcgggcattgtctggagcgctcaaaatgcacggggtgcatgaagtgcgcagatgcctgtcctacaggggctttagaaagatgttccaagcagctatcagcggaagaaattttccgttccgtcatgaaagatgcggcattttacaacggcatcggcggcgttactttttcgggcggcgaaccgacggtacatgccgagctgcttatccctcttctgcggcttttccgcagccaagcggtcagcacggccatcgaaacctgcggatattttgacgcggcaatactgcctgagcttacggcggttacagactggtttttgtgggatgtc

SEQ ID NO: 1657 - DNA, 1020 bp, Unknown
  Artificiall/Consensus sequence
ttgactcgcagagaaaaagaaaatctgaccaagatcgccgtaacggccatctgcatcggctttgtggcgatctccaagttcttctcggtcacgctgcccctgttcggcgcatcgggtatgaacgtcggcttcggcggcatttttaccgcttttccggccttcctgttcgggccgctgtacggcggcgtcgccacggccatctccgatctgctcggcgtcatcatcaagccgtccggcccctacaacccgattttcaccattaccgccttctgcggcggcgttatcaagggctggatctggcgcctgctggctatgcgcaacgacggccgcgtgcgccgtgtggcgctgtgcctgttgatcgcgctgggcgtcgtaggcggagcgttccacatttcgcttgtcagtgacggcatatcggcggggctggcggccgacgcctctgaactgcccaaacgcagcgaaatacaaatggaggattacaatccgctgaccaaactcgtcgtgcatctggccgattataacaacgacgtcatcacctattcccgctacaccggcgacgcggacacggtcacgcttccgtccaagatcgtctatcccgacggctacaccctcagcgtgaccaagctgggcgaaaaagcctttcccgaggcccagctgcgcatcctgatccccgaaaccgtcaaaacgattgacgaaaaggccttcgacggactcgccgagggcagcgtgattgttgccaaagccggaagcaaagcgcaggaagcggcggaaaaggccggcattgccttcgaagcggcggacgtggagtcggtcaccgtgcaggtagacgaaaccggcatttcggacagcagcagcttcaccaacagtgacgccttccgcaaaaatctggccggctacatcaacttcattaccctcggtctggagggcaccgccctgctcggactgctctacatcggcgcggaagcgctcgtcaatcttcgccgccggaagcagggcaaggagggcaacgcgccgcacatc

SEQ ID NO: 1658 - DNA, 480 bp, Unknown
  Artificiall/Consensus sequence
ttgaatacacggcaaatacaggatgagatcctccgcttaaaacgcgaaaacgacgtctgcatcctcgcgcacagctatcaggcgcacgagatcctggaagtcgccgatttcgtgggcgattccttccagctcagcgtgcaggcgcagaaggcaaaagccggcacggtgctgatgtgcggagtgcgttttatggccgagacggtcaaaattctctcacccgagaagcgcgtgctgctttcggtggcggatgcgggctgtccgatggccgagcagatggacaagtcgctgattgagcatttgaaggagaaatatcccacctataccgtcgtcgcctatatcaataccacggcagagctgaaaaccgtatgcgacgtctgcgtaaccagctcctctgccgtcaagatcgtcggaaagctcgaaagcgacgatatcctgttcatccctgactgcaacctcggcgcgtatgtcaaagagcagctc

SEQ ID NO: 1659 - DNA, 960 bp, Unknown
  Artificiall/Consensus sequence
gtgaagaacttcaatgtagtcaaaaatcaaaagattgccttcatcatcgttgcggtcgttctggtcgtgggaattgcttcgtttctgattcggggctttaatatcgatatcgatttttccggcggcacggaaatccaggtcaacctcggccgcgaggtcacgcaggacatctgcgacgagatcaacgagatcatcgcctcgcacgagcagctcggtcaaaattatgtttcatcgacgacgcagtctggcgcggacgcaaacgttgccatcatccgcaccggctcaagagagctgaccaacgaacagcagaatgcgctcatcagcgcgctggaatcgcaatacggctttaaccgcgaagaagttgacctgcaaatcacctccgtctctccctcgatcggctcgggtctgaaaaagacggcgctgctgtcggtcctgattgcgacggcgctgatgcttgtttatatttccttccgcttcaaggtggcgtcgggtatcgcagcggtgctctgccttgtgcatgatttgtttgtaatgctgacggcctgttctctgctgcagattccgatcaatgccaacatcattgcggctttcctgacaattctcggatattccatcaacgctacgatcgtcgttttcgaccgtgcacgcgagaatctcaagcgttccggcgatgagaaaagcttcggcgagattatggatgacagtgtccggcaaactctttcccgttccatcaacacgacgctgacgacgttgttccccatcggcatgatctatattatgggtgttgactccatccgaaattttgcgctgccgctgattgtcggcatcgtagcgggtctgttctcctcggtgtgcctgtccggaccgttgtgggttatgctggataaggcttttggaaagaaaaaagacaagagcaaggacggcaggaaagccgataagcgcctctcgtccgccgagtaa

SEQ ID NO: 1660 - DNA, 819 bp, Unknown
  Artificiall/Consensus sequence
acggagggattctccgaggacgacctgctgaacatctgcatcctcgtcatcccgatttccatcatcggcgcgcgggcagtttacgtactgacctcgctggagaaatacaacagcatctgggatgcgctcaaaatctgggaaggcggactggccatttacggcgcgattcttttcggactggcgacggtgctgatttactgccggcacagaaagctgccggcgctcaagctgctggacgcgcttgcaccggcggtgatgctggggcagattatcggacgctggggcaactttgtcaacgcagaagcctacggctattccgcaggcgtggaaaagctgccgtggcggatgacggtgggaacagtctacatcgacggcgtcccgcacccggagatcgaattcgtacacccgacgtttttgtacgaatcgctctggaatctgctcggcttcatcgtcatcaatctgttttacagacacaaaaagcgcgacggacaggtgttttacctgtatgtcgcctggtacggactgggccgcgggctgctggagttcctgcggacggacagcctgcgcattttcggctataaggcgtttgtgattctcggactgggttcgttcgtcatagcggtgatcctgctgattgtatcctatcgccgtgcggctgcggagcgcgaagaaatcgaagcatacacgagcgcaaatccgactcctgtgtccgtgccgaaaaccgaaaatacattggacatacccgtggactatgaccacaaggacgataacgatgaaagcgacgaaaaagaaggagaagacaatggcgaccatacttga

SEQ ID NO: 1661 - DNA, 1776 bp, Unknown
  Artificiall/Consensus sequence
aacgtcacctatattgcaagcgacggcatcgtgctttacagcgatgccgcaactcaaggtgctcctgtcactttcattaagaccggcacgtcggacgtccgtgtgccgctggcgtgcggcgggaatgcggtcagcgccgttttctgtggtaacgttcgcttggagtcgggtcgggattatgccgttgacggcgaatcactcatccttcgcgcggcgtggctggatacacttgcagccgatgcgtatacgttggacatctcctatgacccgttgggcattccttatgtcgaacagcccggcaatgttgcacccgcatcaacggtgctgacactcaacgttgataaggctgcgggcagcgtaacgcttctttccgatctttcgaagtattatgacggcctgcctgtggcggatatcgcttacagcgcgtcggcgggtagggtcacggttgaatataaagcttacgatgcgccggatgataaatatacaaccgaaaagcccagtgccgtcggcaactacaccgttcgcgttacagttgcggaaagtgaaacgcacaccggcgcatctgcgacggcgaacttttccattcactatcttcccgatttgccggtgcaggccgagggaaccctcggctccaacggctattatacgagcgtcgtgtatctcgttccgccgtcgggctattccatcgcttttcaacgtgagggcatctatctggaccgtctcgaattgaccgaaagcaccggtgcattgagcgtgtatttgaaaaacgagttcggacagatgaccgatgccatttccgttttgccggtccgtattgatcgggtacgtccgtcgatttcggccgatggaaataccgaacgatatctgccgtccgacaaggtcacgctgacggttgacgtcggcgtttcgggaatatcccgtgtggaagtctgccgggataacggtgtgtatacggatatcaccaattcatatacagaaggctatatcgtaacggaaaacggcacctataccttccgcgtgaccaacggtgccggtgtgacggctgtgtgctcgcttacttatgaccggcttgacgcgtctgttcccgtcctctgcattgacgcgggcgattatgcggagggaagctgggcaaccggtgatgtaacactgaagccggtaaatatgacgcccaatctgggcgaaagctcgtatttttatcgaatcgatgacggcgaatggatgtcctgcggcggttccgtgatcatctcagcggatacgaatgggtctgtttattctttttacgctgtcagtgccggcggcattcggagcgccgaggcctcgtttaccgtccgtcgggataccgctgtacccaccggtctaacgctttcctgcggcgggagcgagctgcgggcattctcagaggagcggcctttccgcttgctttttgatgacacagtgaccgtcgttttctcggcctccgacgcgggcagcggtataaccgcgtttgccttccgcttcagtgacggggaagagcagacgattgctgctgttgacggcacggcgcgtctgcccgtttcgccgccgttcgtgggcagcatttgcgcagtgtcggcaattgacgcagcggggaacgcctgcagcgaaatggatttcgagttttttgcggtcgatgaccgcgtgccatctgccccgacgctggataccgacggctataccggtggctggacgggcagggaagtgactcttaccgtcggcggctccgtagcggtcagcggcattgcctgttatcagtattcg

SEQ ID NO: 1662 - DNA, 1353 bp, Unknown
  Artificiall/Consensus sequence
acgattcggcgctttggcatcggatacgctcccgacagttgggattttttgcacagccggctgacggccaagggctacacggacgaagaactgaaggccgcgtttttgtgcgggatttcccaaaaggggcacccctacgatgtgttccgcaatcgtgtgatttttccgattttcgatctcaacggcgaggttgttgcttttgcaggcaggcggctgaacgaaaaggacgagcggaaatacgtcaatacctccgatacgcccgcattcaaaaaaagcaaagtcatcttcgggatgaatttcgccaaacgttcggaggcgggcagtctgatcgtctgcgaaggcccgattgacgccattgcgctccagcaggcgggcttcgacaacgccgtcgccacgcagggtacggcaatcaccgccgatcaggtgcgtacgatgtcacggtttgtcaaaacggtttatcttgcctacgacattgacaaagcaggacggaacgcgacgatgaaagccatcaatctgtttacgcaggtcggcgtgtcggccaaggttatcgacctcgggaccgaggtgaaagatcccgacgagtatatcaagaagttcggcgccgacgccttccgccgccggctggatgcgtccgccggacaggtggatttccgtatcgacgagatcctgaaccgctattcgctctccatccccgacgaaaagctgcgcgcgatcgacgagctgaccacgctggctgcggacatttattccaaaagtgagcgcgaagtttacattgcgcggatggcggaaaaaaccggcatatccgcagccgcgctctcggaggacgcagcgaaaaaggcgaaaaaggcggaggaaaagcaaaaggccgagcgccggcgccagacggtgaacgcgaccctcggctacggcgaccgaatcaatcgtgaccggctcacctatgctaccggcgccctgcttgaagaacggcttctggcctgtatgctatccaaccccgcacttgcggccgaagcctgcaagtcgctgtcggaggacgactttctcaccgcattcggccggaaggtgttcaccacctttgcggaggaattttccgacggcacggaagtcgtcctgtccaaggacggcgccttaacccccgaagagatttcggcgctggcgcggctgatggcaaagcatgaccgactgctttccgtgatgccggacgatgtgggttcactggtcggcgcgctgaaaaccgagcgccaaagaattgcgttcaacgaaagaatggaagaaaacccgcaagacgcactcgaggaatacatccggctcaaacggcagaaaaaaacgcgccccggagacggcggcgaagcataa

SEQ ID NO: 1663 - DNA, 804 bp, Unknown
  Artificiall/Consensus sequence
gattcccctgcgatggaggccggattacaggttggtgatgtaatcgtcaaagtcgacgatctggaagtgacggcggataactacaataccgcggtcaacaatgtcgtcggtgaagccggaacggaactgacagtcacgattcttcgggacggtgaaacagccgagctgacgatgacccgccggcttgtccgcagcgaagctgttttcttggaaatgcagggaaacaatacggctcttatccgcatctatgaatttaccggcaatgcggcggaggatttcatcgccgcaatggaggaagccaagagcgccggggcggagcgctacgtatttgacgtgcgcaacaatccgggcggcgatctcggcgtcattgtcagcatcctcgactatctgctccccgaggggccgatcgtccgcattgtggacgcttccggcgaggtggtgcatacctatacttcggacgaaagcgacgtagtcgcgccgatggtcgttctcatcaacgaaaacaccgcttccgccgcagagctgttcacctctgccctgctggattacgataagtgcgtgaccgtaggacagacgacctacggcaagggcgtaatgcagaacatcattaccctgcccgacggatcaggcatccggctgaccacgcattactacaatccgccctattccgaaaactacaacggcattggcatccctgccgattacgaggtgcagatggatgccagcgctatcgccgatcccgcgctggacacacaattacaaaaagcgctttccctgctcacgggtgaggaaagcggcaattag

SEQ ID NO: 1664 - DNA, 1674 bp, Unknown
  Artificiall/Consensus sequence
atgcgtgcacggctgcgcgcctgtggcatccgcccgatcaacaacatcgttgatattacgaactatgtgatgctggaatacggccagccaatgcacgcgttcgacgcttcatacatttcctccggctccattgtcatccgtaaggcggctgccggcgaaaagattaccacacttgacggaaacgtccgcgagttgacaaccgatatgctctgcattgcagacggcgaaaagccggtcgcactggcgggcatcatgggcggtgaaaactcggagatcaccgacaagaccgtaaccgttatttttgaaagcgccaatttcagccgttcgtcgatccgccgcacctcgcgtgcggtcggtctgcgcacagacgcctcacgccgatacgaaaagggtataccgccctgtacgacgatgccagcactcgaccgcgcctgcgagttggtcgagcttctcggcgccggtacggtaatcgacggcacgatcgacgtctgcaataccgacatcggcgagcgcacggtcgactttgattatcaaaaaatcaatgcactgctcggcattgctttgagcgagacagaaatgcgtgcactacttgaaaagctctttttccgctttgacggcgacggccgtatgattgtaccgccctaccgctgcgacatcgtcaacaccgccgacatcgccgaggaggttgttcggctgtacgggtttgataaaatccccgccacccgattcgccggctgcgtgacggagggcggcgaaagcgcctaccaaaaattctgcacgcgtctgaacgctgtgatgaccgggcttggcttttatgagacttatacctactccttcatttccccgaagctctatgataagctcgcgcttgcgtccgacgacccgctgcgcgacggcatccgtctgctgaacccgctgggggatgatacatcagtcatgcgcacgacggctgtcggctcgctgctgggtgcgctggcttataaccgcagtcaccgcatcccctcctgcgcattgtttgaaaacgcgacgatttacgccaagcccgatgcgtcgacgccttccgaccttttctctaacgaggaaaagcagcttgtctgcggcttttacggcagcggcgatttttacgacttaaagggatatatcgctgcgcttgcagatacgctgcacatagacgcgttgcgtttcgaagcggaggcgtcggtaccctacttccatcccggcagatgcgctgccgtttatgccggcaaagcgctgctcggccgtttcgggcagctccatcccgccgtgtgcgacaattttgaattaccgggtgacgtatacgccgccgtcctttcgaccaaagcgctgtttgccgctgcgcagaccgaatgggaatacagaccgctgcccgtctaccctgctgtcgagcgtgaccttgcactggtaatggacgttgcaacggaggcaggagtggtggaggacgctattcgcagctatgcgggcaaatcgctctgcggcgtgacggtgttcgacgtctacaccggaaagggcgtggctgacggtaagaaaagcgtggccttccggctcagcttccgcctgcccgataaaacgatgaacgacagcgaggtcgacgccgcggtgactaagattctccgccgcctggaaagcgagaagggtattacgctgcgtgcctga

SEQ ID NO: 1665 - DNA, 1050 bp, Unknown
  Artificiall/Consensus sequence
ttgaacagcttttttgacattgaacagagggctgcgggctatgtccggctcctgacggacaaacgcgagacgccgctgcgctatacccgcgcgggcgaaccctttgcgcttttgctccgcctgcgctgtccgccggcgttcacccgtgcgcgcttttatctcggaaatgacgacggcatcctcgtgcagggtgcggagacatcggtcttgcgggaaagggagacgacgctgctgcgttcgccggactgtacgctggataagggcctgtatttcttccattttgaactggagaccgaaaacggcctgcgttataccagcgaggagatgttcggctgcacgctcgcggaccgtttcagcggcgagtggcagctccttgtttacgacgaagaacctgcgcgcccggatgaccccggtatcatttaccacgtttttgtcgaccgcttccgcaaagcgggcgacgtcccccgccggccggacgcggtctaccgcgaggactgggggggcgggatccctgaatatgccgatgtgaagggcggatttctgcgcaacaacagctttttcggcggcacgctttacggcgtgaccgaaaagctcgaatacatccgcgcgcttggcgcgtcggtgatttatctaagtccggtggctgaggcgtattccaaccataaatatgacgtcggggattttatgaaggttgatgcgggcttcggcggcgaccgggcgcttgccgagctgaccgaaaaggccgcttcgctgggcatccgtgtgatgctggacggcgtgttcaaccacgtcggcgacaacagcgtgtattttaacaaatatgggacgtatccgtcgatcggcgcgtaccagtcgaaggagtcgccgtatgcggattggttcacgttttatcgattccctgatctgtacgaatgctggtggggcgtgaccaatctgcctaaggttcgcaaaacgccggaatatcaggcattcatcaccgagcaggtcatcccgcattatatgcgtctcggcgtcggcggctggcggctggacgttgtggacgaatacagc

SEQ ID NO: 1666 - DNA, 1224 bp, Unknown
  Artificiall/Consensus sequence
atgaaatgggggattacagacttggttaacgactggatcgaaagcatcaaaaacgcattggaagcatacggcaagcaaagcgacgaaacactcacttcactgtacgccgccgcgcgggacgaatacaacaaaagctacaatgcggcgctggatacactcaacgcgcaatacgaatccgacaaaaaacaggcgtacacaaaaaaagcggccgacgataagaatatgggtgaatatttagccgcacgcgggctgtcgcggtcgggtgagagcgtgaacgcgcgcattgcatcagacgtttcgcttgggaacaccttgtccgcgctgtcaagcggactgcgcgaatcgcagaacacgcttgcctccgattacggcaaggcgctggcgaatcttgcgatagaggaggcgaacaaaaaagccgagaacaaccgctggacggcagagttctccgcctcgctggcgagcacggccgccgataacgcgctgcgtgaggaacagaaccgtctcgaccgcgataaattcaaccataccgtagaaatggacaacaatgcgctcaatgatctgaaagccgagctggaagcatacgaagcggagctgaagaagcgcgaagaggcactcaaggaggccgaaagcaacaagccgggcacaggaaacacagggaatacaagcgcatcggacgacacaccgggaaatacgggcggcaacgaggacaacaactcgatgctcaaccctgccgaactggcaaaggatatcgtctcacaatacgcgacaggcaaaacgctttccacgcaggcggaaaactttgccgttctcaaatacctgcgcaatctcaaacgcgagggcatcgacgaggcatattacgactctcttgtttccaacctgaaggcgctgggctttacgggggcgaacgtaaactacaatacgctgcttgacacagtcaacgacagtattgaaaactattatcgcctgcaggaagagctttacaatctctatttggaaaaaggcttcagtccggaaatcgcgtccgccggttccaaagaccgggcacagggactgcagtatgaatacctgtacagacactcgccgagcatatccttctttgagctggccgtctatgcggcggatctggacctcgaccatctggaaaccttctacagccatgtagaaacaaacaggcgcgacccgaatgaatatgacatcgtactcggcggtgcgctgaagcattga

SEQ ID NO: 1667 - DNA, 1548 bp, Unknown
  Artificiall/Consensus sequence
atgtgtaagagaacctttacggcgctgctcctctgcgctgcgctgttgctgacggtactgcttgccgcctgtaaggcggaggaagaggacagcggttcttctgccgtgagtgccggcccggcggtaagcggcgaaggcttggacgaataccacgacgcggccggaaaatattggccgtcctattccgacgagcagcgggacgaaatcatcggcggccgcaccgaggtgcgtgtgctggtgtacaataacgtcaagcagtctacgtattattccgaggagatcgagccggaactctatcccaataccgacgccaagctcaatgaagccgtgaccgagcgcaacaactatgttgcacagcagcttggcgtggaggtcaaggcagtgccggtggacgacgtactggccacaatgcggcaggagatgcttgtgccgtcggatacgtttgacatcgcgatgcccttcctcaatgcatgtgccgtattggcgcaggaaaacgcgttctacgacctgcgcgaattcgagcaggaggggatccttgatttgagtgctccgtggtacgaccagaacgccaacgcttcgatttcgattgagaaccgttcttatttcacggtcagcgacatgtcgatcatgcagaaaatcgtgtccttctcggtcacgtataatcccgagctgctggcgacgaaatttccggacctcgatttgttccaaaccgttgtcgacggagaatggacgctggacaggatgctcgagctgggccgttcgtttgcgggcgacgcagacggaaacggcacgatggattataccgacgagtgggggctggtttcctcacagggcgacgccatccagttttatctcgcgtcgggcgaaacgctctgcgccaaggatgagaacgatgaccccatcatcagtatcggcggcgcccgttcgctgagcgtgtcgcagaagattctggaaacgcttcagcagaaggattgggtaatcctgtatcaggatatcctcgcgcagggcgtccccgcctcggagggctcgaacaccgcgctgcgcatctttggcgacggacgggcgctgttccgcatctccgccttttcggccattaagaagctgcgtgcctatgacgttgagtacgccgtcgtaccgatgccgctggccgacagtacacagaccgagtattatacgccctgcagcgcagtctatgcgtatggcatcggcatcccgagctcgctctccgaagaagacgcacgcttcgctgcttacatgatggatgtgctttccgccggcggcaaggaatacatagccacggcgtattatgaccagattcttaaaaacaaggatgcgctttccgacacgagcagggaggtcgacattcttgacctgattttcgagaatgtcgtgtatgacgtcgggtatatctacggcttctcgggcctgagcacgatgcatacgacgctgatggccaatgactccaccgatatttcctcgcaccttgagtcgatccgcagtcaggtgaaccagaagatagaggaagttatcgcacagttcagaaaataa

SEQ ID NO: 1668 - DNA, 948 bp, Unknown
  Artificiall/Consensus sequence
atgaaagacggcatcacacgcatccagcggcgcagtgccctgctgcccgtactggcaatcctgtcacttcttatgacgggtgcttccattttctgcatcatttttccctacataaaaaaatttgacgatatgcttttttatgccttcctcgcagtaggcggtatcgggcttttatacttttcatatatgtttgcaagctcggtttaccgcatctttatcccgcagaatgcattgctgatcgacgagaacggcttttgcgattatacagtctgccaagcgggaacgggcttcgttccgtggtcgaacgtcgacagtatcaaggttttcggcccggaggatgagccgctgctcggcatcacgctcaaatcgatcgaccggctcgaggagatccccgacaaacgggtgtacaaggaattatccgacaatatgaaaaccggtgtgcccgagatcatcatcaagcaatcggacgtcaaaatgccgctgcggcagttggaacgcgtgatgaagcgtgccgccgggctggccgacgccccgtctgcgccgaaaacagacgacgcgacccgagaactgccgttaaaggacatcgtcccaaccttgaagcaggaagccgccgaagcggaaagcgcagaaaaagcagatgatttcgaggcgctcgccgacctgttcgcccgcaaggaggagcggcccaagccggcggaaacgattccgtcacagcccgagccttcggagccggcttcaccgcgatccgaaccgtccgcaaagccgtcagacaaaaccgagaaatccatcgacgagctgctcgaagaactggctgccacgctcaaagcaccgtccggcgacacggacaagtccgccggaaccggctacggtaaaaaattagaagcgctgctcgaagagctgaaagccgatgcaccgtccaaggatgcggatacaaaaaaagatcaataa

SEQ ID NO: 1669 - DNA, 1125 bp, Unknown
  Artificiall/Consensus sequence
gcgcctctgattccgctgtcactcgggttgttggtagcctttcttttcggactgatcatgcggcgaatgaagcggagaaatttgatacagatcgtattttttctcctcttttttgccgcgtatatgtatgtgatgtccaacagcgaagacattttcatctttattgaaaatgcgggcagtgatttctggaatcgtgtgaccaacgcttattttccggcggcactgctttataacgcgatcaacggtgatttgctgagcctattgggtttcgcggcgatcaatgccgcgccgatgctgctggtgactgcgctgctttccaaattctttttgaaaatgaccgcgcttctcaagcaaagcgcaaaaaagtccaaattcgtgatgaagcatcagaaaaacagcggactgttcggtgcgcttttgagaaaggaatttcagcgctttaccggctcggcaacttatatgctgaactgcggaatcggacttgttctgctgcttggaatcgccattgccagtttcttcatcggcgacgatatttttgcacaagccggattcgcagacaatggacttatggtattcagtaccgccattcccctgtttctgttcttctccactttgacgacaacgacctcggtgtcggtttcgctggagggacacgcattatggattttgaaaaccgctccggtaccgacaacgacgattctcagttccaaaatagcggcaaatctgctgctttatctgccggcacagcttgttgctacaattttgctgacgattcgctttgggctgaatgtgcaatacgcgctgtttttgtttctcattccggcggctgctcttggaatcactacagctttggggctcatccttaatctcgcctttcccaaactcgattacgataatgaaacgcgtgtcatcaaacaaagcatgagcgtttttttgtctacaatgatcaacattctgctgaccattgtattctcggtcccgctgtatgtgctattgattccatacgctccattttttacgttgcttgctttcgcttattttcttattcttggcgccgtcgccgctctgctctgttatatcctgagaagctggggcgtaaaaaaatttaacgtcctgcctgcatag

SEQ ID NO: 1670 - DNA, 1146 bp, Unknown
  Artificiall/Consensus sequence
taccgcgacaacgcgaaccctgcaaatttttctgactggcagctttttattgacgatgtgtttctcgacggttacaacgtagatgcactcaacgaggctgtcggtgagatgaaagcagggctcggttcggagtacagcggctataaggcgcgcatcttcctgacttgtatgtaccccgtcaaaacgcagacccggttcggggatgtggacggcgacggcataacggaaaatttcacgaacctcgacgaccggctggcagccatcgagtggatggtcgacgagcagctcgaacgctttatggccggcaattacgagcatctggagcttgtcggcttttactggtttgaggaggacttcgccgagtccgacccgcacgaattggaactggtcaagcatttcaacggttatgtgcattcggccggcctgaaaacgatctggattccctacaacggcgcgccggggtatgaccgctgggcggaattcggctttaacgtcgcctgttatcagccgaattatatgtttaacgcaagcactaccgaatcgctgcttacctatacctgccgcacggcgaacgaactcggcatgtgcgtggaaatcgaagcggcaggcacaatgcttcgttctgccgaatattacaatcgctatatggattatctgcgcatatgcaccgaacagggtgccggaaacgcgattaaaatgtattacaacgaagctgtcgacggcgtattttacaatgcgtaccgttccagcgatcccgcaatccgcaggatttatgatttgacctacaaatacgccaaaggcctgctgcaaaacggcgactgtcaatactatcccgtgcgcagaccggcagaggattatgaaattgtctcgctcggcaagccctacaccgcttccgcgccgtataccgattcggagctggactatgccgatgtaagcggcctcgagctcaccgacggtgtatttggttcaacgcagtacggcacggaatggcatcctttccatcgttggcaggcagaaagcgacggcagcttccgcatcgaccttgacctcggtgccgtgtatgacgatctgcgctacttcgcactggagctgaattccgacgaaggtgcgggcatcggtctgccggcttcggtggaatacttcgtc

SEQ ID NO: 1671 - DNA, 1176 bp, Unknown
  Artificiall/Consensus sequence
tggggcggcggtcacgatgagcgtgagcagacgctgaaccagcttcttgtagaaatggacggctttggagtaaatgacggcgtcatcgttattgccgccaccaaccgcccggatattctggatcccgcgttgctgcgtcccggccgtttcgaccggcagattaccgtcaattatcccgatatcaaaggccgtgtagaaatcctgaaggtgcatgcccgcaataagccgctggaagaaaccgtcgatctcgaaacggtcgccaaatccaccgcaggctttacaggcgcagatctggccaacctccttaacgaagccgcgctgcttgctgcacgcaaggggaagaagctcatcgggatggaggagatcgaggaggcaaatatcaaagtcatcgtcggtccgcagaagaagtcccgcgtcatcaaggaagaggaaaagcgcgctacggcttatcacgaagccggacacgcaattgtcgaacatttcctgcccacacaggatcccgtgcatcagatttccattattcccagcggcagagcgcttggttatacactttctctcccgtcagaggacaaaaacagcatctataaaaatgagatgctggaaagtatcgcttcactgctcggcggccgcgttgcggaaaagctgatgcttaaggatgtttctgccggtgcttcgaacgatatccagcgtgcgacagaaattgcacgcaaaatggtcacgcagtacggtatgagcgacaggcttgggccgattgtgttcggcaccaatcatgacgaggtgttcctcggcagagatttttccaccggtcgcaattattccgaaaagattgcttcggagattgatgacgagatccactcgattatcaccggtgcgttcgaaacggcggagcggattctaacggagcatctggagcaaatgaaattcattgccgagtacctggtcggcagggaagtgatggaccgcgatcagttcctggctgtgtttgaagaaggagcaacctttgagaagctggatgccatcaaagaagaaaaagtgcaaaaaagcaaacgggaaaatgaggaaaagcgtcgtaaggcggctgaagaagaggctgcaaaggccgctgagcctcagtttatcgaaacggatgaaaagtccgacgaaaacaagcccggcaatggttccgaacagcattaa

SEQ ID NO: 1672 - DNA, 465 bp, Unknown
  Artificiall/Consensus sequence
tttgtcaaggtattcgtcttcggtgttgcaggtaaacggcgttgtatttgtgtacatgatgcattcccttattttttagatgtatgccaacgtaaaaagtcttttctgtcattttatgctttcccgtttccgcggtgtcatatgctggcacttacatgtgccgtgattatagtgtattataatgacattatcaagacttttttaagggggattttaatgttttcggaaagattgaagaaaaccggaaaagcgaagggtttcaccgcgaaggaaatggcagattctctatacataagtttacggaattaccgcaaatacgaaagcggagatgcaagaccgactatagaacgtttcgtgctgattgcggacttgctcgacgtttccgctgattatttgctgtgccgcgatgcatttctcacaaagcatgatcattcaatttacaaaatgaagcaggataacaaataa

SEQ ID NO: 1673 - DNA, 729 bp, Unknown
  Artificiall/Consensus sequence
aacgactccgagggcaccgtcctcctgtccaaaaagcggctggacgtcagcaagcatcttgcggagatccaggctgcggtcgaaagcggcgaaaccctgaacggcaccgtgaaggaaatcacacgcggcggtgtggtcgtgcaggtcaagaccgcgaccgtattcgttcccgcctcgcagtgcggcctgccgaaagacgccgacctttccgagttaaagaacaagaaagtgccgctgaagatcctcgagtacaacgagcagcgccgccgtgccgtcggttcgatccgcaacgcgctccgtgcgcagcacaagcaggaggtcgaagcattctacgccacgctcgaaccgggccagaagttcaagggcaccgtccgctcgctgacaagcttcggcgcgttcgtcaacataggtccggtggatgggatgatccacatcaccgagttgtcctggggccgtctgaagcagccctccgaggtgctgaaggtcggccagacggtcgacgtgttcatcaaagcggtcgaccccgaaaagaaacgcatttcactcggctacaaaaccgaggaaaacaatccctggaatattttccttaagacctacaaggtcggcgacgtcattccggttaccattgtgtcactgatgccgttcggtgcgtttgcggaaatcattcccggtgtggacggtctgatccacaattcgcagatttcggataaaatgatctccaatcccgct

SEQ ID NO: 1674 - DNA, 768 bp, Unknown
  Artificiall/Consensus sequence
atgacgcgcacggcctatctgcacgttcccttctgccgttcgaagtgccgttattgcgatttctactcccgtccctgcgggaacgaagatcagcttgaagcctacacccgcgcgctgctgcggcagatcgggacggcggagcggtcggcgctgtcgagcatttatttcggcggcggcacacctgccatcctcgggacgcgcagactggcggcgctgctggaggcgctcacggcacgcttttcggttgaagcggacgccgaaatcacgctggaaatcaacccaaattcacttggatgcgccgatctttccgcgctgcggagggcggggttcaaccggctatcgatcggcctgcagtctgcgctgccgaaggggcttgcggtgctggggcggacgcacacggcggacgacttcctccgctgcacagacggcgcgcggcgggccggtttttccaacctgtcggcggatatgattttcgctgtccccgggctgtcggttaaggaaaacgcgttgactgccgtatttttagccgactgcgggccggagcatatctcggcctacgagctgtcctacgaagcgggcacgccgctgacgcgcgcgctggaggccggaacgatttccgcccacggcgacgaggcagcgggagagatgtacacgcagatctgcgcgctgctgcgcggacagggctatgaacattacgaaatcagcaatttcgcaaagccgggctttgcctcgcgccacaatctgcactactgggcctgcggcgaatac

SEQ ID NO: 1675 - DNA, 594 bp, Unknown
  Artificiall/Consensus sequence
atgcaattcaaggaactttgggaaaaggtcaaaaaatacgactacaaaaagctgctctgcgcacgcaattacgttattgcgggctgcgtggcgctgctggtcgtagccgtcatcctcaatgccacgctgggcggcagcggcggtgatgaggacgtgctcggcaacgagagcacgaagattttaggcaactccgtccttaccgacgcaaacgccgacggcaacgagggaacggataccgaaacggccgaggacttcttcgcctccgccgtgatcaaccgtcagcgtgtgcgcgacgaggcgatggagacgctgcgccaggttgccgacagccccgacgctatgcaggaaaccaagaatcaggcgctcaaatccatcgaggatatggttgcggagatgaacagcgaggtcaacatcgaaacgctcgtcaaggccaaaggctttgaggaatgtgttgccgttatttcagacgaaaaatgctcgatcatcgtcaaaagcgaaggattgacggccgagcaggtcgcgcagattctcgacattgctatcagcgaatcgaagctggcggcagacgatatcaaaatcctcgaaaaggtcggc

SEQ ID NO: 1676 - DNA, 1515 bp, Unknown
  Artificiall/Consensus sequence
atgcttaaaaaatggatctgcctgctgctttgcatctcgacacttgcattgccgttgcttgcgtgcggtgccgacccggcagagacgtcctccgcgtcgggagactcgaatgcagaccaaaccgcgtccggcgacgagtcagacgtttacgtcgccgatgtccccgtgatagatatggaagggcgcgtattccgcgtgctgtgccgcgattacggctacggttcaacctccattaccggcttcaacggggaagtcatccagcgtcctgactatgatgaagcgaccgcaggcgtcgtcgatcaggcgaaggccgaggtccgccgccgcgtggaggagcgttacaattgcctcattgaaggtgatttcggccaaggcgacgttacgcagttcaatgatatcatccgcaacgacgttttgtccggcagcggcatgtacgacatggtgttcgatacatacggctattcctcccaactggtgacaggcaacatttatgtggatctgaacacgattgaatcgctcaatttcgaccagccgtggtgggaccagaacgccaaggaggatctttccatcggcggcaagctgtactttatggtgggcgatatcaacacctttgataatgacggcacctgggtcatcctgttcaacaaaaacctgaaaaacgacctcggcatcgatgaggacctgtatgcgcttgcacgtgacggcgaatggacgtttgacaaattcgcggagctgtgcaaaggtgtgacctacgactccaaccgcgacggcgtcctggacgaattcgacacgtggggttttgtgaccgaaaaatacaacgttctcatccatacccttgccgccggcgaaaatattgtgcgcaaggatgcagatgacatcccgtacttcaccttccagaccgaaacgacctacaacgcgctgacgaagatcatggacttctatatggatacgaatacggtgatgattgctgacaacggccggtttgacaacaagggctataccaacatttgggaagaaacaatcgttaaggccttccgggaggggcgggcactgttttactgctgcgggctgatgaacgtccccggtttccgtgcaatggaggatgaattcggcatcctgcccgttcccaaaaccaatgccgatcaggacagttattaccattcggtttccagaaccaatatgtcggcgctcagcattcccaactccaaaacggattacaccgaactgggctatatcatcgagtctctcgcggcggaaagcaagaacaccgtgacgccggcgtattatgaaaaaagcctcaaataccaatcatttacggatgacgagagcggcgagatgctcgacatcgtctttgcgtcccgttccttcgacctcggcaccgtctttgactggggcggcatcgtggggcattatatgaaaatcgacaccgattttgtctcacggtttgaatctgtgtaccctgtcgcgcaggcggcgctggaggacacgctcgaggcaatcgagaatctcaactga

SEQ ID NO: 1677 - DNA, 594 bp, Unknown
  Artificiall/Consensus sequence
ggcgggatgaacctttatgttccagctatgattgagatactgcttatttccgtatccgtcgccatggacgctttcgccgtctcgatcggaaaggggttgaccgtcacgcgcgtgcggccggtcgacgtcatcaagaccgcattgtggttcggcggcttccaggcattgttcccgcttctgggctttttcgcggccaacacgttcagcaaatacgtcaccgcggttgatcattggatcattttcgcgctgctcgcgttcatcggcggcaacatgatccgcgaggcgttcggcgaggaagaggagaacagccgggagacggcccagttcgactggcgccatatgctgccgctcgcggtggcgtgtagcatcgatgcgttcgccgtcggcgtgagcttcgcattcatgcaggtcaacatctggttttcggtgatcgtcatcggcgtggtgaccggcgcgttctccgctgccggcctgtatatcggccgcgtgtttggcgcacgctggcagaagccggcgcagatcgccggcggtgccgtgctcgtgctcatcggtcttaaggtgctgcttgagcaccttggcttcatagcatggtaa

SEQ ID NO: 1678 - DNA, 1257 bp, Unknown
  Artificiall/Consensus sequence
atcagcgacaatcacaacaaacgacacccacgcgcgggcacgcccgcgagatgtgatgaagagggaaccatgaagaaaagcctgcttgccttggcttccggcgcgttcatcctcggcgcggccgaattcgtgatgatgggcatcctgccccagaccgccgaggcgatgcacgtcgatatcccgaccgccggccacttcatttccgcctatgcgatcggcgtgtgcatcggcacgctgatcctggtgttcgggcgcaagatcccgccgaagcagctgatcatcatgttcatggtgatcgccttcgtcggcaacgtcctgtcggcgttctccgtcaatgcgcccatgctgctgactgcccgtttcatctcgggactgccccacggcgcgttcttcggcactgccacgctgatcgccaagaccgtggccgacaagggcaaggaggcgcaggccgtctccgccatggtcaccggtcagaccgtcgccaacatgatcggcgtgccggccggcacgctgatgtcggagttcctgtcatggaggcttgcgttcatcgtgctcagcgcctgggccgcgatgaccgtgttcctcgcgctttcctgggttcccgccatcgcgccggtgaaggacgtcggtctggccggccagttcaggttcctccgaaagcctggaccgtggctgattctgggcgcggtgttcaccggcaacgccggcgtgttctgctggtggagctacgtgtcgccgtggctgcagaagaccggcggatacgacagcgacatggtgccgttcctgatgatgctcgccggattcggcatggtggtcggcggcatcatcggcgggcgtatcaccgacaactggcgtcacgcgggaaccgcagccctcgggcaggcgatctccggcgtcggcctgctgctggtgttcctggtgcccggcaaccatgtgagcgccgccatcttcacgttctggatcgcgttcggcctgttcttcatctccgccccacagcagctgctgatgaccgaatccggcaagggcggcggcgagctgctggccggcgcggccgtgcaggtggcgttcaacttcggcaacgcggtcggctcgatggtcggcggtggcatgctgaacttgtcaggcatgaactaccacttcaccgcattgggcggcgtgccgttggcggtcatcgcggtggcgctgctgaccatatactccatgcgtcacgagacgcacaccgacgcgctggagcgtatgcgcgagatcacggtgtga

SEQ ID NO: 1679 - DNA, 327 bp, Unknown
  Artificiall/Consensus sequence
atgctcatggttcaacagtacgccgtgtatcgcccatcaacgtcagtgtcgacatctcatgtgggcccgatatgcctgtgggcgacattttcaagccttgattggcgatatctcgctttcaaggggttgattcgagtcccatgggacatctatctgcgtttcagggggttggtggccaagtatgaacgcctccagaacggcatggttccaatggcgattggcgctcaatactccaggtatcacgtttcggcaccccctcgaaacgtagatagatgtttcgcggccgtcgaatcaacccctcgaaatgcagatagcgtcggatcgtag

SEQ ID NO: 1680 - DNA, 951 bp, Unknown
  Artificiall/Consensus sequence
gtgggcgcaccactggccgatgcgcatcatggggcagccatgatggcgagcgatgacgatcaaaggcgcgaacgccacgaccagagacaacgaccgacagacgaggttgatgcagacatggatttgcgagaaatgacacaggccgtcgcccaagtggcgcggcatgccggcaggcacgcccttcaggagcaggtgaacccccacgacctatccacgacgatggtgtcgcccggcgagacgaaattcactagcgaggtcaacacccggctgattcgctatacccgcgcgcgactgtccgaaatcgaaccgttccagggcttctgggaggagcgtccggaggacaaccagccgggggagaggtactggtgcgtcggcaatatcgacggagccatcaatttcatccgcaacatggccgaatggaccgtgaccatctcactgttcgagttcgacgagcactgccatgcgtgcccgatcatgggtgtggtccatgcgcccgccatgggcatcacgtacatggcggcgaagggccagggcgccatcaggatacgccgcaaccccgtgggcggcgacaagcgcgagaaggtcatgccgtcgatcactgcgacgttggatggctccgtggtcagctacggcatgtcgtatgtgccggaggagtccaagcgggccctgtccgcggtagcctccatcgcgggtaaaccggccgatatcaagcgagtgggtccggcttcgatggatttgtgcaaggtggccgacggcacgtacgacgcctatttcgagcctcacctgcacaagtgggatgttccggccgtctcggccggcgccgtcgtggtatgggaggcgcaggggcgtctgagacagtggaacggcgagctgatccattggcgtcgcgagaacgatgtcgtggcgtcgaacggcctgatcggcgacgagctgcagccgtatctgcagtga

SEQ ID NO: 1681 - DNA, 1278 bp, Unknown
  Artificiall/Consensus sequence
atgactgacactcccaatgcatccggcgaacccgacgagctgtatctggacgccgctgccaccgagccggtgaccaggaacgtcatcgaggcgatgatgccgttcatgaccgacgcatacgcgaacccggcaagcatgcatcaacccggcaagacggcggcgagggcgcttgatgccgcccgcgcctcgttcgccgccggtctcggcgctcgcccggacgacgtgatcttcacttccggcggcaccgagtcggacaatctggccatcaagggcatcgccatggcacgtatgcgcgcactcggcctgcagccggtctacggtcttgccggaatcgatgacgagccgtccggcgtgaaccccgcgcaggccggtgaacatccggcgatccgccgtccgcgcatcatcatctcatccatcgagcacccggccgtcgcgcaatcggcgcaatggctgcacgaatggttcggcttcgaagtcgtgcacattcccgtggacggtcaggctcacctcgaccttgacgcgctcgaacaggagctcgacggcgaggccggtgaccgcaccacgctggtttccgccatactggccaacaacgaggtcggcaccgtcgaacccgtggaggagctggtccgcatcgcccacgcgcacggggttcccattcatgtggacgccgtgcaggcggccgggcagattcccatccgcatgcgcgattgggatgtggacgcgctgagcgtgtccggacacaagttcggtacgcccaagggactgggggcgctgctggtccgcggtcgaaccccgatcgagccggtgctttccggcggcggtcaggagcgcgggctgcgctccggcacgcagaacgtggccggtgcggtggcgctcgccatagggctcaacgagtcgaacgcgcgcatggcggcgcagtaccgggagctgacagattcccgcgacatgctgattgacgccgtgcggcgggtggtgcctcgcgccgaactcaccggcgacccggtcagtcgtctgccgggacatgcgtcattcattttccccggagtcaccggcgaagctctgcttgtcgatctggacgcccgaggcatagccgcctcgtccggatccgcctgcgccattggccgtcacgagattcccggcacgctgcttgccatggggctggaaccgcagatcgccaaatccgccctgcgtatgacattccgccgtcccctcacacgggaggaaatcgagcgcatctccatggccttggaagactcctacaccgagctgacgtattag

SEQ ID NO: 1682 - DNA, 792 bp, Unknown
  Artificiall/Consensus sequence
gtgatacttgaccgacaaagccgcatcaacacgaatgacctgaaaacccgactcgatgccgtgggcatggaccgggggtctttttcgccggaagaactcaccgaattcgtgaatctcatgcaagtctacgaaggcgcgatgtatgagataagcaccaaactggagatccttgattcggagttccaggtgcggttctcgcatgatcccatccatcacatggaacgccgtctcaagtcggtgaactcgatcctcggcaagctcaagcgcaagacgctgccggtgaccgtgtcgtcgatcaaggacaacctgttcgatgtggcaggcatccgcgtgatctgcaactaccgcgacgacgtgtactccgtgtcgaactatctgtcggcgcagaacgacatctccgtgctgcgggtcaaggactacatcaagaaccccaaacagaacggctatcggtcgctgcacgtcatctatgcggtgcccgtgttcctctcatccggcgcccactacaccccggtggaggtccagttccgcaccatcgcgatggattactgggcgagtctggagcacgccctgcgctacaagaccgatctgccggatgcaaagctcgccgagcactcgcagacgctgcttgattgcgcgcggagcctgcagaacatcgagacccagatgcagaacatccaccgcgacatcaacggcgcgccgcaggtcgaggagacaccgaaagccgaccaagctggtcgaatcggcccccgtcacgcatcctccgccctcgctgacgggaacggatccgtctga

SEQ ID NO: 1683 - DNA, 717 bp, Unknown
  Artificiall/Consensus sequence
atgaaaggagtcgacgtgagcacaccagcacccacctcgaaaaacgccacgcggcaacgcgatgacgccctgaccgaaaggcagcatctggtgcttgatgccatacgcaagcacattgcggaacagggattcgctccgtccttccgagaaatcggcgaagctgtcgggctgaagagcccgtcatcggtcaagcatcagcttcatgcgctggagcgcaagggctatcttcatatcagcgccaacaagggccgcgccatcgagttgtatgattccggcacggactcgcaaaccgccacggtactccccttccccggggacacggaggccagcgagtcgattctcgcatcccgtgacgtcccgctggtcgggcgcatcgccgccggcgtcccgatcaccgccgaacagcacatcgatgatgtcatgcggctaccgcaacggcttacgggcagcggcaaactgttcatgctcgaagtgcacggcgactcgatgatcgacgccgccatctgcgacggcgactacgtggtcatacgcgaacagccgtccgcagtcaacggcgacatcgtcgccgcgttgctcgacgacgaggccacgatcaagacgttccgcaaggacaatggccacatctggctgataccgcataaccccgcatactcccccatcgatggcacccacgcgcagatcatgggcaaggtcgtcagcgtgctgcgtcgactctga

SEQ ID NO: 1684 - DNA, 1362 bp, Unknown
  Artificiall/Consensus sequence
atgaggaagcgtatccaggcctggctcagggggccgatcatcgccatcggctcgatggcgttgtacgccatcgccctgggctgctttcttgcgctcatgctgctggtcatctcgatggaggaaggtggggaaaacctgtcgtcctcgacgttggacatgacccgcatcgtggtcctgctcagccagggcatcggattcgagaccgactcgctttccctgtccatcatgccgctgctgctcaccgtgctgctgataggcctggtctggtcgttcagccggaagatatgcacggatatccgcgcatacgtcagcggcgtggtggtctggattttcatcaacgtcatgggcacgcagtcgcttcccgtcggattgcttgactggccggctctggtatgcgtcaaatcggccgtggtgttctcgcttggattcgccggcgccgcgctgtcgaagggcacgctctccgggcagctgcgtgaacttatccgtcatcatgtgtccgacggcgtgcgccgcacgatcaggaccggactgatggtgggtgtcatcatgatgggcgtgtacctggtcatgggactgatcaccgtcatcgtgtggggcgtgctgaaccgttcggccatggactcgctgttcgccgacatcggcatggggaccggctcgcgcatactgacgacgatcgcatcgcttgcatggctgcccaacctgtgcatatgggcggtctcgtggctgttcggtgccggattccacatcggagagcttgcgacattcaccctttggatcgggcaggggcgttcgcttccgcctcttcctgttttcggcctgcttccgcaggcagtcggcgatgaaggcatacggttcgccgtcgtgctgattccgctggtcgtcggattcgtcgccgggctggcatccatggcgatgaaatccggtttccgcatcatcgtcggcagcgcgtccgatcccctcgaccgcaaggacctgattctcgaactcgcctacccggcgggcgggttctgcctgtcgagcgtggtcatatccctgctgtcgtcggtcatgttcggggtgtcgaacgggtcgctgggaaaggccaggctcaaatacgtcggcgtcgacgtgatgcagtccgcgcaggccgtcggacgtccgagcgccatgggactgtgcatggcctgggtgctgtcgctgattggcgtcgccattgttttcgggatacgctggattgcacgaagaacgggggcacaacgagccgcaacaacgcacccgcgtgccatcgtttcccgcaagtccatacaaccaacaaccaagaaggagcacgatgaccaacacgaatcgaccgatacgacgggctctggtgtccgtcttccataa

SEQ ID NO: 1685 - DNA, 2076 bp, Unknown
  Artificiall/Consensus sequence
atgttccgcatggccgcgtgccggtacgcggccatgcttatagtggagcctatgttgcgtgaatacaccgtcgatacgatctatcagaccacagacctggacaccatctattcactgctcgccaagcgttgcgaacgcgaccccgatgacctcgtcgcccaatggcaggacgatgagacgaggcagtggcatgacgtgtccgccggccagatgaacgaccgcgtccgtgaggtggccaaggggcttctcggcctcggggtcaagcccggcagcatggtcgtgatatacgccgccacctgctatgagtggggcgtcgtggacttcgcctgcgcctccatcggcgcggtgagcgtccccgtatacgagaccgattcgcccaaacagacgggtgatatcgtcgcagaggtcgaaccggtcatcgccttcgccggcgacgactcccatgcgcagatccttgagcagattcgcgcgcacagcgagagcctgcgctacgtgttcaacttcaaggcgaacggcctcgacgcggtcgccgatttcggcgagtccgtcagcgacgaggaactggacaaggcgatcggccgcgtccgcgccgacgacctgttcaccatcgtgtacacgtcgggctccaccggcaaaccgaagggcgtgatgctgtctcaccgcaacttcaaccacacggtctacaacggctatgaggtactcaacgacatgctgtaccagccgagccgtctgctgctgttccttccgctggcgcactgcttcgcgcggtacatccagtacgtggccatcggctcgcatggcgtggtcggctatatctccagcgccaagcggctgctcgccgacctgcgcggcttcaagcccacgtatctgctgggcgtgccccgcgtgttcgagaaggtgtacaacgccgcctcgcagaaggccggagccggtctcaaggggcgcctgttcgccaaggcgttcgatcatttcgtgcagtggtcgaaggacgagatggccggcggccatcattccctgggcgcccgcatccagcacagcttctacatgcagaccgtgggctcgtcgatccgttccgccctgggccccaacatgaagtggctcgcctgcggcggcgccccgctcaatgccgatctcgcgcacttcttcaacggattcgatggtatcaccttcatccaggggtatggcatgaccgagacggccgcgccctgcctggtgaatttccaggacgcgaacgaggtcggctccgtcggccggcccggctgcatctccatcaggctcgcggatgacgacgagctgatgatcaagggggcgaacgtgttccttggctactacaagcagcctcagcggaccgccgaggccctgacctccgatggctggctgcacacgggtgacctcgccacgatcgacgatcggggattcgtgttcatcacgggccgcaagaaggacatcatcatcacggccggcgggaagaacatcagcccggcgccgatggaggatgtcatcaacacatgcccgatcgtcgcccatgccgtcgtcatcggcgacggacgcccgttcatcgccgcgctcatcgaactcgacgcggagatgacccgatcgtggcttgcctcgcagaacctcgacatcgacgcgccgatgagcgagatcgcgaccaacgacgcggtccgagcgttggtgcagcagtacatcgacaaggccaacggcaacgtctcccgcgccgagtcggtgcgcaagttcgttattctggacgaggagttcaaccaggaggacggcactctgacacccagcatgaaggtggtccgcccgaaggtgctgcagcgttacgccgacgtgatcgacaacatgatctatgctccgaagaacgccgcaaagccgctgcccgccaccgtcaagatcctcgacatgaccgccgagaccgtgaagcagtcttcggaaagcgtcaagcaggccttcgaccaggcgaagggaaagattcgcttcatgaaggacgacgaagccaaatccggcagccccgagcaggaggacagcgtgggcgacgcggcatctgacggcaacgacaccagtgaggagaagtaa

SEQ ID NO: 1686 - DNA, 528 bp, Unknown
  Artificiall/Consensus sequence
gtgctccgcgaaggctatgatggaaacgtgaatgacgtctcgaatcagccggcagcgaagcccccagccgaatcatcctccgagtccaccgaatcctcccgtttcacacgcggagacagcacgctgaccaccgtagggcggatcgtcatggtctacgcggtcgtccagctgctgatggcgatcagtgcgctcgcgtcactgtccggccttgatcccgcggcttccgtgcaagtgatcggcgggtggcgcatcggcctgcgcgtggcatggttcacgctcggcctggtgttcgcgggcaattgcgtgctgtatctgatcggcggatggctcggccgccgggccggagcggacacgtccaaatcccggccgttcatggcactgatgtggctttccgtggtgaccacgcttatcggtctgctcgccgcgcgggcgaccacatccggctgggaggcgtggttttcgcttctgatcgccgtgatactttccctatacgcgaccaaagtcgtaaagcgcagcacgcgcatctga

SEQ ID NO: 1687 - DNA, 867 bp, Unknown
  Artificiall/Consensus sequence
atgattactacgtttactattcgcaacgtcgccaatgaagacggtgccgcgcagatcagcgatttcggcgctcacgtgctctcctggacgcccgcgggcggccatcccgccgtatggcagcccaaggccgtctatctgggcaaaccgatccgcggaggcgtgcccgtggtactgccatggttcgcactcggtttcgagcatggcgaaatcgccggtaagaagccgaagcacgggttcgcccgcaccactgtctggcatgtggacgaggacgcgaccgacgaccgacgcatccgatacacgctgtccgacgccgacgcgacgcccgaactgctcgcccagctgcattccggggcctccccgcggttccatgcggtctacgacatcgaagtcggcaaggagctgaccatgacgctgaccgtcaccaacgacggtaccgagccgctgcgctatgagaccgcgctgcacacgcacttccatgtcggcgacctgacccaggtgagcctacacggattggagggctccgactatctcgacgccacggtcgccgggtaccctccccgcgtgcagcccgatgagccggtgaccttcgacggcaccacggtcgaccgcatctactactccaccgacacgttgcgtctggatgacccggcatgggatcgcgtcatcgtcatcgaggcccatggcacgaagcagaccgtcacatggaacccgggaaccgcggccgacaccgaaatcggcgacatgcagcccggcgaatggcgcgatttcgtagccatcgaggcagccgcctgccgcgagtatgccatcgagctcgctcccggcgaatcgcacgcgctcacgcagcgcatcagcgtcgagaaccgctga

SEQ ID NO: 1688 - DNA, 945 bp, Unknown
  Artificiall/Consensus sequence
atgactgatacaaccgtcaaaaacaacgaaacgacacagaaagagtccgacgagagcacgtcgaagggcgatatcaagcacatcggttacgccggcctgatcgcgcgtcgtttcttccgtcagcgctccgccgtggtcggactgatcatccttctggtgctggtgttcttcgcgctgttcggcgccaacatcggcaagtgggcgtatgacgaccctgacttcctcgccctgtcggcaggtccgagcgccagccactggctgggaaccgactccggcggctccgacctgtacgccatggtggtgcgtggtctcggcaagtcgctgatgatcggcatcatcacctcggtggcgacgatggcgatcgcctcgctgctgggaacggccatctccttcttcggcggctgggtcgagcgcgtcggcatgtggctgctcgatatgctgctcgtcgtgccgtcgttcctgctgatcgcaatgatcgtgcgcaccgcgaacgccaccaccggatggatctggctgatcatcggcctgaccgcgttcggctgggtcggctatgcgcgaatcatacgaacgctgacgttgtcgctgcgcgagcgcgactacgtcaaggcggcccggttcatgggcgtcggatcgttcaagatcatcgtgcgtcacctcatgccgaacctcgcctcgatgatcatcatcaacacggtgctgggcgtcgtgggcgctgtcaactccgagaccgcactgtcgtaccttggtctgggcgtcaaggcgcccgacgtgtcgctgggttccatcctgcagtccggcgccgtgtccatgcagaccgctccctggctgctggtcttcccctccatcgccctggtcctgttgacgttcagcatgcagctgatcggtgacggtctgcgcgatgcgcttgatcccaattcacgtgcgagcggaacggtgggtgcctga

SEQ ID NO: 1689 - DNA, 855 bp, Unknown
  Artificiall/Consensus sequence
cacacgcacgcagaaggaaacatgattcgacaggtgaagcatatgggtcaggcagacagcacaagcatcggaccgacatcaggagcggatgtgaggcaaggggcggccggtgagttcggcagcgtggagtgcaacgacgtggagtccggcagagccactgatacggataccactccccgcgaagctgcggcgacgccgattcgcgtggccgtcgtcgacgaccatgagatgttccgcgccggtgtcatcgccacgctgcagccgtacttccacatcgtcgggcaggccgccgacgtggaaggctcgatcgcgatgatcgccgacatcagaccggacgtggtgctgctcgacgtgcacgtacccggcggcgagggaggaggaggcgcggagatcctcgccaaatcgcagccgctctcccccgcttccgcgttcctggcgctgtcggtgtcggattcgccgcaggacgtcggctcggtgattcgtgccggcgcacgcggatacgttaccaaaaccatcaccggcgacgatctgatctcatccatcaagcaggtgcacaaagggtatgcggtgttctcgccgaaactggccggattcgtgctgtccgccttccagggggcaccgatggacggggccggcggcgcacggggccgcgacgaggagctggacctgctgtcaggccgcgagcaggaggtcatgcgcctgatcgcccgcggatacacatacaaggaggtcgccgccgaattgttcatctccatcaagaccgtggagacccacatgtcaaacgtgctgcgcaaattgcagctgtccaaccgcactgaactgacccgctgggcagccgaccgccgcatcgtatga

SEQ ID NO: 1690 - DNA, 1320 bp, Unknown
  Artificiall/Consensus sequence
atgcaggcaacacgcatggcggcgcatccgcgcttgcgcgagaagacgaggagaaagcacatggcaatcatcaaggcgttcgcgggcgcgctcggcggaacgttcgcggatctatggaaagacatcatcactgccggtcggttcgacgagtatgtagtggtcgcgccgggagtcccaagaggcacgaacaacggacgcgggtcgaacgagtacggttctgaaggcgtcatcagcaacggttcccacatttatgtgcccgaaaacacggcggccttcatcttctctgaatccggcatcgagaacgtgattaccgagccgggcggttacgagtaccgcgacggcgagaaaagcgtgctcgccggtgacggcatcggatcgctgttcagttcggtcgccagtcgattcacattcggcgggcagccggtggagacgaagtatgtggcgttcgtcaacctgcgtgagatccgcggcattaagttcggcactccagcgccgctggtctacaatgacaaattctatggcgtggatttggagatacgggcgcggggcacgatgtcactgaaagtcaccgacccggttcgcttcgtgcgcaattacgttcccgccaacgtaacgtcgtactcgttcgacaatcccaaggctagggaacagattctttccgaattcgtccagtcgttcatcgtcgccatcaactcgttgtccgatcagtatcgaatttcgcagctgccggcccatgcgaacgatatcgccatacgcgtgcgcaacgatgagacgaatgcggggacgtggaggaatcgcttcggattcgaggtgtccggcgtcggcatcgagagcatcgagttcgatgaggagtctcgccagctcgtgcgccaattcgcttcgaacaagatgaatgtctctgcgtacgagggcgtctcgcagacggccggcaacatggccgcgcagcagcagatcgcccaaggcatccagaacaacggtttcggtgatggcggcggcatgctcctcggcatgaacatggctcaggccatcaatccgatgaccgcggcgccggcagcgccgatgccgatggccgcgcaaccgcaaccgcaaccgcaaccgcagcagccgcagccgcagcctcaagccgcacttgcagccgaaagcacgggcggtgccgatacggcaacctccggagccggcgcggcagcgccctcgcacgccacctccatgagcgtcacagaacaggtggaaacgttgaagaagctcaaggaactcgtcgacatcggcatcctctcccaagaggagttcgacatgaagaagcatgaagtcctaggcctgtaa

SEQ ID NO: 1691 - DNA, 615 bp, Unknown
  Artificiall/Consensus sequence
atggccaaggcgctgattgtggtggatgtgcagccgacattctgcgaaggcggcgagctgggggtcgaaggcggcaacgcggtcgccgggaggatcgccgactatgtgaacgcgcatcgcggcgagtatgcgtataccgccaccacgcaggattggcatatcgagccgggcgcacactggtcgggcaatccggatttcgtggatacgtggcccaagcatggcgcggcgggcacgccgaacgccgagcttcatccggccatcgcggttctgggcatcgcccatcatttcaagaagggccagtattcggcggcatactccggttttgaaggcatcgaagacaataccgaccgtatccagacgcgcgaggaggtcacggccgaacagtccgccggcaagacgctggccaatgcgctgaaggccgcaggcgtcacgcaggtggatgtggtgggcatcgccgaatcgcattgcgtcaaggacaccgcgcttgacgcgaaacgtctcggctttgatgtcaccgtgttcgaggatctgaccgttccggtcagcgaggagttgggtgtcgcggcccgcaaacagatggccgatgccggcatcatattggcggaggctcgctga

SEQ ID NO: 1692 - DNA, 1218 bp, Unknown
  Artificiall/Consensus sequence
atgccggccgcggcgaacgacagctcgggcggcagtacggccggcggcagcccggacgccgccgccccctatgccacaccctctttcgcgcacggcatcgttccgttcgaccatgagatctcatcgaaccagcatctgacgttctcatacgccgagcaatcattcgcctcagcgaacatcccgtgggatccggatcatgacgcgctgcatctcaaggagcgcggcatgttcaccaacaccgcgctgatcatctccgaccaatgcccgttcaccatcaaatgcgcgacgttcgacggcgacgtcaaggcacccatcagcgagcgcatcgaactgagcggctccatgatcagacagctcaatgacgccatgacgttcctgaacgggcacaacagacgcgacgacggccgccaatgcccaccggacgcgctgcgcgaggcgctggtcaacgccgtgctgcatcgcgactacgcattccccggcccgactctggtcaacatcttcccaagccgcgtcgagatcgtgtcactgggtgggctgatggacggcatcgagatcaacgacctgctcaacggcatcagccagccgaggaacccccggctggccgaactgttcaccagactgggattcagcgagaattacggcaccgggatccgccgcatcatggaggaatacgacgaggcctccgacaacccgcagatccgcgtgggcacgtcctcggtggtgatggtgctgccgttgccgtcgcagccgtcgccgggtggatcgcgcacgcgcggcgacgccacaaagggcggctccgcacaaggcgccgacgggcacgacgccgcccaaggccacgcgaagatgtacgcattccccaccatcatgacgacggccaccagcgatccgaccgtggctctggccggcacacgcgtcatcgggtgcgtccccgtgcgcctgtcggacgggtcggcgctgcgcacgtcgccgctcatcgcgccgggacgcatcgcatctcccgcggcaaccgcccaactgccgccgaacgccggacagacgctcgaagaagtgaccctgcactgcatcgcacaggccggcgtgccgttgagccgccagcagatagccgacaatctcggcgcgaccaagaaccagatgacgtacgtgctgcatcatctggtcgagcagggtctggtcctcaaacgcggcagatcccgggccacgcgctacagcatgccctga

SEQ ID NO: 1693 - DNA, 576 bp, Unknown
  Artificiall/Consensus sequence
atgaatgctatgattgccgatatgccatcccagtcatcccgagtcgaccccgagcgacagcagcacatcatcgacgccgcgctgcgcgtcatcgcgtcacgtggagtggcaggcacctcgcatcgcgtcgtcgccgccgaggcgcacgtgcccctcggctccatgacatactatttcgacggcatgcacgatctgctgcaccaggcgttcgaccagttcgcccgggcctccgtactgaaattcgccgcgcgcatgcagtccgcctcgaccgtcgacgaagcctgcgacgccatcgcgctgagcatcgaacgagacatgctcggtaaccagcgcgacctgaacatcaaccttgagttctacacgctcgccgcgcgcgacctgtctttccgcgacatcagtgaccgctggatgtcggcgacacagaaggtcatgggccggttcttcgactccgagaccacggtgctgctcgacgcgatgatcgaaggcctgacactgcaccgggcgctgggcggggaaccgcgcaacccccagtccatccgcgacggtatccggcgcatcatcgaccaccggcgctga

SEQ ID NO: 1694 - DNA, 1095 bp, Unknown
  Artificiall/Consensus sequence
atggcgagatatacggtagctgtggctggcgccaccggatacgcgggtggggaggcgttgcgcatccttgccgcccacccggacttcgaggtgacctgcgtggcgggccattcctcggtggggcagaaactcggacggcatatgccgcatattccccagctggcggatctgacggtggaggacaccaccgccgaagtgctgaacggccatgacgtgatcatcctggcgctgccccacggcgcgtccggggcgttggccgcgcagcttgaccccggtgccgtggtcgtcgacctgggtgcggaccatcgtcttgaggagcgctccgcgtgggacgcgttctacggaggcgagttcttcgaccattggacatacggcatgcccgagctgatcaccggcaagagcgcagatggagagtacacgcgtcagcgcgacctgctccccggtgccaagcgcattgccggaccgggctgcaacgtgactgcgacgacgctcgccatgcagccggccatcgccgagggactcgtggaacgtcgtgacctcgtcgccgatctggtggtggggtattcgggcgcaggcaagaacctcaagcgcgcgaacctgctcgccgccgaggcgttcggctccgccgtgccctacggcgtgggcggcacgcatcgccatatccccgagattttgcagaacttcgcccatgcggcaggtttggacgccgcccgggccgaggagttcacgctcggattcacgccgatactcgcgccgatggcgcgtggcatcctcgccacggtcagcgcgaagatgaccgacaaggcgctttccatgagcgacgaggaaatccacgacgtgtgggccaaggcatacgccggccaggagttcatcgtgctgctggagccgggcacgctcccggccacggcgaacgtcgtcggatcgaacgccgtccacgtgcaggtggtcaccgaccggcactccgggcgtctcatcgccttcgccgccatcgacaacctgaaccgcggcaccgcgggccaggccgtgcagtcgctgaacgtcgcacttggacttcccgaagacaagggacttacgaagattggagtagcaccgtga

SEQ ID NO: 1695 - DNA, 471 bp, Unknown
  Artificiall/Consensus sequence
atgcgaggagtaccgattatggcaatgtttccggctttgatgaatgacacgatgttctctgacctgtttgacgacccgttcttcgagggttggcgttccgccgacaacagcgcggcgatgaccccgacgaacatgatgagtacggacgtgcgcgagaacgacaagggctatgacgtggacatcgacatgcccggcttcaagaaggacgacatcagcgtctcgctgaacaacggctatctgaccgtgtccgcccataaggacgagggcagcggcgacaaggatgagtccggcaagtggcttcgtcgtgaacgttacgtcggcacctgctcgcgcagcttctacgtcggcgatcaggtgaaggagaacgacatccacgccaactaccagaacggcacgctgtgcattcaggttccgaagatcgaggcgcagccgcaggtcgagagcaagcaccagatcgccattgagggctga

SEQ ID NO: 1696 - DNA, 531 bp, Unknown
  Artificiall/Consensus sequence
ttgcaatcacttcacatgccgctcatgacacccgtccgcacaatcgcattatcaaacgccgccgttgtatcctgggtaaccatggactctcatgccaagatcatcaacgttgtgggtgcggcgatcgtacgcgatggagcggtgttatgcgcgcaacgcggaccgggaaaatctctcgccggatattgggaattccccggcgggaaaatagagccttacgagacgtctcgtcaggcattgcatcgggagatcgaagaagaactgctctgtgagatcgaggtcgccgatgaggtgtgcaccagcgagtacgcctacgacttcggcacggtccgactcatcacattcatttgtcacctaatcgacggcatgccacgactgaccgagcacacggacatccgttggctggatccttccgcaatgccacagctgaattgggctccggtcgaccgtacggccgtcggcatcatcgcaggcatgcgcttcctcacccagacaacgtcggatacctccgaggaaccgagccggtcatga

SEQ ID NO: 1697 - DNA, 1143 bp, Unknown
  Artificiall/Consensus sequence
atgggcgcgatggacggcgtggcgttggcgaaggccgtgcgcaaggcgggcggcgcgatgcagatcgtgttcgtcactgggtattcggattacatcgccgaaggatacgacgtcgaagcgctcaattatctgatgaaaccggtggatgcggccaagctgttcgacgtgctcgacaaggcggtcgcgcgcatgcgccgcgattccaggtgccttgatctgcaatgcgcggaagggctgatgcgtattccgctggccgacatccgctatcttgacgtgcgccgtaattatgtgacggtgcacgccgaccgggattatacggtgaaacgcccgctgggcgagtttgaggccgagctcggcgacggattctgccgggtgggacgcgcgatgatcgtgaacctgcggcgaatccgctgcgtgggcaggtcgtccgtgcaattgaccgacgggacgacgccgccactgcctcgtggggcgtacgagccgttgaatcggacaatcatagaccagacaagactacgcatggccggctcacggccggcagggtgccggaaagccgtcccggctggacggggcagaacgcaaaggaggggcacgatgtggttctgtgggcgaggcaaggccgacagggccatcgcggcatatcagcgcgagctggtcgacccgcattaccgcgaggtcgagaacatgtaccgtcagatgcgcatgtggcggcatgactaccgtaatcaccttcagacgatgaaggcgttggataccccgatcaagtccggcaatgcgatggccgacgcgattctgagcagcaagatgtcgcttgcacaggcgcatggcatcgacgtgcgcgtggacgcccatacccatattccgatcaagctgcgcatttcggaactcgatttgtgctgcgtcctcggcaacctgttcgacaacgcgatcgaggccaacgacgggttacctgaagccgatcgcatgattcgcgtgtatatggacatgaagggcacgcagctgtacatctcgttcaccaacgcttcctcgggcggcaagcagcgcaaggtcggtggcgcttccgcaccaccaaatcagacgaggggtacggtttcgggttggtccacatcgaccagatcatcgaggctgcgggcggctacctga

SEQ ID NO: 1698 - DNA, 603 bp, Unknown
  Artificiall/Consensus sequence
atgaaaacaaacattcgttcgatatggcgtgttgcttttgtcgaaccgctgtgtcactatgagtacagttgttctatgaaacatgagttcgagaaggagggcgacatgatggaacaaatgattgaggcagcggggctccagtgtgcatcgagtcgtcatgatgcgatgcgcgatgtggcgttcgatgtcagaaacagcgatgttccaacgttttcgaggaatatggattcttccgatgcgcgacggcgtgattcccgggtgattatcggagtgtgcgacgagcatggtgttcgcatggcgaagaagggtcattcgaccatgtgtttgactcttcgcggcaagatcgtgttctcgatgatgggcgccctgctgtgcctgtgcatgatcggcctgctgatgccgcaggtcgcccggtcggcgccggatctctccgcagtgtacagctataccgtgcagccgggggacaccttgtggtcatatgcctcggccatcactcctgatgggggcgatgtgcgcgacaccatcgatgatctgatatcgctcaaccatctcgatggtgtctcgttgcaggtggggcagcagctcaaggtgccgattgtctga

SEQ ID NO: 1699 - DNA, 531 bp, Unknown
  Artificiall/Consensus sequence
atgggttttgagcgggaggcgctcagcgaactgtacgccagcgtgtggggcaaccgttccaagatgcagaaggagttcgcgcgcggcgcgcatggcgagccattcattctgcacgagctcgcactgcgcggcaccatgacgccgtcgcagctcgccagttcgctgaaggccagctccggccgcatctccacagtgcttgccgctctggagaaaaaagggttgatcacccgagacatcgacccggacgaccgccgcatcatccgcgtgaaccttacggatgccgggcgagagcggtccaagtgcgacttggaggagatgcgttcggcaatctgttggatcttctcgcagatgggggagcggcgcacgcgcgagttcgttgatctgctgtcggagttctcgacatacatggccatctgccatcccggcgcgccgcgcccgacccccgatgaggtgcgggccgcgttcgccgagcgtgacaggcgtgtcgccgatcatatgcgggccgagcgcgcgaaggccggcgaggagtag

SEQ ID NO: 1700 - DNA, 1407 bp, Unknown
  Artificiall/Consensus sequence
atgactgagaatgatctgttcggggcggcggatgtgcccgacgatatgacgcgaccgttggccgtgcgcatgcggcctcggacggtcgacgaggtgttggggcagtcccatgtgctggggaagggctccccattgcggcgtctggcgaatccctcgtccaaggggtcgctgaccgcgccgagctccgtcatcatgttcggacctcccggcgtgggcaagaccacgctggcgaccatcgtcgcccgtcagtcggggcgcgcgttcgaggagctgtcggcggtgacatcgggggtgaaggacgtgcgcgacgtgctcgcccgcgcgcggcgcagactcgtcggcgacggcacggagacagtcctgttcatcgacgaggtgcatcgtttttccaaatcgcagcaggacgcgctgctgcccgccgtcgagaaccgtgacgtcaccttcatcggcgcgaccaccgagaatccgagcttctccgtcatcaaaccattgctgtcacgttccgtcgtcgtcaaactcgaatcgttggaaccgtccgatctcgccacgctcatcgcacgcgcggtggaagacaagcgcggattgaacggcgaagtcaaaatcgacgatgcggcggtcaacgagatcatccgcatggccggcggtgacgcccgcaagacgctgacgatcctcgaagccgctgcaggtgccgtcaccggagacaaggctcgcaaaaaaggcgcgcggcgtccgaccatcacgccggatgtggtctcgcaggtcatggacgccgccaccgtgcgctacgacaaggacggcgacgaccattacgacgtcatctccgcattcatcaaatcgatgcgcggctccgacccggatgccgcgatacactacctcgcacgcatgctgcgagcgggcgaggatccgcggttcatcgcccgtcgcatcatgatcgccgccagcgaggaggtcggcatggccgcgccgcagatactgcaggtcaccgtcgccgccgcacaggccgtcgcgatgatcggcatgcccgaagcgcgcatcatcctcgccgaggcgaccatcgccgtcgccaccgcacccaaatcgaacgccagctacaacgccatcaaccaggcgctcgccgacgtggacgccgggctcatcggccaggtgccgctatacctgcgcaacgcgccgaccgcgttgatgaaaagctggggcaaccatgacggctatcggtacgcgcacgactggccgggtgccgtcgcgccgcaggaatacctgcccgaggagctgcgcggccgcgagtactatcatcccaacgaccgcggatacgagcacgaggtcagccagcgcttggacaaagtccgctccatcctgcacagtgaaaccgcgccggacggctataccgagtccaaagagcagaacggataa

SEQ ID NO: 1701 - DNA, 1023 bp, Unknown
  Artificiall/Consensus sequence
tccttgaccagcgtcatgccgttcaagcaacggattacaactataatgacaaccatgggatttgccaaatccggcgtgtcgcgcgatgtcacggcctgcgaccgatcacccacaggccttgccataccgcgattctctgatggcataagccgcctgcaccagccgcgaggaaccgttacattggttgatatgagtgaagaagcgaaagcgcatgaaccggtgatgatcgccgcattcgaaggctggaacgacgcatgccaggcagccaccaacgtcatccggcatctcgtgtcgcgctacgattcacgcgagatccgccacatccgctgcgatgggtactacgactaccaggtcgcgcgcccgatgctgtgcaaggtgacgggccgacgccggatcctatggccgcagacgacattctacgccatcgacgtggcgccctcgacgaccctgtatgcgcagatcgcgcccgagcccaactaccgttggaacgactactgccgtcaaagcatgcgcatcgccgaggagcttgacgtccgccatatcgtgaccatgggcgccatgttcgccgactgcccgcacacgcgcgcgctgccgctcgacatcagcgaccagcagtgtcagtgcgacatggaccgggaatacagcggccctgtcggcatcccgaccgtgctggattgcatggcatgcgaggagggattctcgaccacgtcgatgtgggtgtccgtcccgcaatacctcggcagcgacgaatgcgcgcaggccaccatgcagatgctcgcggcattgtccgaccgcatcggcgtcgagctggatccgggcgacctcgccggcaaggccgaacagtggaaggcgcaggcttcggtgctgacgcgctgcaacgacgacctcgcccaatacgtgaaacaccttgagcatgattacgacatgcaggagaaagccgatcaggtggcgcgcttcggcgctccggccgcggaacagctggtgcgcgaggcagaggccttcctgcgcagtcgcggcaagtga

SEQ ID NO: 1702 - DNA, 1434 bp, Unknown
  Artificiall/Consensus sequence
atgttcgttctcaagaacgcatggtcatccatagtccgccgcaaatggcgcacgctgttgaccatgttcatcgccatcatcgtcacattcgggacattgttcggtttctccgtcctgcacgccgatgaatcggccaccgatggctacaacccccagctggtcagcgccgtcatccgcccggatgcgaagaccagggcaacctacaacggcgccgattcttcctatacgaagaactacctggcgttcgacgcatacgacaactacgcgtctgcgctgcaggccgccggcctgacgtacagctatgcgctcaccatcaccgtgccggtgcggcagagcggcgacgtcaaggccatcgccggcaccgacgaccagagcgccgacaagaccggcggcgagatgctgtaccgcagcttctcttcgctggaggccgcgcatgagaacgagctcggccggtacaagatcgtcaagggcaagcaactggactactcgagccagtcgaagacaggcgtgctgatttcacaggcgttcgcgaagaagaacggcctggacgtgggcgacaagttcaccgtcgcgttcccgaacgacgcgaagaagaccatcgagcagaccgtccgcggcatttacgagtacacggagccggccgccgcggggcagggttcggacgccaagctcgccaaggacaaccgcgacaacgtcatctacaccgcgtactacaccttcgcgatggacggcctgtatgcggccgacggcaaaggctggctgattcccgacctgaacatctcattcctgctcgacagcatgtcgacctatcggaagttcgagaaggtcatcaagaaggcaaagctgcccgcgaaccatgagctcacctcgccgacgctaatcgagcacgagaagcagatcgcgccgctgcgctccctggcgagctcgatgaagcctatgctcgccgccctctggattgtgggcgcggtactgttgctgctttcgtggggatcgagcctgctggtcggccgccggcgtgaaatcggcaaccagatcgtcatcggcgtctcgcgtgggcgtatcgcctggcagttcatgctggagacgctgttgctgaaccttgtcggattcgccgtaggcatggtcgtcggcgcgttcgcggtcaagccgctggccacgaagctcgccgacggcaatgcggtcagtgtgccgggcaacctgatctggactgtcatctggagcggtctcggcacgattgtggtcctgatggtgatcgccatgatccgtgtgctgctgttccgtgtcaggacgctgtttgcggcccgttcctcgaatgaggtcgaggtcgtggatggcggcgggacggacgacaccgcaacaagcgacaacgcagcgaacgacagtgatacggcagacgccgacgatacggcggaatcggcacaggagcaggcatga

SEQ ID NO: 1703 - DNA, 972 bp, Unknown
  Artificiall/Consensus sequence
atggacgctgatccgatcaagccgctgtcgtttcccgtgccggccgagaacgcgccggtgaaacgtcgcgcggtgttttcggattccgtggcccagtcgcagtcccggcatgtcaggcccgcggaaggcgggcagaccatgccggcccgccgcagacggctgcatgacgattcactcaagctcatcgacgatctcaccaaccgccccatggatccgctgttctcggattcgaggctcgaccagcgtccgcgctcgcgtctgtcgacgtgggcgacgaagtttctggtgttcgccatgtgcatcaccgtcggtttctacgggtcgctgttcatcgaacggctgcattccgacccgcgcaaggtcgtcaggcaaagcctcgccagcgagctgcgcgagacgcgcggccaggccgacacgctcatgaacgaagtcaacgatctgcgcaaccaggtcacggaacgatcgaagaagctgggcggcacgggggaggattcgacgctggtcaacgacgagatggtcaacgggcttgtcgccgtggaggggccgggcatcagcctgaccctggccgaccccatcgccgccggctccgacggggcatcgacgccacgcgagtccagcggcatgcagattcgcgtggtcaccgacgccgacctgcggctgctggtgcgactgctgtggcaggcgggcgccgagggcatagccatcaacggcaaccggctcggcgtgcagacatcggtgcgcaaggcgggatcgaacattctcgtcggcgtcaccgccgtgaccagcccgtacacgatccaggcgataggggaccgcgacacgctggcctccgcggtcagcaagtccacgcagcgcagtctgtatgattcgttcgcccaggcgggcatataccctcaggtgaataaagagagttcgattacactggaagcggcaccttccggcgaattgtcctatgcaaagaggagcgagtag

SEQ ID NO: 1704 - DNA, 1323 bp, Unknown
  Artificiall/Consensus sequence
atgaacgacagcatcgcagccaaacccaccgatggcccggcagacagtacagcggccggcacagatccggccctcaccgccaccgcgaaactcaccccgcgcgagaagaaatggatcatctacgacgtgggcaactccgcgttcgtgctgctgtccaccgcggtgattccgatctacgcgaaatcgctgatgcccgcggacggcaacatcgtgtcggcctggggctacgcgcagaccatcgcatcgctggtcatcgcgctgctcatgccgctgctcggctcgattgccgacgtgcagggcatgaaaatcaagttcttcctcggcttcttcggcaccggcgtcgtcacgtgctgcgcgatggcgcttccactgacgtggctgccgttcctggtcgtgtatatcctcgcgacgatcggactcaacggctcgctcacgttctacgattcgatgctgatcgacaccacgccgaacgaacgcatggacaaggtctcctcgcacggctacggctggggctacatcggctcgaccgtgccgttcatcgtgtgcatcgcgttgattttcggcggcccggcgctgccattcggctggacgacgaccggctgcacccgcgcatcgttcatcatcaccgccgtctggtgggtcgcgttcacgatcccgctgatctccagctaccgtcaggagcattaccgcgccacacgcgaccagctgggaacggccgtgcgcggcaccttccgcgagcttggcggcaccttccgcaagataatgaggaacaagccgctgtggatgttcatgctcgcgttcttcttctacatcgatgcggtgaacacggtgatctcgatgagcacctcgtacggcgccgagctgggcatcgactcgactcagctggtggtggcgctgctggtcacgcagttcgtggcgttcccatgcgcgatcctgtacgggcggatggccgggcggttcggctgcaaggcgatgatcgtggcggcggtcgtggcctacatgtgcatcgtgttcttcgccgcgttcttcctcgtgtcggccgcgcagttctggatcctggcgatcctcgtcggcatgttccagggcggcatccaagcgctgagccgctcgtattacggcaagatcatccccaaggaccacgccaacgagtactacggcttctacgacattttcggcaagaccgcgagcatcctgggcacgttcctcgtggccaccaccacgtcgatcaccggcaacgcctccctcggcgtgctttccatcgccatcctgctggtgttggcgctcatcttcctgctcctgcagaaggatccaacacaagcgtaa

SEQ ID NO: 1705 - DNA, 1113 bp, Unknown
  Artificiall/Consensus sequence
atggcaaagcatatgcgcccgccgcggcgcaggacgggacgtatcctgcgcggcatcgtgccgcatgccggcggtcgtgtcggccctcgtcggcggtcgaacccgcctggcggccgaataatatccacccgtgagctgacgtatgtgcgccgccgtctgacggtgctgatcgcgatgttctccgtggtgacgatggtggtgctattgtccgtgcgtgggtgctcgaacgatggcgatggctcgtccggcagcgtttcatcagccggtgcggcccggtccggtgccacggtcgaccccaccgacggcagtgtcgccgatgacggctcctccgacgaaagtttctccgacaagtcggggtccggcagggttcgttcccaatcggcgtctcggagcatgttcaaggcggccgtgccggctccggcccagcccgaacgtgacctgactgcccaggcatccgccgcgctggccggtgtgttttccggcgcgagatattccgtctccgtggtcgatctgagcaatgccggcacactcgtcgacatcgactcctcccaggtgttcgcatcggcgagcacgtacaagctgttcgtggcgcattcgatggtgacggccgtggaattaggcgaaatgacatgggattcgccgctcaacggcatgacgctgcagcagtgcctgaccacgatgatcgttgattccgacaacgaatgtcccaaggcatggctgatgcgcgataacggcaccggctacgacaaagtaacgcagcaggcgaacgcgctcggcgcgaagaacacgacattgcattatctggacgtgcgcacgacatcggccgatctggcgctgatcctgaccaaactgtatcggggcgagatttggaacgacgacgaccgggacatggtgatcggcctgatgaaacggcagcagtaccgcagcggcataccggccggcatcggcggcaacggaaccgttgccgacaaggtcggattccgcgactcgtacctgcatgatgcgggcatcgtatattccggcaagggcgactatgcgttcgtcatcatgacttccggctcgtcgtggacggcgatagccaacgccagcgccgcgctgtatcagctgctgtga

SEQ ID NO: 1706 - DNA, 1938 bp, Unknown
  Artificiall/Consensus sequence
atggcagagggatcgaacgggagacgccgcttttccgacaaatggggcaaacatgagttggatgtgttggccgtgctgtcgtctgcgtttccgcagtggctgacctcgcggcaaatcgcccagcgcgtcaaggcatatgccgactcctacggggaacttgccgatcaggccgcgaaggccgcgttcgccaagcagttccagcgcgaccgcgccaagctcgcggcaatgggaatcgccatcgagtcacgccagcctgaatactcctcgaagtccgagggacaggacttcgcgtcgtaccgactgcagctcggggacgagccgcgcatccgcctgcgcttcgagcaggaggatctgccggttctcgccgcggccaactatctcgcacgttcgatttccgtatcgtccacgcaatcgcagaccgtgacgccgcagcatgtgtcccgcaccacgccaagggtgccgcagacgcccatccccggcctcggattggattccatcgccccgggactcggcacgcagacgattccgccggctctcgtgcgcgtcgtcgactcccgccgtttcgcggcgacggtcgacgtggacggagagaacatcaacgtcgcctacaccgattccgacgacctcgccatgttcgtgctcgaacatcccggcgcagtgatcgtcagcccgcaggaggccgtcgacgccttcaaccgtcgtctccaggcggcgtcaaacatgatgctggccgacagatcgtcggacgataccggcagcgccacggtcgccacgcccaccatcaccagcacgacccccgagccggaggacgccgaccccaagaaaaaccaccagaagaagtccgggacctcgttccagaccggcagcgaggtcgaccgcagactgcgcctgatgctcttcctgtccgcccacctcggtgaggaattctccctcgcggaactcgcggagcgcttcatcggcaggcccaagtcggatgacgagctcaagaaatacgtcaacgtgatccacaaagacatcaacacgctgaccacggtctccgacgacggcgagatggccggaagccagttcttcgacatcgattggtcgctgcttgacgccgaaggcatcgtgtccgcgacgaattcgctcggactggaacgcctcgccggcatctccccgcaatacctgagcatgctcaccgcttcggtgagctacctcgcgcattcgccgctgctgccggaggcgcagcgcacgcaggcggcctcgctgtatcagcgtctgcgccagctggtcaagccgggggagaccccttggctgagcctgaccggctacgagctggagccccactgcttctccgtcgtcaagcgcgcgatctccaccgaatcgctgctcgacatggaatacacggacggcgcgggacggacccgccgcaaggtcgtcgccccctccaagatcttcgtggatgagggcgtctactatgccgccgtctggaccgacgtgctggactccactccggaggaccggcgcaagttcgtctcacgcgaccagctcatcaacaaggcgaacggcaagccccgcacatggcaggtgctcaggctcgcccgcatcgagcacgccgaggtcatcgctccggtcaagcgcgtggacattcccgacatgccggtgagcgagttgcgcaagtggagcttcgacaacggcactccggccgtgttcatcacggatcagccggatcttccgttcatcaagtcgatgccgggagccaccgtcgagccgtgcagcccgggcgagaaggtgcatatcatcgtgtcgtccgattcctggttcgtcgccttctgcatcgcccatgcgcgtcacatcaccgcggtcgcgcccgagaccctgcgcacgatgatcgtcgcccgtgcgcagcgcgagctcagcctcggcacacgtgaagaagacaccccggaagaggagtga

SEQ ID NO: 1707 - DNA, 657 bp, Unknown
  Artificiall/Consensus sequence
atgcggtggacacgagcggcctcgcgcacgccttcgagcggctgggcgtggtgtagcagccccagcccgcgcacggcacggctttccggcaaggagcgtaatccatctgactgtattacgatggaacatgattcgtacaccgacgtcggaggtatcgccgttatgacatccaagcagaacaactatctgcgcgagcgtgaaaaagccaatgcgcgctcgccattctccaaacgaacgccggaacgtgtgatcatgtgcgccggtgccgtgtattcggtcggcatggccatcttcttcgcgctgtcgtacttcggcgtgatttccagtacgtccgaggccgcccggacgtcggctcaggccgtgaccgcgctgagccgcaacagcagcaacacggcgctcatcatcctgtacgccatcgtgacggcgggagtcgccgcggtgaccatatatatggccgtgaagcacatgcagcccggtccgcggttcaaatggacggtcggctggatgatcttcgtgatggtcttctcactgttcaccgctgacatggtggggctgatcgcgttcggcgtggccttcggcatgtacatgacacgcgattggcagctgctgcgtgccgtcaacgccgcgaacgccggcaaacgctcgtcgaagcgctga

SEQ ID NO: 1708 - DNA, 1647 bp, Unknown
  Artificiall/Consensus sequence
ctgagcgaaagaggagcaatgactggatctgctgtgcgtgtggacggaacgcaaggtatcacccccatctggccggtggcgacggcagtgaatgccgaaggcgccctgacgttccacgggcgcaccgccgagtcgctgcttgacgagttcggatccccgctgtatctgatcgacactgacgaagtttccgcccgcgccagatatttcgtgcgcgcggcggccgacgccttcaccaactccaccacgcacgtgagtttcgccggtaaggcattcctctccaaagaagtcgtgcggttggtgaccgatgcaggcatgctcgtcgacacatgctcgatgggggagatgcgcatcgtgctcgccgcaggcgtccccggtcgtcgtctggtgctgcacggcaacaacaagtccgacgcggaaatcgaactcgccatcgagcagggctttgcgaaaatcgtcgtggacgagccggatgagccggcccgcatcgccgccatcgcgcgacgactcggcaagcgtgcccgcgtgatgctgcgcgtgaccgccggcattcacgccggtggccacgaatacatctccaccgcgcatgaggatcagaagttcggcgtgccgctgctgccggccggcgccgatgccgcggcactcagcgtactggacgaactcacggctgatccagcaggcgtgagttcggctgttacgaacgcgcacatcgccgaacgcgatggtgatgccggtgacgggaatgcgaagcccgagcgcgaactgcactacgacatgaagtacccgtacgacctgagccacgaggagatccccgaaaaggacaaggcgctcgccgccgcgatggaaaccgtggcggatgggccggcactggccgtgctcaaggatatcctcacacggtccgacgagttggaactcgtcggcattcactctcatatcggttccaacatccatgacgcagacgccttcatccaggccgccaagcgcatgatgctgctgcgcaagaccttctacgccaccgacgcctatacgctgcccgaggtcgacttgggcggcggctactccgtggcatacaccgacggcgaggattcgatggacgtgcgcgtcgagctgcgtcgtctcgccgaagcggtcggtgccatcaaccgtgcgctcggtgtgcccgcgccggccatcagcttcgagccaggacgatggatcgtcgccccggccggcgtgaccctgtatcgtgtgggcacgatcaagccggtgcatctgtccgacgccaaagacaagaccggcaatcccatcgatgagcgcgtgtacgtgtcggtggacggcggcatgagcgacaatattcgtccagcgctgtacggcgccgactacacggtccggctggccaaccgtcgcgggtcggacgagtcgatgctggtgcgcgtagtcggcatgcattgcgagtccggcgacatcatcgtgcacgaggacaggcttccggccgacctcaggcgcggcgacatcctcgccgtgccggtgacgggcgcatacggccgcacgatggcgagcaactacaatcaggcgctgattcctgccgtggtcgccgtgagtgaagccggcgcacatgtgatgatccgtcgccagaccattgacgacctgctggatctggatcagggctga

SEQ ID NO: 1709 - DNA, 1329 bp, Unknown
  Artificiall/Consensus sequence
atgacgctgccgggataccatgacactatggatatttcgtctcagaccagtcggttcattgcggcgcaccgcaatcaggatgtgcgcgacctggcgctcagcgccaaacgcgtggacgggcttgacctgccattcgcgctcgaccagatcgccggctggcagactgcgtgccgcaagctgccgcaatgggccgagaccgacggcatcgtctatccgccgcacatctccatggaacagtgctcttcccagctcgccgcgcagtacaaggccggcatcgcaaggcgcgtagcgggcgccggcggtgcgatggtcgatctgaccggcggattcggcgtcgattgctcgtatatcgcgcgtggattcagccgggcggtctatgtggagcgccagcctcacctgtgcgagctcgcggctcataatttccgggcgctggggctcccgcacatggatgtgatcaacggcgatgcggaggattggctgcgcggcgtcgttgattcccgcgccgcctccgcagactcggccgcagtcgattcagctacagccgttcccatcgcgctgatctacctcgaccccgcgcgacgtgacgcgcatggcggccgaacctatgccatcgccgactgcacgccggacgtactcgcgctgaaagaccgtctgctggccgtttcgccgcacgtcatggtcaagctgtctccgatgctggattggcgaaagacggttgcggacttcaacggttcggtcggcgaagtgcatatcgtctccacaggcaacgaatgcaaggaactgctgctggtgctcgaccgcggttcgcgcgacgccatacgcgtgatctgcgtcaacgatggcgacgtattcggatacgtccatgacatgaagaccggcgcggattctgacggcgtggtcctcgccgccgcaggagaaaaagacagtcagggcgggtctgcagagccgtcacacgccgctccggaacagcccaggtatctgtacgagccgaacgcttcgctgatgaagggcggctgtttcgcgctgctggaggaccattatggtatgcgccagatcggcccgaacagccacctgctgatatcgggcacgccggcgccgcagtttcccggccggggatttgtcattgaaaccatcgcgggtatgggcaaaaaagagctgaaacgggctctagcgggcgtcgacagggcgaatatcgcagtgcgcaacttcccgttgaccgctgtccagctgcgcaggaaactcaagctggcagacggcggcgatgtgtatctgttcggcacgacgtccgtcgatggccgtcatgtcatcgtccgcaccgtgaagcagtga

SEQ ID NO: 1710 - DNA, 588 bp, Unknown
  Artificiall/Consensus sequence
gtgacaatgcccggcatattcgccaagtcgaatgtgccgggtatttttgttgccatgaacgactcgacccggaacatgcgaccacgcggcaaacgaagcaaacggcacggcaccggaccgatcgcgttcttcgtgtcgctgttcatcatcgcgctcggagccatccaactggtctccacgttccacacgtacgcgctgaacctcgcccagctcaacgacctcaagaatcaggaagccgcgcttgtcaccaagaagcaggatctcgaaaacgacatcgaacgctggaatgatgacagctatgtggcgacgcaggcgagggagcggctcggcttcgtcttccccggtgagaaggcggtgcgcgtgcaacacccggaagcggtgacgggcacgagcgaggggaccgcgaagaccaaaagcggtacatccgacgggaaggtgctgccctggtacagcgagctcgaatattcgttcaagaaagccgatgagcggccatcgaaaacggcctccggcagccaatcgggcgataccggcaaagccgacggcaactccggcagcgcaaccgacacgaactcgggcgacaagcagtag

SEQ ID NO: 1711 - DNA, 570 bp, Unknown
  Artificiall/Consensus sequence
atggccaaggaactgaccgaaagccgccgcacccgttacacgcggaaggcgatgcaggacgcgctcatcgacctgatgcgcgaacggccgctcggcagcatcaccatcaaggcgctgtgcgagcaggcggacgtcaaccgctccacgttctacgcgcactacgacagcatcgaggagctgctacacgacatcgaggacgaaacgatggcatgggtcacgaccgcgctcgaccagctgctcatgcagcctgacgcggccggcgtcgagcacgtcatcgagcacatctgccgctatatcgccgacaaccgcaaccatctgcaggtgctgatgagccctaccgccgacctggatttccagcaacagctgctcggcctgatctacagccgccgttccgtcgccgaacagatgcagcccgcctccagcgacccggccgaagcgcagatgcgcatgcggttcgccgtatccggcagcatcggactgctgcagtactggctcgccaccgacctcgccgccccaccagaaaccgtcgcccacatcatcttcaccatgggcatgcccggcgcccggtga

SEQ ID NO: 1712 - DNA, 900 bp, Unknown
  Artificiall/Consensus sequence
atgagtatcccgaaaagcgtcaccaaggcacatgcgaccggcaatgatttcatcgcgtatctggattccgacggccgtttcgagccgaccgccgatgaggtgcggcaattgtgcgacaggcatttcggcatcggcgccgacggcctgctcaggctcacaaaaccgcagtacgtcgccgatctgagcgaggcgcaggtcgcggcgtgcgatgacggagacgccgagtggttcatggactatcgcaacgccgacggatcgctcgcagagatgtgcggcaacggcacgagggcgatcacgctgttcgcccagcggtgcggcgtggcgtcgacgcaggtgggggagccgttccgcctgggaacgcgcgccggtgtcaagacgctgcgcccgctcggcgacgtggcgccatacggcagggatgtgttccgcgtggacatgggctcatggcggcgcggcgaccttgacgccttcacggtgaccattcccggcacgccgggagccgcccgcggcacgttcgtggatatgggcaatccgcatgtggtctgcgtgatcgaagacgcgatgtccacgctgccaagggtcgaggatctggatcttgtgaccaaaccggaggtctcaccggtgctggaatccgaccagaacgcggagttcgtgcgcgtcgacgagatcgacgctgccgcagggacgggagaggcgaccatgcgcgtcaatgagcgcggttgcggcgagacgctgtcctgcggcaccggtctgtgcgccaccgcgatcacgctgcgcgccaaaaccggcgtagatcactgggacatcaccgtgcggggaggcacggtgcgggtggacgtcaccgatgagaccgtcgcgctcaccggttcggccactctggtcgcggacgtgacgttgatctga

SEQ ID NO: 1713 - DNA, 1479 bp, Unknown
  Artificiall/Consensus sequence
atgatccccatacgtctccgtcaggcgtcgctgctgctgttcgccatgctgatcagcgtcgtcgccttctaccagatgttcctgcgcgtctacggccacttccccgccaactacatcggcctgctggccgtggtcggcgcgctgttcctcgtgctgtggggactgctgctgcggttcaagccgtacgccagccaggcgattctgccatgcgtgctgatgctgaccgcgatcggcgtggtgatgatcgcgcgcatcgacaagtccggtaattcctcggtcggctcaaggcagctgatctggttgtgcatagccctgacgctgtgtggcatcctcgtggcggtcatgcgcgactatcgtgtgctgcgcaaatactcgtacgtgaacatggtgataggcctgatactgctgctgtcgcccatgatccccggtctggggcgcaacatcaacggcgccaagatctggatccgcatcggcggatattcgctgcagcccgccgaattcgccaagctgttcctcgcgttcttcttcgccgcctacctgttcgaccaccgcgaccagctcgccgtgggaggcaagaaggtgctgggactccagctgccccgcatcaaggacctcggtccgatcatcatggtgtggctgatctcgatgggcgtgctcatcatgcagcgcgatctgggcacgtcgctgatgttcttcgcgatgttcgtcgcgatgctgtacgcggccaccgggcgcagaagctggatcgtcatcggcttcatcgcgttcgccgtaggcgcggtcgccgcggccagcgtgttcagccacgtcggccagcgcgtggactcatggctgcccccgttcagcgacgagcagtacaaccgcataggcggctcgtggcagctggtcacgggcatcttcggcatggcctccggcggcatgaccggcaccggcctgggtcacgggcagccggggctgaccacgttcgcgaattccgacttcatctattcgtcggtcggcgaggagctgggcttgaccggtctgatggccgttctggtgctgtacctgctgatcatcgcgtccgggttcatcaccgccatgaagatcaaggacgggttcggcaagctgctggcctccggactggtgttcacgatggccttccaggtattcaccgtggtcggcggcatcacgctggtaatcccgctgaccggcatgaccatgccgtacatggccgccggcggctcatcgctgatcgcgaactacctgctcgccgcgctgctgatgatcatctcgaacgcggcgaaccgcccggagccggacacactgtccgacacgttccaatacgaggcgctggcggtgctgcgtgaccgcgagctgaaggaacgcactgacaaggagtccgcacccgaacgcgaaccgcaggccgagcggccaccggaaccccgccacgcggcggcgaacaaccagaccacggaaatcatcgaggcaggtgcgcgatga

SEQ ID NO: 1714 - DNA, 2217 bp, Unknown
  Artificiall/Consensus sequence
ggctccgaaacggcgatttcacacacccaattgcggataacggctttttcgacccgtaattcgcaaaccggagaggggctcgaggctccccgccgtcacgtcctcgccgccgataggatggacgctatgaaaaagcacatcgtcgcgggcattctggctcatgtggacgcgggcaagaccacgctgtccgaagcgctgctctaccgttcggggcagattcgcaggctcggccgcgtcgatcacggcgatgcgttcctcgacaccgacgcgatggagcgggcgcgaggcatcacgatattcgccgagcccgccatcatccgatccggcgatctgacgatcaccctcatcgatacgccggggcacgtcgatttctccgccgagaccgagcgcgtgctggcggtgctggattacgccatactggtggtgtccggggctgacggcatccaggggcataccgagacgctgtggcgcctgttgcggcgatacaacgtgccgaccttcatattcgtcaacaagatggacgcgcccggtgccgaccgggccgcactgctcgcccagctgcgtgacaggttctccgacggctgcgtggacttcgagaacggcgctccgacccggtcgatggaagacatcgcgatgctcgacgaatcggccatgaacgagttcctggactccggcgccgtcgcggacaagcggctgaaagccatgatatccgcgcgctcactgttccccgtgttcttcgggtccgccctcgccatggagggcatcgatggcttcctcgccggctttgaacggtataccaaggagatcgaaccgggtgctcgtttcggggcacgtgtatataaggtgtcgcatgacgagcatggcaaccgtctgacgtggctgcgcgtcaccgggggagagatcaaggcgaagatggtgcttgacggcgacgagaaggccgaccaggtgcgcctgtattccggcgcgaaattcaccacggtcgatgcgctgcccgccggctcggtctgcgccgtcaccggcctgacgcacagccgccccggtcaggggctgggcgaccagtgcgacgccgacgccccggtgctgcagccggtgctcacctacacgctgttgccgcagggggaggatcctcaccgttgcctgaccgcgctgcgagaactggatgatgaggaccctctgctgcatgtggtatggcaggagaggctgcaggagatccatgtgcagctcatgggcgcggttcaattggagatcatccagcagatcatgcgggaccgtttcaacttgaacgtcggcttcggccccggatccatcctctacaaggagacgatcgcccatgcggtggagggcatcggccacttcgagccgctacgacactacgccgaggcgcacgtgctgctggagccgggcgagccgggcagcggactgaccttcgccacatcctgttccgaagacgtgctggcccgcaactggcagaggctcatcctgacgcatttcgccgagaaggagcatctgggcgtgctcattggcgtccccatcaccgacatgaagctcacgctgctcaccggccgcgcgcacgagaagcatacggagggtggtgatttccgccaagccacctaccgggccatccgacaggggctgatgaccgccctggtcgagggagacttctcccggcacgacctgttcgacgaggacgccgcggaggacgtcgccgaagacgcggccgcagccgatgccaaaacagcccggacggacgaatcggagccgtcggacggcagcgccttcgcctccgcggccgcccgcgatcccggctggtgccgggtgctcgaaccgtggtaccgcttccggctcgacatcccgcaggacatgctcggccgggccatgtccgacatacaacgcatgtcgggcacgttcgacccacccgagatggacggccagtacgccgtgctggcgggagtctgcccggtatccgagatgcgcgactacgccatggacgtgaacgtctacacccacggcacgggccatctggggtgcgtgttcgacggctaccggccatgccacaatgcggccgaggtcatcgaacaagcgggatacgatccgggagacgatctcgaaaacacccctgattcggtgttctgcgcgcatggcgccggttacacggtcaaatggtaccgggtgccggatttcatgcatctggatcgcgcatacgacgccgggcagtga

SEQ ID NO: 1715 - DNA, 1488 bp, Unknown
  Artificiall/Consensus sequence
atgttatggtgggcgtgttcgggaaaccgggcgaatagcagtttgtctcgccgaggccggatggcctcgcacattcaaggaagcagagaaagtatggagaagttcttccatttgaaggagaacggcacgaccgtgtccacggagatcgtggccggcctcaccacgttcttcgcgatgagctacatcatcgtcgtcaatccgcagatcctgcaccagaccggcatgccgtggggcggcgtgttcctggcaacgatcatcgcggccatcatcggcacgctcgtcatgggcctgttcgccaatgtgccgtacgcgcaggcggccggcatgggtctcaacgcgttcttcacctacacggtgtgcttcggtctgaagttcacgtggcaggagacactgtgcatggtgttcctgtgcggcctcatcaacatcatcatcaccgtcaccaagatccgcaagatgatcatcgaggcgatcccgcccatgctgcagaacgccatcggtggcggcatcggcatattcgtcgcctacgtcggcatgctcaacgtcaacctcgtcaccttcaccccgaaggacaccaaggccgccggcaagggcctggccaccggcgccacgcctggtctggccacgctgaacaccccgaccctgtggctgttcctgatcggcctgctgttcgccatcgtgttcaccgtgctcaagctcaagggcggtatgctgctgaccatcgtcatcaccgcgatcatcggcatcccgatgggcctgaccagcatgtccaactccgtgtccatctccgacacgttcgcccagctgccgcagaccttcggcgtgatcttcagcgccgatggcttcccggcgctgttctccgacgtatccaaactgccgctcgtgctggtcacgatcttcgcgttctcgatgtccgacacgttcgacacgctcggcacgttcatcggcaccggccgccgcaccggcatcttctccgatgacgacatgaagcacatggaggacggcaagggcttctcctccaagctggaccgcgccctgttcgccgactcgatcgccacctccatcggcgcgatctgcggcacctcgaacaccaccacctacgtcgagtcttccgcgggcatcgcggcgggcggccgcaccggcctgacctccgtggtcgtgtccatctgctttgcgctgtcgatcttcctgtccccggtgatctccgcggtgccgtccgcagcgacggccggcgtgctggtcatcgtcggctgcatgatggcctccagcctcaaggagatcgagtggagcgacatctccgaggcgattccggcgttcttcgccgccgtgttcatggcgctcgcgtactcgatcagctacggcatcgccgccggcttcatcacctactgcatcgtcaagacctgcaagaaggaagccaagagcgttcacccgatcatctggattgtctcgctgctcttcatcctcaacttcatcctgctggcagtgctgtaa

SEQ ID NO: 1716 - DNA, 672 bp, Unknown
  Artificiall/Consensus sequence
atggcacgttccaccgctcgcaaaagggctctgaacacgttgtatgaggcggacgagaagggacaggatttcctgtcccttcttgctgagcgcatcgaagagcctggtgcgcagaccccgcttcccgactacgccatcgagatcgtgcgcggcgtcgccgatcaccggcgtgagatcgactacatgctcaacgagcattccaccgggtggaaggttcgccgcatggccgtcgtggatcgcaatatcctgcgcatcgccgcatgggagatcatcttcaacgacgacgtgcccgatcgcgtggccatcgacgaggcgctcggcctggccaagacgttgagcgacggcgactccccggcgttcatccacggcctgctcagcgcgatttgcgatgacaccgaaggacgcgaggccattctccaccccgaaaacgacgagcccgacgcacagccgagcgacgacggtcatgagcctggtgagcctgccggtgaagcgtcgcatgcggaagccgaaaccggcgattccgaagcgtccgaggacgatgacatcgccgacggcgtcgatttcgacgacatgacgttcgacgatgtatccgatgacgttgccgaagctgcatccgagcagacgtccgatccacaagccggccagcaggacggcgagtccacaagtaaatga

SEQ ID NO: 1717 - DNA, 4818 bp, Unknown
  Artificiall/Consensus sequence
atgatcgcagcatcggtcgctttggggacggcgttcgcgttgatcgcgccgtcttcggcgctcgcgggcgatgcgacgccagcggcggcgtcgaccggaacgacatattacgtgtcatcgacgcatggcgatgacggcaacgccggcaccgataagggccatccctggaagacgctggacaaggtcaacgccatcgcgaccgaccttaagccgggcgactccgtgctgctggagcgtggctccacgttccaggaccagtatctgcacatcaaggacacgtcgggaaccgccgacgcgcccatcaccatcgccgattacggcgacgcctccgccaagccggtcatcgcggcgaacggcgtcaagggcagccggtggtaccagaactaccgtgcgtcggtcggcaaccaccagaacaagggcaccgtctcctcggccatcctgctcaaggacgtgtcgtacatcacggtgaagaacctggagatcaccaatgacgaccccgacgtctacgacccgatcgacacgtggaagtggaccgacacggccgattcggatggcaccaagctcgaccgctcggccgaccgcatggaccgcaccggcgtggccggcatcgcggagaacggcacaacgatgagccatgtcacgcttgagggcctgaacatccacgacgtggacggcaacatctacaacaagcacatggccaacggcggcatctacttcatggctcactacgcccgcgagaacaagaacgccgcggacaacacgtggctgcagaaccacatctcgcgcttcgaccacatcaccatcaagaacaacatcgtcaaggacgtggaccgctggggcatcgccgtgggctacaccgcgtacctcaacttcatcgacgcggcgtggggcgacggcagcatcgacgacgacctgatcgccaagtacggccagaccaacgtgaccatcgagaacaactacgtcaagggtgcgggcggcgacgccatcaccctcatgtactgcgaccgtccggtcatccagtacaacgtgggcgacagcgtctcgaagcacatgaacgacgtcgactacccgcatgatgccgcgcacggcggcaggtacggcggctgggtcgcggcgggcatctggccctggcgctgcaaggacccgatcttccagtacaacgagatgtacaacaacctcaactccgaacacggcaacggcgacggccaggcgtgggacgccgattacggcgacggcacgctgtaccagtacaactactcgtacggcaactcgttcgcctcgctgatgatctgcaaccagtacgccatcaacacgacgttccgctacaacatctcgcagaacgaccgccgcggcgtgttcgacctgccgggcaacggtccgggcaaccacatctacaacaacaccgtctacatcggtaaggacagcgcggtgctgaccggccgatccaacagccaggcgaagttcgagaacaacatcttcatcaacgcggccgacaccaagaagaccgagacgtggaacctcggcaaccagcacggcggccagacgtacgacaacaacatgtacgtcaattacgcgaacaggcccgcctccgattcccacgccgtcgaggtcgccgatgtggcgaccgtgctggccaatgccggacacgcgccgagcgcgccgaaggccaacggttcggtctatggccgttccggcagcgagttcgacggatacaagcccgttgacggctccccggccatcaatgccggcaaggtcatctccgacatgaacgactacgcggtcacgaacgacttcttcggcaacaccatcaagggaaccccggacctgggtgccgtcgaaagcaacgtgctctccgtctccggcaaggtcaacgcgtacgagaccgccacggtcggcggctccaaggtcgtctacgtgccgttcaccgcgaagaacccgaccacagtcaagcagcttcgcgcgggcctgacggtcggtgacggatcagtcgccaacgtgtaccgtggcggcaacaagctggcggccgacgcggcgatccaggccggcgacgtgctgcgcttcgaggtcgaaggcacttcgaacacgccgatcgaatacaccatcgctcagaagaacgcctggaactgggtcgactggttcaagaccgccacgggcgtggtctggaactcccagaagcagaatggcgccgacggtgactggacggacatcacgacgttctccaccgagtacccgatgtcgaagtacaacgagtactacggcgcgggactcaccggcaacctgtcggacctgccggcggtgggagctgaccgccccgggcgtcagggcctgttggtcgacgacccgggtgcggccggcggcaccgccatcgcgtggaaggccccgaaggccggcaccgtgaaggtcacactcggccgcgacaacgagccgcagcggcgcaacgccaacgcttcgggcacggtgacgctcgcactgaccaagaacggcgagacgctgtgcaccgcagacatctccaccgcgcagaccaagaacgacgacttcgtcaattgcctgaaatcggataagggcacggtgcaggtgaacgccggcgacgtgattcgcatcgcggcgaccgcggccagtggcgcggccgctccggacctgtacgcctcgccggtcgtcacctatcaggatgtggcacccgtcgagtcccagacagcgcagtacactgcctcctacgacgcggtgagcgccaaggtcggcaccaaggccaccgctacggtgaagttcacgaaggacggtgccgccgccaccccgaccggcgtcaagtcctacgcgctgaagaccgcggtcgacggcgtgtccgtggacgccgcgaccggcgcggtcacctacacgcccggcgcaaatgcgtacggcaccaccaagaccgcgaccgtggtcgtcacctactcggatgacaccaccgacgaggcgaccgtcaccttcaacgtcgagaagtccaatgcgcagaagtacaacgtgctgtacccggccgtgtccggcggcgcgggcgtcgcgctcaagcgcacgcccaagttcacgctcaaggcggacagcgccgcggcgtccatccccgccggcaccaagttcgcgctcggcacgggcgccccggccggcgcgtccgtgaacgccgccaccggtgaggtcacgctgaccagcacccaggccggcaccatcaccgtgccggtgacggtcaccttctccgacaccaacgagtccatcgaggcgacggccacgttcaccgtgaccgctccggcggcgctcggcacctccaagctggagaccggcaccgcggacggcgcgaacgtcatctatgtgccgttcacctcgaagaccccgaccaccgtcgccgatctgctggccctggtgaccgccgagccggattcggccctcaaggccgtgtaccgcgacggcaccaagctggaggacgccgcggcagtaaaggccggcgacgtgctgcgcttctacgccgacggctccaccttcaccgccgactacacggtcgtgcagaagaacgcctggaactgggtcgacgagttcaagaccgactctcagggcccgatctggacgtcgcagcgtcaggtgtccggcgaatggcagacgattaccgatttcggttccgatgtgtacccgcagacgtactacgacaagtactacggcgtcggtgtggactatcagaacaagagccttccggccgaccgcagcgccatccacggcctgatcgccgacaatccgggtgattccgcggcgacggcgatggcctggaccgcgccgaaggccggttccgtgaaggtcacgctggacgaggtgaccggagcgcacgtcgagccgtacatccgtcagtcgggcagcaacggcaaggatgtggtcctgaagctgctgaagaacgacgaggtgatctgctccgcgacgatgaccgattccttcgcgacggcgaccgggttcaacgaatgcctggcgtccgccaagggcacggtcaaggtcgcggtcggcgatgtgctgcgcttctcggtggatgccgcggccggcacctccaagtcgtcgatccacatcagcccggtcatcacctacacggatgccgatgagccttcgcccgagcctggcctgtcggagcagtatgctgcggcgtatccggcttcggttgcggcgaaggtgggcgagaaggccaccgccgcggtgtcgttcacgaagggcggcgccgccgcggatgccccggcgggcacgacgttcgcggtcgcgggtgacgggttcacggtcgccgcggacggtacggtgtcgttcacgccgacggacgcgcaggcgggcaagacggtgacggccacggtgacggtgacgtattcggacaagtcgacggatacggcgacggtgacgttcaaggtcgccgccaagaccgagcctgagcccaagcccgaaccgaccgatccgaaggccgacctgcgcaaggaggtcgaatccgcgtcgaagcttgacgagaaggactacaccgccgactcgtggaaggtgttcgccgcggcgctcgataacgccaaggccgtgctggaggacaaggacgccaccgaggcgcagatctccggcgcgcttacgacgctgaagtccgccactgccgcgctggccaaggccggcgacaccggcaagcccgacgatggcgacaagccttccgcgggcaagcccaacgacaagggcgacaagggcaacggtctgtccaagaccggcgccagcgtcgccgtcatcggcgttgccatgctgctgcttgcagccgccggcttcgtcacggtgaacgtcgttcgccgccgccggtaa

SEQ ID NO: 1718 - DNA, 792 bp, Unknown
  Artificiall/Consensus sequence
atggcacgataccgcaagtcaaggatgtgggcgccgcagggctttttcgagtgcgagggccgcggcctgcaatggctcggcgaggcgcaggcgcagggcggaccccgcgtggtggacgtctacgaatggggcaaggattttctcgacatcgaacgcgtatccccctgctcccccacggccaaggcggcccacgatttcggcgcggccctggcgcggatgcatgacgcggggacggaccacttcggctcggctccggccggatatgacggcacctgctatttcgggccgctgcaggatccggtgccgatggcgaccggcgcgtgggatgacccgatcacctatttcgcgcaggggcggctggtcccgatggtcgaactgggcatgcgtcgcggagagctgacccaggccgacatggacctgacgaaccgcgtcatcgacgcgatgcccgaccttctggggcgtgcggcgcaggacaagccggcacgagtgcacggtgacctgtggagcggcaacgtgatgtgggccgacgaccgaggctcgtgcgaggccgtgctgatcgacccggccgcacacggcggtcatcgcgaggaggatctcgcgatgctgcacctgttcggcatgagctatctgaccgagatcatggacggttaccagagcgtgcatccgctgaaggccggatggcaggagcgcacgacgctgtggcaactgtatccgatcgccgggcactgcgtgttcttcggcggcgggtacatcagcgaataccgttccatgtgccgctcgctgctcaagtag

SEQ ID NO: 1719 - DNA, 993 bp, Unknown
  Artificiall/Consensus sequence
atgctcatgaagcagcaggaaatggccggtatggcatgtcttgtattgacctcgctgatttggggattcgcgttcgtctcccaggtgcagggcatggcatcgatgtcgccgttgttcttcaacgccacgcggttcaccttgggggcgatttcgctgatcccgttgctgctgtggaagcgtttgcgacgatgccgggaatcagggaagacggttggcgcggggaaccgtgaggccggcgatgacgaacatgacatgatcgtcggcagcgcactgtcgaacccgctcatcgtcggaatgatatgcggtgtgttcctgttcgcggcgagcacgctgcagcagtacggcatcatgttcggccgttcggccggccgcgccggattcatcaccgcgctctacatcgtcatggtgccgttgctggcgtatctcgtccttcgccgcgcagtgcgcatgatgacttggatggcggtgggcgtggccgtggccggattctacctgctgtgcatcacggacggcttcggttccccgacgctggccgactgcctgctgctgttcaccgcggtcctgttctccgctcatatcctgtcgatcgatacgctgggagcacgcgtcgacgcgctgacactgtcattcatccaattcgtgacgaccgcggcactcagctgggccggcacgctgatcgaaggctccatggactggaacggggcagggcaggcgtggatcgccgtgctgtatgcgggaatcgggtcagtcggcgtcgcctacacgttgcaggctgtaggccaacagtgggtgccgccgacccgcgcatcgctcatcatgtcgctggaatcggtgttctcggtcatcggcggcgcattgctgttgggcgagacgatgacggtacgcggatacctcggctgtgcgctgatcttcgcgggcatcgtgctcgcgcagatgcccggtgtcggccgcagacgattggcggtgaacaagaccggaaaacgggatcagtga

SEQ ID NO: 1720 - DNA, 870 bp, Unknown
  Artificiall/Consensus sequence
tcgaacctgactcgcgcggatgccgcgctggcgttctatcatgggtggaggcatccgttcatgatgcgcccacgcatcacgattcataaggggattcgcatgctcgtagcggtcgacatcggcaacaccaacatcgttctcggcttcctggacggcgacgacatcatcggcacctaccgaatcacgacgaaatcgaaccacacgtccgacgagtacggcctgatgatcacgcagttcctcgcgctgagcggcctgcgtccctctgatatcgatgacgtgatcatcgcgtccgtcgtgccgaaggtcatgcactcgttccgtgcaagcatcatcaagttcctgaacatcaatcccatggtggtcggccccggaatcaaaaccggcatcaacattcgcatcgacgacccgaagtcgttgggttcggactgcctcgccgactgcgtgggcgcgtattacacgtacggcggtccggtgctggtcgccgatttcggcaccgccacgacgttcaactacgtcaatgacgagggcgtgatcacctgcggcctgatcaccacgggcatccgcacggccgcggcggccttgtggggtgagacggcccagctgcccgaggtggaaatcaccaagccgaaatccattctcgccacaggcacgaagaccgcgatgcaggccggactctactacaacttcctcggcggcatcgaacgcacgatccggcagttccgcatggagctggacgagccgttcaccgtcgtggcgaccggcggcctgggccgcgtgttcaaggatgacacggagctgatcgacgtgtatgaccccgatctgatcttcaaaggtatggcgctgatccacagccgcaactcgcatcgctga

SEQ ID NO: 1721 - DNA, 2658 bp, Unknown
  Artificiall/Consensus sequence
gtgcagcaggatccggatctcatcgcaagaagcgccgaggaactcgtcggcgacctcaacccgcagcaagccgaggcggtgcagtaccgggggcccgcactgctgatcggcgccggcgcaggatccggcaagacacgcgtgctcacccggcgcatcgcgtggatcctcacgcaattcggagcatggccgagccagatcctcgccatcaccttcaccaacaaggcggccgctgaaatgcgcgaacgcctcgaaggtctgatcggaccggtcgcccagcgcatgtgggtgtcgacgttccattccgcatgcgtgcgcatcctcaggcgtgacggccagtcgatagggctggcgtcgggcttctccatctatgacaccgccgactgcgagcgcctcgtcaagctgatcggcgccgatctcaacatcgacctcaagcgctacacgccgcgcgcgatcctctcgcgcatctccgattacaagaactcactgatcggctggcaggagcagctcaagcgctacgcgcccgactaccggcccggccagcgcggttatcagatcggcaatttcggcgacatcgaggtgctgtattccgtcatctacgccgaataccagcatcgtctggccatggcgaacgccgtcgacttcgacgatctgatcggccggacggtcgaactgctgcgcacccaaccgcaggtggccgactattaccgtcataagttccgttatatcctcgtcgacgaataccaggacacgaaccatgcccaatacgagctgatccgcgagctggcgggcgtggacgcggccgggcaggtcgtgccggacgccccctcggcggggcgggccggcccggcatggatcaccgtcgtcggcgactccgaccagtcgatctatgcgttccgcggcgcggacatccgcaacatccaggatttcgagcaggatttccccaacgcgaagaccatcatgctcgaacagaactaccgttccacgcagaccatcctcgacgcggccaacgcggtcatcgccaacaaccagggtcgcaagcccaaaaagctgtggaccgcattgggcagcggggacccgatcgtcggctatgccgcggacaacgccgagcaggaggccgcgtggatagcgggggagatcgctcgcgtccgcgccgaggagggcacgccgtattcggacatggccatcatgtaccgtgccaacgcgcagtcgcgtgcgcttgaaggcgcgctcgtgcatgccggactgccgtatcagctggtcggcggcacgcggttctacgagcggcgggaggtcaaggacgccatcgcgtatctgcaggccatcgtcaatccggccgacaacgtcaacatgcggcgcatcctcaacgtgcccaagcgcggtctcggacctcgcgccgaatcgatcatcgtctcatatgccgatgctcatgcgaccacgttctgggacggcatcgaccatctcgaccagatcgacggcgtgcccacccgcaccggcaagcagctcgccgcattcagggacctgatgcgctccctgagcgcgttcgcggccgaacatgacggcaagccgtccgaagtggtgggggaggtgctctcgcagtccggtctgctcgaagaactgcagcggtccgaggatccacaggatgcctcccgcgtggagaacctgtcgcagttgcagtccgtcgccgccgaattcgagcagaacacgccggacgccacactcgcgggatttctggagaccacggcgctggtggcggactccgaccagctgccctccgagggcgaggactccggcaaggtcacgctgatgactctgcacaccgccaagggcctggaataccccgtcgtgttcctcaccggcatggagcagggcacgttcccgcactcgcgggcgatggaggacgccgacgagctttccgaggagcgtcgtctggcatatgtcggcatcacgcgtgccaagcgtcgtttgtacgtcacccgtgccgccgtgcgcgcgcagtgggggcaggccaacgagatgatgcccagccagttcctcgatgagatccccgaccggctcatcgactggaaacggcgcgaaaccggcatggagggcatgcgctccggctggtcacgccgcggcttcgacgacgagttcggcggatgggatgatgacgacttcggcggcaccacatacggcgggtcgtcctcgtacggcggttcctcatcatacggctctcgtggacgttcctcgtacggtggttcctcgtcgttcggctccggttcgcgcggcggatcgggctcgtcatatggcggggccaggggattcggctcatcttcgcgccacggcggttccggccgtcagggctccggacagcagtacgggtcgggcagccggttcggctcatccacgggattgtcgcgtggcggcaaggtcacgacgcgccgcaccgctcccaagccatctctctcgtcggccaaaccggcctcgtcgctcagcaaggacaataacctcaacatcgccgacttccatgccggtgacaaggtcacgcatgaccagtacgggctgggcaccgtcgtcgacacgcaggacaagggccgcaactccgtaatcacggtcgatttcggctcgtcgggcgtcaagcggctgatgctgcgcgtggcgccgctggagaagctctga

SEQ ID NO: 1722 - DNA, 837 bp, Unknown
  Artificiall/Consensus sequence
atgaccaaccctgaacagcgactcatcgtcaccgacctcgacggcacgctgctgcatgacgcccccaccttcgaggagcggtttatcacgcagcgcagcattgacacagtcaaacgcatgcacgatgccggttaccggttcgcggtggcgaccgcccggccggtgagcaccggcttcgagtacgcgggtaagttgccggtcgacgcgtacatttatctcaacggtgccctgattgatttcgcgcctgaacgttccgattacgatctgctcacctcgggacggctcccctccgatgggcatctgctgaaggtcggcttctcctccgcacgggcctgcgaggtgtgccggtatctgctcgacgagatacccggcctcagcctcggcgtcgtcatggatgacgtgcgctacacgaacttcgacgtgagcgtgtactggaagacacagacttggcaattcaccgatttcaccgacgtccccgacggtatcgccgacaagatcattatcttccccaagtcggagcaatgggcacatctgaagacgctggtcccgcccgatttcgacgtggcgatctccgaaggctcgatgtggatgctgctgagtccgctggcgaacaagcggcaggcgttgaaaacgctgtgcgaacgcatggatgtgcggctcgacggtaccgtcagtttcggcgatgaccttatcgacatcggcatgatgacgacatcggaaacgggtgtggcggtcgccaacgcgaaccccgaggtcatcaagatcgccgacgagatctgcccgcccaacaacgatgacggcgtcgcgcaatggatcgaacggcatctgctggcatga

SEQ ID NO: 1723 - DNA, 762 bp, Unknown
  Artificiall/Consensus sequence
ttggacagaccgcaccggtgggtgagtgaggagccccatatcccgttcgatatcgacgtggtgtatgaggatgccggcatcatcgtcatcgacaagccgcatttcctcgcgacgaccccgcgcggcatgtggtatcggcagaccgcgctgattcggcttcgcgagatgttcgacgagccggacatcacgcccgcgcatcggctggaccggctcaccgccggcatcgtcgtgttcgtgagggatccagcgctgcggggcgcataccagatgatgttccagggccggaagatcagcaagacctacgaatgcctggctccgtgccggccgacgacacggccgcgatacggcaccgtcgagcggctggaccctcctgtcgtgttcccgctgcgccgacgttcgcacatcaccaagctgcgtggcgtgctgcaggcgttcgaggagccgcagaccgtcaatgccgagacggtgatcgatctcgcggcgggagaatatccctcgatgggcgggcgcttatgccacgggaagaacggtctgcgcgcctacgagctgcacccgctcaccggcaagacccatcagctgcgcgtgcacatgaactcgatagggttgccgatccatggcgatgatttctatccgcgtatcgtcgaacgcgcctatgacgacttctccacgccgctggaactggtcgcgcggtcattgcgcttcaccgaccccgtcagcggggagccgcgcgaattcatctcccgcatacctctgggttggtga

SEQ ID NO: 1724 - DNA, 765 bp, Unknown
  Artificiall/Consensus sequence
gtggctctcatcgtgcagaagtacggcggctcgtcggtcgccgataccgaatcgatcaagcgcgtggccaagcgcatcgtcgagaccaagaaaaaaggcaacaaggtggccgtggtcgtctccgccatgggagacacgaccgacgacctgatcgaccaagcgctgagcatcgactccaacccgcccgagcgcgagatggacatgctgatgaccgccggtgagcgcatctccatgagccttctcgccatggccattcacgccgccggggaccgtgcgcattcgttcaccggtcagcaggccggattcttcaccgacacccgttacggcgccgcgcacatcaaggccgtgaagcccgaccgcgtgcagaacgcgctgtcgctcggagacgtggccatcgtcgcaggtttccagggcatcaacgccaagggagacgccaccacgctcggccgcggcggctccgacacgtcggccgtggcgcttgccgtggcgctcggcgccgacatctgcgagatctacaccgacgtggatggcgtgttcaccgccgatccgcgcatcgtgccaaaggccagtcgcattccggtcatcggctacgacgagattctggagatgtccagttgcggttcgaaggtgctggcactgcgctgcgtggagtacgcgcagcggttcaacatgccgcttcacgtgcgcagctccttctcgcatcgtcccggcacgctgatcgtgcccgacggagtcgacccgcgcagcctgcccaacatcgactga

SEQ ID NO: 1725 - DNA, 675 bp, Unknown
  Artificiall/Consensus sequence
atgggcaatatcacgatggttgacgggcatgtgcccgacggctcatatcaaaacgtgacggcgaacggcagctgctcctgcgatgccggcatgcgattcgacggtttgcgtgcccgcggctcgttcgatgcgatggggctcgacggcgggaacgtgcattgcgaggggcgtctggtctgccgcggcgacatgcatgtcaacagaatcagcgggcatggtgaactgcatgtcggaggcgacctgcgttgctccgctctggatttcaccggcaagatcatcgtgcagggcgatgtcatgtgccctggcggcatgaccgttcgcggactgctgcgcaaccgttcatgcatcgtcacgagatacctggatatgcagggcacgttggacgcggacgagctgcgcaccgaacggctgcggatgactcccctgtcaagcgccatgttcgggcgcagcggcatgacggaattcacccggacgagcaacgccgaacgaatcatcggcggcgatttgcgtgtcagcaggctcatctgcaccctgatgcagggcgtcttcatacggttgactgacgaatcgcatgtggaacgcgcctcgtgcatcacgaagctcgccatggacagcacgtccagcgtattgctggtatccggcgccgccaagcgtgtgtatctgcgcaatacgtga

SEQ ID NO: 1726 - DNA, 1923 bp, Unknown
  Artificiall/Consensus sequence
atggcggttcgcggtgatattcgtaatgtggctatcgtggcacacgtcgatcacggcaagaccacgctggtaaacgcgatgctccagcagtcccacgtgttcaacgagcgcgaggaggtgccggatcgtgtgatggactccaacgatctggagcgcgagaagggcatcaccatcctggccaagaacacggccgtggaatacaccggtccgctggcggccaagtacggttacccggacggcatcacgctcaacatcatcgacacccccggccacgccgatttcggtggcgaggtcgagcgcggcatctcgatggtcgacggcgtcgtgctgctcgtcgacgcttccgaaggcccgctgccgcagacccgtttcgtgctgcgcaaggcccttgaggccaagctgccggtgattctgtgcgtcaacaaggtggatcgtccggacgcccgtatcgaagaggtcgtctccgaatccaccgacctgctgctgggcctcgcccaggacgtcatcgaggaaggcgtcgacctcgaccttgaccacctgcttgacctgccggtcgtctactgcgcggcgaaggccggctacgcgtccgtcaaccagcccgagaacggcggcctgccggacaacgacaaccttgagcctctgttcgaggacatcatcaagtacatccccgcccccgaatacgaggagggcgcgccgctgcaggcgcacgtcgccaacatcgactcctccgacttcctcggacgactcggcctggtccgtatctacaacggcacgctggagaagggcaagacctacggcctgtcccgcgtggacggttccatcgagaacttccgcgtcgtcgaactgctgcgcacgcagggcctggagcgcactcccgtcgaatccgccggccccggtgacatcgtcgccgtcgcgggcgtcaacgacatcatgatcggcgagaccatcgtcgacccgaacgacccgaagccgctgccgctcatccacgtcgacgacccggccatctcgatgaccttcggcaccaacgactctccgctggccggccgcgaaggcaaggaccacaagcttaccgcccgcatgctcaaggatcgtctcgaccgcgagctcatcggtaacgtgtcgatcaaggtgctgcccaccgaccgccccgacgcctgggaagtccagggccgtggcgagctcgcgctggccatcctcgccgagcagatgcgccgcgaaggcttcgagctgaccgtcggccgcccgcaggtggtcaccaagaccatcgacggcaagatcaacgagccgatggagaacaccaccatcgacgttcccgaggaatacatgggtaccgtcacgcagctcatggccgaccgcaagggccgcatggactcgatgagcaaccacggttccggctgggtgcgtctgcagttcaccgtgccgtcccgtggcctgatcggcttccgcaccgcgctgctgtccgccacgcgcggcaccggcatcgcctcctcgctgtccgccggctacgcgccgtgggccggcgccatcgtcacccgccagaacggctcgatggtttccgaccgcgccggcgttgccaccccgtacgccatgcagcggctgcaggcccgcggcaacttcttcgtcgaaccgcagtccaacgtgtatgagggccaggtcgtcggcatcaacaacaagccggacgagttggacgtgaacatcacgctggccaagcacatgaccaacatgcgttcctccaccgccgacgtgctggaaacgctgactccgccgatcaagatgagccttgaggagtcgctcgacttcgcgaatgaggacgagtgcgtcgaggtcacccctgaggcgattcgcgtgcgcaagatcatcctcagccgtgaggactggtacaagtggcgtgccaagcagcgtcgtcagaacaacaacgcctga

SEQ ID NO: 1727 - DNA, 2061 bp, Unknown
  Artificiall/Consensus sequence
atgggaaaaaagttatttatagcagaaaaaccaagtgtggcacaggaatttgccagggttcttaaagtaaatggacggcggggagacggttttatcgaatcgtccgatcatgtcgtgacatggtgtgtcggccatctcgtgacgatgagttatccggaaagttacgatcctgcctatgcaaaatgggcgtttgagacgctgccgtttattcccgaaacatataaatacgaagttattggaaatgtaaaaaaacagtttgaaacggtaaaaaatcttctgaaccgggacgatgtggaggcaatttatgtctgcaccgactccggacgcgaaggagagtacatctatcgtctggtggaccagatggccgcggtgccggataccaaggcaaagtttcgtgtatggatcgactcacagacagaggacgagatcctgcgtggaatccgcgaggcaaagccattatccgcttatgataatctgagcgcgtccgcgtatctgcgtgccaaagaagattatttgatgggaattaatttttcaagagcgttgtcactcaaatatggtggctggcttaacgacaatgtgtccggaaaaaaatggacatcggtgtctgtcggcagagtgatgacctgcgtgcttggcatggtagtgagccgcgaatgggagatccgtaagtttgtgaaaacgccattttaccgcgtgatcggtttgtttggaagagagcagacagaggaagaagaggcggctttttttgagagcgaatggcgcgtgaatgaaaaatccaaatatttccagtctccaaaactctataaggaaaatggatttactgaggagagttttgccaaagaattgatcgatacccttatggcgggagaaaagcaggcaatcgtcgaaaaagtagaaaagaagaaggaaaagaaaaatcccccattgcttttcaatctggcggaattacagaacttgtcgtcgaaattgtttaagatcagtccggacgagacattgcagatcgttcaggaattatatgaaaaaaagctggttacctatccgagaacggatgcccgtgtgctgagcagtgctgtcgcaaaagagattacaaagaatctcaaaggacttcaggggtatgagatggcacttccgtatctgagagatatcgcggagcgaaagagttttcttggactggaaaagacaaggtatgtggacgataaaaagattactgaccattatgccattatcccgaccggacagggattgggggcgctggcgtcgttaaaaccactcagtgccaaaatgtatgaagtcatcgtacgacgtttcttgtgcattttttacccgccggcggtataccagaaaatgaatgtttctctgatgatggaaaatccgtccgaagagactatatatgtggaaaattttgtaactactgcaaaagttttggtggaagaaggatttctgccggtgtcacagtattcgtttgctaaaaagaaaaaggaagagaatcctgaaaacgaagaggagacagacagcgcggcattggagaagatcctcccatccctgaaaaagggaatgaagctgtctttgcatgacatgaagatcaaagagggagagacatctccgccaaaacgttataactccggttccatgatccttgcaatggagaatgccggacagctgatcgaagatgaggagctgcgcgccatgatcaaaggaagcgggatcggtacgagtgcgacaagagcggagattttgaaaaaactagtaaatatttcctatctcgatctgaataaaaagacgcagatcatcacgccgacgctgaaaggcgagctggtttgcggtatcgtgcggtattccatccccgcgatgttaagtccgaaacttacggcaagctgggaaaaaggtctcaccggcgtgtccgatggcggaatcagcgaaaatgaatatatggacaaactgaccggctttgttaaaaatcaggtaggaaaggttaagcaaactaacaatattgcgcagcttcgttcctattatcaggttgcagccgtatactataagaataagaaaaaaggagaaaagtaa

SEQ ID NO: 1728 - DNA, 2466 bp, Unknown
  Artificiall/Consensus sequence
atggaagaaagagtaatgtacctgacaaaggctgagaaaaaggcacatttgaaaaaagacattgaaaattacatgaaactgttgttccgtaaaccggtggaacaggcgacaaaccagcagttgttccaggctgtatcttatgcggtaaaagatattgttgtcgatgactggtttgatacacacaaacaatatgaagagaaagatgtaaagacggtttattatctttccatggaatttttgatgggtcgagctcttggtaatatgatcattaacctgaaacaggatgaggttgtacgcgaagtgttagaggaacttggtgtgaatcttgatgtcattgaggatgaagaaccggatgcagcactgggaaatggtggtcttggtcgtttggcagcatgctttttggattccttgtcaacgttgggatatccggcgtatggatgtggaatccgttataagtatggtatgtttaaacagaagattgagaatggattccaggtagaagcaccggatgattggctgaaagagggcaatccatttgagatgaaacgtccggagtatgctgtggaagtaaaattcggaggttatgtagccgtacgtaaagcggaaaatggaagagatgagtatgtacaggaaaattaccagtctgtaaaagctgttccttatgatattccggtagttggctatggcaatcgcattgtaaatacactttgtatctgggatgctgaagcaatcaatacctttaatctggattcctttgataaaggagattatcagaaagcagtagagcagcaaaaccttgcacgtacgatctgtgaggtgctttatccaaatgacaatcatattgcgggaaaagaacttcgcctgaaacaacagtatttcttcgtgtctgccagtgttcagcgtgcggtagcaaaatatatggcaaatcatgatgatattcatggtcttccggataaagtatgcttccagttaaatgatacccatccgaccgtaaccgtgccggaacttatgcgtattcttttggatgaatactttttggattgggatgaagcgtgggaaattacgacaaaatgctgtgcctacacaaatcatacgattatgtcagaagccttggagaaatggccaattgacttattctcccgcctgcttcctagaatttaccagatcacagaagaaatcaatcgtcgttttcagaatgagattgctgagaaatatcctggtaattttgataaagttaagaaaatggcaatcatttatgatggccagataaaaatggcacatcttgccatcgctgcgggattctctgtcaatggtgtggcaagactgcatacagagattttgaaaaatcaggaattgaaagatttttatgagatgatgccggagaaattcaacaataagacaaacggtatcacgcagagaagatttcttcttcatgccaatccacttttggcagattttgtatcaagaagaattggaaaaagttggattacaaatttgtcggaaattagtaaacttgtaccttatgcagaagatgagcgtgctttgaaagagtttatgaatatcaaatatcagaataaagttcgtttggcagattatatcaagaagcacaacggcattgaagtggatccaaattccatctttgatgtacaggtaaagcgccttcatgagtacaaacgtcagttgcttaatattttgcatgtaatgtatctgtataatcaattgaaagagcatccggagatggatgtggtaaaacatacctttatctttggtgcaaaggcttctgccggataccgtcgtgcaaaagcgattatcaaattgatcaacagtgttgcggatgtagtaaataatgatgccagcattggcggaaagattaaagtagtgtttattgaaaactatcgtgtaagtaatgctgagattatttttgcggcagcggatgtatcggagcagatttctacggcaagtaaagaagcttccggaaccggaaatatgaaatttatgcttaatggtgcaccaacgcttggtacaatggatggtgccaatgttgagatcgtagaagaagtgggagaagaaaatgcctttatctttggactctcttcccaggaagttattgattttgagcataataaccagtacaatccgcgtgaaatctacaataatgatgcggatatccgtaaagtggtagaccaattaattgatggaacatacggggaaccggaactgttccgtgaattgtattcttccctactggaatccaatggttacgagcgcgcggatcagtactttatcctgaaagacttccgctcgtatgcggaggctcagaagaaagtggatactgcttaccgtgaccatgaggcatgggcgaagatggcacttttgaatgtggcaaaaagtggaaaattctcttctgaccgtacaatcgaagaatatgcaaaagaaatctggaaattggagaaagtttccctgtaa

SEQ ID NO: 1729 - DNA, 1812 bp, Unknown
  Artificiall/Consensus sequence
atgaatttattaaccgccgaaggcatcactcacagttatcatgaccgccgccttttttccggcctctcattccacttgaatgagggggaaaaggtagggctgatcggcatcaatggaaccgggaaatcgacccttttaaaaatcatcgccggaatgctcgttccggatgagggaaccgtgatccgcggaaatcagctgacgctgtcctatcttccgcagtctcccgaatttgcggataccgatacggttttgagtgctgccttagccggtcttactgacaatggcatctgggaaagggaaccagatgccaaaaatatgttgacaagacttggcatcaccgaatttacaaaacccattcaccaattgtccggaggacagcgaaaacgtgtggcccttgtccgcactcttctgaccgacgcagacattctgattctcgacgagccaaccaaccacttagacagcgcgatggcagaatggcttgaaaataagttaaagaactaccgcggtgctctcgtgatgatcacacatgaccgctattttctggacagcgtcgtgacgcggatcgtcgaattggagcagggaaaactttacagttacgccgacagctacctcggatatctcgctctgaaatccgagcgcaaagagatggaggcagcgaccgaacgcaaacgtcagagtttattgaaaaccgagatccaatggatgatgcggggtgcgcgtgcacgttccaccaagcagaaagcgcatatcgcccgctacgaggctctccgcgacgtaacaccgccgaaaatcgacgaaaatgttcagatgacttcggtcgcctcccgccttggacgaactacgattgaattgaatgggatttgcaaatcctatgatgaccgcacactcatccgggatttttcctatattttcctgaaaaatgaccgcattggaatcattggaccaaatggctgcggaaaatccacattaatgaaactgatcaatgggatcgaaacgccggattccggcacgatcaccatcggacagaccgtaaagatcggctacttttcacaggaaaatgaatatttagacccgtctctgaaactgatcgaatacgtccgcgaaggagccgaagtcattcatacgcctacaggcaccatcagtgcttcgcagatgttagagcggtttttgtttccttccaatatgcattatgcattgatcgagaaactttcgggcggcgaaaaacgccggctgtatctgcttcgtatccttatggaagcgccaaacgtcctctttttagatgagccgaccaacgatctcgacatcgaaacgctgacgatcctagaagactacctcgatcactttgccggcatcgtcgtgacggtatcgcatgaccgctattttttggaccgtgtcgtccgccgcatctttgcctttgaggaaaacggaacgatcacccagtacgaaggcgggtactccgattatctgaaaaaatccggcgacaagctgtcggaaatgagcaccatttccgataaaaaggaaagcagccgcaatccggattctacttccaaagatacatggaagaaaaatgcgccaaagaaattaaaattttcttacaaagaacagcgcgactatgaaacaattgaagaagacatacaaaaactggaagaaaaaatcacttctttagaaaaagaaatggaggaatctgccagcaattacagccgtctgacagaattaaatgaagaaaaagaaaatgccgaaatggctttgcttgaaaaaatggaacgctgggaatatttagaagacctggcagcccagatcgaaaatcaataa

SEQ ID NO: 1730 - DNA, 1920 bp, Unknown
  Artificiall/Consensus sequence
atgcgaagaaagaaaccaaaacgttttacccgtggaatgaaatttggccttctgtgggtattgggagtatgttttcttctgttttgcggattattgtataacatttgccgatataactgggataagggagacgattataagaaaaaagtgctggcacagcagtcatacaccaatgcggtattggattaccgccgtggtgcgatcaaagaccgaaatgatactgtgcttgcgcagagtatacgtaaatttaatctgatcatagaaccaagatcgttagcgacaaaagaggacatcaaaaaagaaacgttgactcagattgccgcttattttgcgtttgataccagtgtgatcgagaatatcatcagtgaaaacccaaattccatgtatcagcatgtagaaggactggaacagttatccgtagagcaggtggatggatttaaaaaattgatgaaagacaatgaaaagattcagggtgtttggtttgaagagacgtatacgagaaattatccgctcaaccagattgcctgtaatattgtcggatttacgtcttccgaaaatcagggaacgtatggcgtagaaggcagttacaacgatgatctgaatggaaaaaccggccgtgaatatggatattttgatgccaatatggaatttcagcggacggtaaaaaaagcgaccaacggaaataatgtgattctgacaattgatgctaatgtgcagcggcttgtcgaaaaacagatccaaaaatacaacgaagaaaccggagcggaaaatatctctgttcttgtaatgaatccgaacaacggagagatccttgcgatggcgtcaaaaaacacatatgatctcaataatccgagaaatctgacgtcgatgtatacacaggagcaaattgacgcgatggatgagaaggcgacaagcgatgcattgatgtcaatgtggtcaaatttctgtgtttcatcagcttacgaaccgggatcgacgtacaaaccatttacggtggcggcagctttggatgaaggtgttgtgaaggattcagattactttaactgtgacggtggacttaccgtatcaggtgtgagaatccgatgctcaaaccgatcgggacatggaagcatttcccttgaaaaaagtttgatggaatcctgcaacagtgccttgatggtaattggacaaaagttagggcgtaccaattttagtaagtacaataaaatctttggatttggacaaaaaaccggaatcgatctgccgggtgagacagcgggactgattcacagcgaagaagagctgaatccggtagaacttgcgacaagcagttttggacagacccagactgtaacgatggttcagatggcagccggctttagttctcttgtcaatgggggagattattacgagccgcacattgtcaaagagattcaaaatgaaaatggtgccattgtaaagaaaaatgagccaatcgtagtgaaaaagaccgtttcggataagacaagcagtctgatccgtcagtatatgaaggcaacggtagaagaaggaactgctgcaccggcgggtgtaaaaggatattccatcggtggaaagacaggaacggcgcagaagcgcccggtgaccgcacgcaaataccttgtatctttcctggggtgtgtgccggcagaaaatccggaagccgttatttatgttatcattgatgaaccgcatgtggaagatcaggcacacagtacgtatgctactgaatttgcttctaaaatcatgaagaaaattcttccgtttttaggaatttatgcggaaaatactgacgatgtggcaaaagcagattcgacggcggaaccgacagcggagccggcggcgacgcagaaaccggacgatgaaccggaaccgacagcgacagaagaaccaacggcagcgccagagggcggtgaacagtaa

SEQ ID NO: 1731 - DNA, 1080 bp, Unknown
  Artificiall/Consensus sequence
atggtgtggttgccagttttgtcagaggacagaattgtcagccaccatttcaaaatatgggcttattttgacaccatcagcgaaagaaaaggctcctggtgtttaagttgcgttattttgtcatcattacatggaatggaggaaaagatgggtaagattgcatttgtatttccgggacaaggtgcccagaaagttggtatgggaaaagagttttatgagacttctccgattgcaaaagagatttttgataaggcaagtgaagctgttgagctggacttgaaagcactgtgctttgaggaaaatgacgacattaatattacagaatatacacaggttgcgcttcttacaacaagcgtggctatcatggaagtgttgaaagaccgtgggattaaaccggatgtagcagcaggtctcagtttgggcgaatattgtgctctggtagcagcaaattcgatgaattatatcgacgcggcaaaagctgtccgtaaacgaggtatttatatgcaggaagaagttcctgccggcgtaggcggtatggctgcgatcatgggacttgagagtacagagattgaaaaagcaatcgcggatattccacaggttcaggtggcaaattacaattgtccgggacagatcgttatctcaggaaagaaagaatctgtagagcagggcgcagaaaaatgtaaagaggcaggcgcaagacgtgctgttatgcttaatgtaagcggcccatttcattctgatcttttaaaaggagcaggagagaaacttgaaaaagttttggattcgattgaaatcaatgagccacagattccatatgtggcaaatgtaaatgcttcttacataacgaaacaagaagacatcaagccattgcttgtaaaacaggtatcttcttctgtccgctggcagcagtccgtggaaaccatggtagaagatggcgtcgacacatttattgaattgggacctggcagaacacttgccggttttaataaaaaaattggaaaagccattggaaaagaattgacgacttacagcgtcggaacaatggaagaattagaagcagttgtagcagcacttagttaa

SEQ ID NO: 1732 - DNA, 1401 bp, Unknown
  Artificiall/Consensus sequence
atgaatcagattcgaaaaattataaaagacctggacaagggagtggcaccacgcaagaatctcccgatttatgccaattatctggcagatacgtatttgaattatgcctccatagagctggtgttttcggcttatatgctggtggagacctgccaggaaggcatcgatctgtccgaagaggaagaacgcagatacgatgaggtgcgaaaggaaattccacatgtgtacgaggaagatgcggaggcgcagaaaacctgcatcgagcggattgaccgcatccgtggcgagattacacaggtgatggaaaaatatacatcctatacagatcagctgatctgttatgattatgtgctgaaacaccgtaaatttgactttgaagaggaagaaccttatcagaaagatgtttttgcgacagaagaagatgtttttgtcaaagaattgatggcatttctcgtgggaaacaaagaccagagtatcgtcaaagaacggcttcagcagctgatgggaatgattccggtacacatgacaaaacagcgtctgatgggaaaaattcaggacaccggaagtttgtatatcggaggcgatatggcgtcgctggataactttatctatatgatacgttcggctgctatgattcagaaagccggtacggagacggaagaagatgccattgcagaccttttgaaggaattgcagaatacggattttgcaggtttgacaaaagaatcgtttgaggcaatgagtaaagaattggaaaaagcgggagagtacattcttcatgtgaccgatttttattatcagctgcaaaaggtagtaaatgcgatgtatgcgcttagtcttgccaattgccataagcgggaagaaagtgctttgtatgagcactgccgtggcattttgatggaagtggcaaacggaagtctgaacgaggaagggcttgtaaaactggaaggaaagattgaaacctatgtggaaaaatccagttatctggaagccgttctctttgagattaaagcctctcataagaagatcattgaggaactcggaaaaggcgaggaatttgatgcatttgcgaaaattgccaatctgttatccgacagtttgtttattgatatggaacgttttggcgagagcgatacggtcgaagctgcggtggaaacagagaagatcaaagaactcaccggagaattgtccgactttttatcgacactttctaagccgctgaagaaagcggttatggcagaggtgctcgaaaaacttccggtagaatttaccaatgccggtgagattgagacttatatccggacaaatctgtttggatgccagaatgaggcagaaaagaaagcagccatgatcgaactgcgtgagtggatggacgaggcagcagaatggaggagtaaatga

SEQ ID NO: 1733 - DNA, 3183 bp, Unknown
  Artificiall/Consensus sequence
atgtatcaagatattttaaccattgcggtagtaaccgtatttgcattttttgcgatttactggatgtggtttcagggagaagtggatggaagccgtctgatcgcaaagaattctatgaagcagcagaaatttaatattattcttgttctggttgcggcatttatcgtaaaagcgatccttgctgtaaagaacgaaggatacagtgtggatattacctgtttccgctcttggtcggagacggtatttaccggaggactttcccatttttacgagggtgatgtaacggactatccaccgggatatatgctggtgctttggctggttgcggcgatccgccacttgtttaacattgacaattattcgaccacgggactttttatgatcaaattgttcccgatactttttgatctggcagcagcgtatcttatttacgtgatggcaaagaagagattttccgagggaatgtctctgatgctttccacactttatgcgctgaatccggcagttgttatcgacagttctgtctggggacaggtagacggcgtattgtgctgtatggttcttctgacctgttacctgtttatggaagaaaagagaattttagcatactttgccttttgtgccggtgtgctgctaaagccacagatggttatgtttgctccgatcattatttattcgatcattgagcaggtatttttgcatgatttcaatacgaaaaagatgctccgtgacctgatcggcggtctggcatctttggcggctatggtgcttgtagcacttccgtttgggctggagaagtcgttggaaaaatataccggtacgctgggaatgtttgaatactgttccgtcaacgcgtacaatttctgggcgatcgtggggaaaaactggcatgaacagacggagaaatttttgtttattccggcacagacatggggaaccattgccatcgtcgcagcggtcgtactcagtgcagtcgtattcttcaaaatgaaaaatgacaagtccaaatattttctcagtatggcagttgtcatcagtgtgatgttctgcttttccgtacgtatgcatgagagatatctgttcccggcagttgctttgatgcttgccgcatttatctatcgtccatgcaaggaattgttttacggatttatcggttataccttggtggtttatatgaataccgcgcatgtgtattatacggcggtagaacttggaacgacgggaccaaccggttatattatcggtgcggttgcggtattgacattgttcctttttggttacctcctttacacaatctttaagaagagtgagatcgtgcaggaagcgaatgtagacgagggtggaaaatcgaagaagaaacgacagaccgtacaaaaacagcaggaaaaacgatttgaatggaaaattattccaactgttgtgatggaaaagatgacaaagacggattacattattttatttgctatcatgcttgtttatggtattttcgctttccatgatctcggaaagacaagcgctccggagaccggatgggaaggaacgcaggcaggacagcagatcgtccttgattttggtgaagtgaagaacctgaaagaatttgaagtgttttccggaagttatgaaaaccgaagcctttatatggaactttcgaacgatggaaccaattatgtgagcggtggaacggcaaaagtctccgatgtattcaaatggaacaatgtgcagcttgtcgctgacggcggttcggaggcgacgacggcatttaacgtcacgacacgttatatccgctttacgacagtagaagatctggtgaccttaaaagaaatggtatttaaagacgcggacggaaatctggtggttccggtcaataaagaccaatatccggaactttttgatgagcaggatgagtacgacgatgcgcataccttccgcagcggaacatattttgatgagatttatcatgcccgtacggcgtatgagatgattcatgatttgtacaattacgaaaatacgcatccaccattgggtaaaatctttatttccctcggaatccgtatttttggaatgaatccgtttggatggcgtatcatcggtacattgtttggtatcggaatgctcccgtttttgtatctgtttggaaagagactcttccatcagacatgggtggcaggcgtggttacgacgttgtttgcttttgattttatgcactttacgcagacaagaattgccacgatcgacgtatatggtacgttttttatcatggcaatgttttactttatgcttcgctatgcacagacaagtttttacgatacagaatttaaaaagaccctgattccgcttttcttaagcggtttgatgatgggactcggttgtgccagcaaatggacggcggtttatgcggcagcaggactggctgtattctttgcggcgatcatgctttaccgatatatggaataccgcagggcgtgcaacaatccgggcggaagtaccggaacgatcgcgcaccggcatgttatagatgtctttaagagtaattttcttaagacaatcggtgcctgtgtcatattctttatcgtgattccgggactgatctatctgtgttcttacattccgtttaacgatggaacgacagacggtctgtttacgcggatgatcaataatcagaaatcgatgtacagttaccattcccagctggaagcgacacatccgtattcttccacctggtatgaatggccgacgatgatccgtccggtattttactattgcaacacggtggcaaatgatatgcgcgaaggaatcagcgcattcggtaacccgctcgtatggtgggcaggcatctttgcgttcctttacatgatctatcttgtagtgaagaaagcagataagacggcattgttccttgtatttgcttatttggtacagtacgtaccgtggatgctcgtgccgagatgtacatttgcttaccattattttccaagtgtgccgtttattaccttgatgatcggatacacattgtatcgctttatcggcgacagtaaaaagaaacgcatttttgcttatgtatatgcagcagcggctgtggggctgttcctactgttctatccggtattgtccggacagccggtaagcctcgaatttgtggaaaacggactgcgctggctgacgggatgggtattagtactgtag

SEQ ID NO: 1734 - DNA, 2589 bp, Unknown
  Artificiall/Consensus sequence
ttgaatactacaccagaaaatcaacagaaaaagcatatatgtgccgcacttttggctcacgtagatgccggaaagacgacattgtcagaagcattattgtatgaaagcggcgtgatccggacgcggggacgcgtagatcacaaagatgcctttttggatacctcaccgttggaacgggaacgaggaattacaattttttccaaacaagcatgcttttcgtatggaaatatggatgttacgatgttagatacaccgggacacgtagacttttcttccgagatggagcggacgctgcaggtcattgattatgctgttttgatcataagcggaaccgacggcgtgcaggggcatacggagactgtgtggaaacttttgcagaaatatcggattccgacatttttctttgtcaataaaatggatcttccgggggcggacaaagcggcggtattaaaagaactgcaggcaaaattatctccttactgcgtggattttaccgaagaggaagaactgttgtgcgaaaatgtggcaatgtgcgaggaaactctgttggagacctatctcgaagagggaacttttgatctgaaaaaagaggtcagaagactggtttccgggaccttgctttatccgtgttactttggttctgcacttcagaatgaaggcgttgaagcgcttctggagggattggaaagctacacgaaaatgccggaatatcagaaagaatttgccggaaaagtatataagattacacgagatgatgccggacagcgtttgacccatatgaaattgaccgggggagaactgaaactgcgcgatgagatcgaaggaattggcaaagtaaatgagatccgcgtgtattccggagaaaaatatacgctgcagcaggaagtaaaggcaggagatatctgcgcggttccgggatttaccgacacctacgccggccaaggtgtgggaaaagaagccgatttttgtgccaatcagctggcgccggtgtgcaattatcagatcctgcttccggagggaacggaggaagccattgcctggaggcagttaaagcagttagaagaagaggatccgaatcttcatctttcgtggcaggcgcagacaagagaaatcttcatccagccgatgggcgaagtgcagctggaagttatcaagagaatggtcagcgaacgttatggaatggatatcgcatttggaagtgcgacgatcttatatcgggaaactatcgaagatacggtgattggaatgggacattttgaaccattgcgccattatgcggaagtgcatcttaaaatggaaccgcttccacggggcagcggtcttcaatttgtgacagaatgcagcgaggacgaattggatctgaactggcagagactgattcttacacatctgggagaaaaagaatttaccggtgtgctgaccgggtcgccgatcacggatatcaaatttacgttgatcgccggaagggcacatctcaaacataccgaagggggggatttccgccaggcgacataccgggcggtgcgtcagggactgcggcaggcgaaaagccgtctgctggaaccgatgtatcaatttcggatggaagtgccgatggaacagatcggacgagttatgagcgatgtcggaaagatgcacggaacctttcgacagcagccggatgacggtgaaatgagtgccatcgagggaatttgtccggtcgcatcgatggcggggtatggtacagaatttgcggcatttacgaaaggacgcggacgaatgacgctttctttctgtggttacgaaccgtgtcataatgagagtgaggttgtgaaaaattgtaaatacgatccggatgcggatgtggaaaacacagcagattcggtgttttgcgcgcatggatccggttttgtcgtgccgtggaatgaggtggcaaaacacgtacacgttgatacgtcgataaaaaaacgccagccggtaaaagcctcgactgccgtcccgaaagagccgtcgaaaaagaattcgaaaatgtcggaagaaaaagaattacaggcaatttttgaacggacattcggaccggtaaaaacccgtgtggaaacgccggcaaagaaagtgatcaaagcagaaccgggaaagacgaaaaccaaagagtataaaccggtatacgaggaagaatacctccttgtcgacggctacaacattatctttgcctgggacgaattgaaagcgcttgcggcagaaaatctggaaggcgcacgaaccaaactgatggagatcatgtgtaattatcagggattttgcggctgtcatctgatccttgtgtttgatgcgtacaaggtaaagggaaatccgggcagtgtagaacaattccacaatatcagcgtcgtttatacgaaggaagcggaaacggcagatatgtatatcgagaagacgacgaaagaaattgcacgaaagaaaagagtgcgtgttgcgacatccgacggtatggagcagatcatcatactcgggcatggggcgacaagaatttctgcccgtgcttttcaggaagaagtaaaacgtgtcaacgaccgcattgccgaagaggttgagaggagaacggaaaagttatga

SEQ ID NO: 1735 - DNA, 2304 bp, Unknown
  Artificiall/Consensus sequence
atgaatggcgctgtgtcgaaaaaacgttggctgatggagattggaatcggatttatgctggggagagtgtgggtattttccatcaacccctttggattggcatatttgtgtgcatccggagtgtatccggcaggaagagggctggtctttctttctgttctggcaggctttatcaccaaagcgaaaggactggatttcctacattatatcatgatgacggggctgctttggtttgtacagaagatcatgaaaaaagtggatggcaaagaggggagctgccaggccgtggcggcgatcggagggatcctgaacgtggtattgtcggtgacgacgggatttctgcaacatggcactacaagtgtagtatttacggcggcgctggaaagtatttgtctgatcgcgtttgcctatgtgatgcagtggggactgcgcttccttttatatgaagactgggaacgggaactcagtaacgaagaaatgattagcgttctggtgcttgcggcattgagtgtttacgggatgccgaggctgtttgacggcgttttgtcgattgtggagacaatgagctacctgcttgtgctctttgccggctatcgttacggcgctgctgtcggtgctatggcaggtgcggttggtggcatcttgtcagttgccggcggaagtgatatgatattgataggagtgtattgtgtgctcgggatcactgtgggaattttccgcgagatcggcagaattgtgagcgtgattacttttgtggcagcagggatcgtttttgcgtatgtcatccgcgacgaagtactcggaattgtcgaattgcgggggatggtgtcagcggggatcgtatttttggcggttccgcgggaactggtgcggacgatcgagacggattttatgcgggagcgggaaaatccatttgccaaagccgacttgatgagccttgccaacgagaaaatcgacggattttcgacagcctttctgcgtctggcaaagtcgttccgggactttaccaagtgtgaaaatcatatttccggcgaagaaatggaacttatttttgatgagcttgcggataaaatctgccgtgaatgtgaaaattgcaagtattgctgggaaatgcattacgaggagacgtatgacaatatccgaaacattcttgcggccgccagtgaacagggcgtggtcgaatgcgggcaggtggatgcgtcctttctgaaccgatgcattcatttagaagaatatgcggaaaaattaaatgagcgcatggcacttgcgaggatgaatctcagctggcgcaataaaatggcggaaagccgggaggcgatggcatcgcagatgtatgagatcgcttatgcgctgcgtggatttacgcaggaactcaatcagacggtggatgtgccggaggagacaaagaaaaaggtattgtatgcgcttcgctcgctcggcatacaggtcaaaaatctttcctttcaaaaagatgtaaaaagcaatctggaagtgtgttttctggcgagagcgcggggaaatgcctgcattacgaaaaaagatgtcgcacttgcgctggaatccgtgctttcgacgaggatgacagcggggcgttatgtgaaaaatgtgatttccaaagaatacgaagtgacaacgtttgtgcaggacgtgaattttaaggcactgacgggacttgccagagcgacaaaaagcggagagacggtctccggcgacaatttttcatttatggaacttcggaccggagagctgatcatgatgctgtctgatggcatgggaagcgggtcaagagcgtgccgtgacagcgaaaatctggtcgacgtgcttgaaagtctggtggaggcgggatttcgcaaagagtccgcaattcggctgattaacacattatttgtcatgtcttatgaaggaaaaacgtttacaacacttgacatgacggccgtagacctttatagtggaagttgtgagattgtaaaaaatggtgcggctgctacatttatcaaaaagaaagatggcgtgaagaccattttttcaagcgcactgccggttggcgtggaaatgaacgcggatccggagacgattacccaggaactggaagaaggggacttcatcgtaatggtgtctgacggcgttattgatgcattcccgggggatgaaaaagaattttatgtagaaaatattttagagaacttacaaacaaataacccatcggagatggcgcggagtgtgctgatggaggcgcttgcgcgcaatgccagacagccctttgatgacatgagcgtgctagtggccggtatttggcggaaatag

SEQ ID NO: 1736 - DNA, 1215 bp, Unknown
  Artificiall/Consensus sequence
atgatattcggacgatttcgcaaacgaaaagcggaaccggaaatagaagaagtactgtcgccggagcaggaggctgagcagattgcaaaagaaattaaagccgattcggcggcagaaaaagagcaggttgacataaaagacaaaaagcagcgcattgactatattcagcgcttgtatgaggggattcaggaagcaaaaaaccagaatgaacagattaaaaaagagtatgcagaggtaacttcgcatctgaaggatatccagctgatggatcaggcactcgacgaggacaaagtggttgttctgcagacggcatcggcgatcgatcagttaatgaaagaacgagattatctgaaaaaacgccggtataagttcaatgatgcacagcgtcaggcgatggaaaactttgagacgatagcagccgatgacgtaaagaagttaaagaactttgaggattaccagattaaggtaaaaaatgatctgcaccagctggagagtgagaagcagctgctcaaatcggacaaacgtgacattatcaataaacagggtactctgcgtgtcgtatcgaaggttctggcggggattctgcttgtgtttgcacttttgatgctgacgattcatctggcatttgaagttgatgttacggtgccggtcattgctaccgcggcatttgcctttttggtgttgcttgtcattatgtgggaagcgcgtgccaaccggaccgatatggtgatcacagaacgcaaatgcaaccgcgcaatttctcttttgaaccgtgtgaagataaaatatgtcaataatacgcggaccattgattatatgtgcatgaagtaccgcgtgcgcaatgcgacggaactggaatttgtgtatgaccagtatcagcgggcaaagcgggaatgggcgcgcaagcgtgagagtgtgtatatgctcaatgaaaaaaaggacattttggtcgccgaactaaagaagatgggcgtaaaagatgccgaaatctggtgcactcaggtacaggcaatcattgagccaaaagaaatggttgaagtccgccacgatttgaacacgcgcaggcagaaactgcgaagccagattgattacaatacagggatcatgcaggattttatcggagaactggaacgcatccgcgacattcgtgaagagtatgcaaaggatgtggaagaggttcttgcaaaatccaaggaaatgaatccggaaaaatag

SEQ ID NO: 1737 - DNA, 2265 bp, Unknown
  Artificiall/Consensus sequence
atgaaaaagaaactggaagattatatggactggccgaagatcgaggatctggaatatgccgaatgccggaatgttgaagacgttctgggagcggcggtagtcgaagatgggatcttgttccgctgtttctttccggaagcagataaagtattgatcaagatcaacgggaaaagccgtaccgttattatgaaaaaaatggatgactgtggttatttcgcagcattgatggttggtaagaagataccggaatacacgtatcaagtacagtataaaacggggaaaatggaaattattgacagctacgcaacggaccattttgtggatgcgatggacgaagtcatgtttgccggtggagagcatgacaaaatctacgagaaactcggagcacatccggggcatgtggcaggatatgccggtacgtggtttgccgtctgggcaccgaatgcggtcagcgtcagtgttgtcggtgattttaacaactgggatggcagacttcatccgatgcgccgcctcgaaagcggtatctttgagctgtttgtaccggaagtcggcgatggcgatatttacaaatacgaagttcacggatatgatggaaaaaccgtgatgaaggccgatccgtatggtttttatgccgagaaacgtccggcgagtgcaagcattgtctggagtattgacgaatacgagtggcaggatgcagactggctgaaaaagagaaaacagaccaattggaaaaaagagccgatagtcatttatgagatgcaccttggatcttttgaaaaaccgatgggcggcggtttttatacctatcgtgaactggctgacaaaacggcagagtattgtaaaaaaatgggatatacacacgtggaacttatgccggtgatggaacatccgctggatgcttcctgggggtatcaggttatcgggtattatgcaccgacttcacgttatggaacaccggaagactttatgtattttgtcgattacctgcaccaggcaggcattggcgtgatcttagactgggttcctgcacattttcccaaagatgaacatggactgggacgttttgacggcacttgtctgtatgaacacctcgataaacggcagggcgaacatccacactggggaacgctcatttacaattacggccgtccgcaggtggcgaattaccttatcgccaatgcgttattctggctggaacagtatcatgcagacggacttcgtcttgatgccgtggcctctatgctttatcttgattatggcaagcaggacggagaatggatcgccaatatatacggcggcaatgaaaatcttgaagccatcgaatttttaaagaaattaaatcaaaagatcaaagaccgcaaagacggaagcctttcgatcgcagaagaatcgacggcgtggccgatggtaaccggaaatatcgaagaaggcggtctgggatttgacttcaaatggaatatgggctggatgaatgactatctcgaatacattaagacggatccactttttcgaaaaggccgtcatggtatgatcacatttagtatggtttaccagtattcggaaaatttcatgcttgtattttcccacgatgaagtggtacatatgaagggatccatgtaccggaaaatgccgggaacaccggcacagaaacttgccggactgcgtcagagttttggttatatggcagcacatccgggcaaaaagttactgtttatgggacaggatttcggacagatcagcgaatggagcgaagcgagggggcttgactggaacctgcttgcagacggaaaagcgatggcaagtgataccggtgaagtgattcgggtaaaatcgtcccatcggatgcttcaggattttgtcgcggatctttggaaattttataaggcacatccggcaatgtatgcctgggatgagatcccggacggatttgagtgggtcagcatgttagacgccgatcacagtgtcattgcctttatgcgcgaagcagaggacgaaaaactgctcgttgtatgcaactttactccggtttgctattccgaatttaagttaggtgtgccatatgccggaaaatataaagaaatcttaaacagcgatgcgatcgtgtatggtggtgaaaatcataccaatccgcgtttaaaaaacagtaaaagggaaaaaatggatggtatggagcagagtatcacttttacactggctccgaccgcgatccagattttcagttatcagccggaacagccggtaaatcgtaaaagaaagaagaaatga

SEQ ID NO: 1738 - DNA, 1380 bp, Unknown
  Artificiall/Consensus sequence
atgttttacgaagataccattgctgcgattgcgactgcctccgtaaatggtggagtaagtatcatccgaatcagtggtgagaatgcagttaaagttgcggacagttgtctgaaattaaaaaataaaactttggcagaagtaaaaagccatacgattcattatggttatgtggtagatgaagaaggacagaaaatagatgaagttcttgtattattaatgcgtacaccgaatagttatacaagggaagatgttgtcgaaatccagtgtcatggaggggcttttgtatgtcagacaattcttgatcttatattaaaaaaagagggtgttcgaattgcagagccgggtgaatttacaaaacgtgcttttttaaatggaagaatagatctgtctcaggcagaggcagttatggatctgattgaatcgaaaagtaaatatgcgttggaaagttcggttttccaattaagtggaattgtcaaacagaagattcagaaaatacggaatattattatggatgatgttgcgtatatagaggctgcgctggatgatccggaacatatttcacttgatctgtttgaaaaagattttttaaatcatattacgagttcgatttctgaacttggaaaaatgaaaaacaattacgataatggacgtttgatttatgaaggaattcagacggcaattataggaaaacctaatgtcggaaaatcttcttttttaaatgcgatgctgggaacagagcgagctattgtgacaaatgtacccggtacgacaagggatacattggaagaaaatgttagaattggtgatgtatttttacacttaattgatactgccggaatacatgaaacagaagatgaagttgaaaaaataggaattgaaaaagcgagggaacagctgaaacactgtgatttctgtattttaatattagaccgttcacgtgaaatagaagaagaagataagatacttttaaaagaaattgagtcgaaaaaagcagttattttatataataaatctgatcttgaaaatgtattttctatcgatgaaatagaaaatatgacaacaaaaaaaatcatcgctttttctgcaaagacaggagaaggattggaagaattgcagcagtatatcacgaatcagttttttcaaaatgagatttcatttaatcaggaaatatatctttctaatgaaagacaaaagcaggcagtgtcggaggcatacgaaagtcttcttcgtgtaaaagaaagttatgatctcggagtgggagaagatttttatacgattgatatgatgaatgcttatgagcagcttggaagtattatcggtgaaactgtggatgatgatctggtggatacaattttcaaaaaattctgtatgggtaaatga

SEQ ID NO: 1739 - DNA, 2007 bp, Unknown
  Artificiall/Consensus sequence
atgaattttccgggtaaagaaaaactgaaaaaaaaatggaataactatagaaaaccttctatgtacgagaaggggtatcgtgatgaattcgatcaggggtatgaaaaggaaaaagactcctatcagaggtatcagtctgtcataaagagaaaaattgaggtagaaagcgatattgcatacgagaaaggtttagcggtagagagccgcgaacgagatcaggaattgacaaagcagttaaaagaaaataaatatttgtttgaggagccatgtgtgattttgaatccgtatggaaggactccgctttgtgcgtatgtgatgttttggacggaggaaccttgtgcagtacagtttacggtaaaaggaaagacaaaagaggcagatatctgcgagaagattgtcacacttgaaaattggcacagagtgccggtatatggattgtatccggagatggagaatgaagtaaaactggaaatgattgacaaaaacgaaacggtcattgcggaaaagaaacttatgatactaacagacaagttaccggactctatgaatgatctggtgcaggtaaagaaaaagacagagaaatctgcgatgaaactaattttagcagtaggaaaaagtatgccatatccggctgcctttgatgaacaggtagacattcgctatatgatgcggttccgaccgcgtggctatggattttttccggtagcaaatgaccgttttattgtgatggagcggcagacccttcttcctacacagttgattccacattcgacgcagatgtatgagatggattatttgggaagagtgtaccggacgtattatgttcccaatggcatacaccacgatgtgtgtgaaatgactccgggcggcaacctgcttgttgctagtaattcccagtgtggacatgttgaggattgcatcgcagaagtgaaccgcgaaaccgggaaaatagagaaagtgctggatatgcgggagatttttggcaccgcataccgggatcggaccaattgggtgcatatcaattccctggattatgacagcagtaaaaagcaggtttatttctcagcgagaaatattcacacgattggctgtatagattggaaaaaggacaagctcaaatggatattgggcgagaaaaatatgtggaaagaacgtcctttttcgaaaaaacttctctcgacaccggaaaatatgccatggcattttcagcagcattcagccaaattgatccgggaaaacctggatggaagagaagacacgatccatattatgatctttgacaatcattggcatgtgcgaagaaaaaataagttttttgacaacgatgagcaatcttatgttacaatatatacgataaatgaaaaaaagaaaaaagcgtggattgaaaaacgttttggcgggattaagtcaaagattacatccaatggaatcttgtgtgctgagaagagacgactattttatatgggcggatttttggcatatccggagaactatgacaaccgtggtggctatatatatgaatttgattatgacaccggctgtgcattgaatgaatattccctgcgatattatttcttccgagcatatgaactgcggatgaatatgcaggatctgtcgaaggcgatggatctgtatgaagagccttgtgttggctggctgcagccatttgaaagatgggaagaaccggtcagccgtcccgagaaaaagacatcggaggcaccgatacaatgcaagcaggagagaatccgacttcgtttagaagatcagaatctccagataaaatccagagatcatttgatcgagcaggttgtcgtaaagggcaagcggaatacgtatcaaaaagatttccgtaatccgccgagagagcaggatcttgccgccgaaatggaatattatgtgtcaattccgttatacaatctgtcagacgatacgtatgaagtatacgttcgttttggtggagaattgtacgacagtggagagacatttacaatccacagccggagatag

SEQ ID NO: 1740 - DNA, 2514 bp, Unknown
  Artificiall/Consensus sequence
ttgtggcctttttctcatatctgccgattgccaaatgctcccctttttgctatactaaaattaactattcagaagaatgataaaagaggtctttttatgacagaacgcagagaattaaaaatttccgtgcgtaatctggtggaatttatttttcgagagggagacatcaattctaccggtcttggcacccggaatccggaggcaatgcagctcggtaacaaaattcacaaaaaaatacaaaaaagtatgggaatcggctatcaggcagaggttcctttatttacgtacgtcacaatgcagagtgaggaaaccggcgaagaatttgatttaaaaattgagggacgcgccgacggcatcttccgcgacgactccgaaattcttgtcgatgagatcaagggtgtttttatggacatccaccagttaaaagaacctcttttggtgcataaagcgcaggcaatgtgctatgcctatatgatctgcgaaaccgaaaatccggcatttatcaccgttcaggtgacgtactgccatctggagagcgaggagatccgccgttttccggtcacctaccgcagtgaagagatccgcgcgtggttccgggatctggtcgacttgtataccccatgggcgcgctacgaatttgactggcagaaaaagcgaaatgcttccattcagtcgcttacgtttccattcccctaccgcgacggccagaaagaacttgccgcctgcgtatataaaacgatcgagcacaaaaagaaaatttttatccaggctcccaccggtgtcggaaagaccatttccaccgtatttccgtcgctaaaagcaatgggcgaagggctgatcgaccgtcttttttatctgactgccaaaacgatcacgagaacagtcgcgcaggaatgtttccaacttttgtcagagcagtcgctgcattttaaatttctcacgatcacggcaaaggaaaaaatgtgctttctggaaggcagcccggagtgtaatcctgcttcctgtccgtatgccaaggggcattacgaccgcgtcaatgactgcgtttatgatatgctgatccatgaaaatgacatgaatcgggataccattctttcgtatgccgaaaaacacaatgtctgcccattcgaaatgtgcctcgatgcggctctttttgcggacagtattatctgcgattacaattatgctttcgaccccaatgtctatctgcgacggttcttttcggaggaaaaaaaaggaaattttgcctttttgatcgatgaggctcataatctcgtagatcgtgccagagaaatgtacagcgccgtgctggtgaaagaagattttttgaaagtaaaacgcattataaatgaggagtccaccaaaaattacccatccgaaataaaatatttatttaaaatttttgcggcttcgctggaccggtgcaacaaaaccatgcttgaatggaagcacgcctgcgatcattttgaacttctggaggacatttcttcttttgaatttcaactgctgcgtgtcgtaaacagttttgaacttttgacgaaagaagtgaaggaacttcccgagcgcgaaacgattttaaacttattttttgctgtccggcattttctcaatatgaacgacaccaaggatgaaaaataccgcatttacaccgattatgaggaatccgggaatttccgcatcaaactgcaatgcatggacccttcgacacggctcagcgatgccgaagaacaggcacgcagtacggtctttttctctgctactctgctgccgatccgctattatatggagcagctttcgacgaccgaagaagactatgccgtctacgccaaatcttcgtttacgccggaccagcggcgcatcgtgatcgccaatgatgtcaccagcaagtacacacggcgttccgtctcggaataccgccgtatcgccggctatatcgaagaatttgtgcaggcaaagcagggaaattatatcattttcttcccttcctacgcctttttacgccaggtcaaagaccagcttcatctcccggagcagacacaaatcgtcgaacaatgtcaaaatatgtcagaatcagaaaaggaagaatttctggcttcttttgatgccgaaaatgactacactcttgtaggcctctgtgttatgggcggcattttcagcgaaggaattgatctgaaagaagaccgtctgatcggtaccgcgatcgtgggaaccggccttccgcaggtttgcgaggaacgcgaattatttaaacaatattatgatgaaaaaaatggacacggctttgactatgcctatctgtaccccggcatcaacaaggtttttcaggcgggcggccgcgtgatccgtacttcttccgaccgcggtgtcattctgctcttagatgaacgcttcgccggcaatagttattctcatttatttccaaaagaatgggtaccttacaagattacaaataaaaaaggaatgaaagatatcctccattccttttgggaaaatccggattcctctccggactag

SEQ ID NO: 1741 - DNA, 1884 bp, Unknown
  Artificiall/Consensus sequence
atggctttgaaaaacagacgttttttggcactttcggatgaaattctgatgagtgtagaaaaacctgccagatatacaggaaatgaaattaatatggtaaaaaaagacccggcatcggtagatgtccggttttgcatgtgtttcccggatgtgtacgagattggaatgtcgcatctgggaatccagatattatatgatatgtttaatcagtgggaagacacgtattgcgagagagtctattctccgtggccggatcttgacaagattatgcggaaaaagcacattccgttgtttgcgcttgagagccagcagccgatcaaagagtttgacttcctagggatcacactgcagtatgaaatgtgttataccaatattttgcaagtcttagatctgtccgggattccgctgtatacgaaagaccgcacgatggaagatccgtttgtcgtatgcggaggaccttgtacgtataatccggaaccgatcgcagacttttttgatctggtttatatcggtgagggtgagacatcgtaccgtgaacttttggataaatataaagaatggaaaaaatcaggaaaatcaagacgggaatttttggagattgcggcgacggtggatggaatctatgtgccatctttgtacgatgttacgtataatcaggatggaacgatccatgccatggtgccaaactgcgaaacggcgccggaaaaggtgaaaaaacaggtcgtcaatgatctgactcatacgtattatccggagaagccattggttccttatatcaaggcgacgcaggaccgcgttgtgttggagattcagcggggatgtatccgtggatgccgtttttgccaggcgggaatgatctatcgtccgatccgtccgagagacattgattatctgaaaaaaatggcagttacgatgctcgataataccggatatgaggaaatcacactgagttcattgagctccagtgactataaagaattatcggaattggtgtattttctgattgatgaatgtgatgagcgaaagatcaatatttcgctgccgtcactgcgaatcgatgccttttcgctcgatgtcatgagcaaagtgcaggatgtcaaaaagagcagtttgacgtttgcaccggaggcaggatcccagcgaatgcgtaatgtgatcaataaaggtcttaccgaagaagtgatcttgtcgggcgcatgggaggcatttcagggcggctggaaccgtgtaaaattgtactttatgcttggtctcccgggcgagcgggaagacgatatcgagcagatcgcggtattggcggataaaattgctgccaaatattttgaactgcccaaagaagaacgtcatggacggccggagatcgtggcaagttcgtccttttttgtaccgaaaccatttacgccattccaatggtcgccgatgaatacggcagaacagtttgagtcgaagcggcgttttctgcttggaaaagtgaaagagcagttaaaccagcgctcgatccgttatcaatgtcacgatgcggttacttccgagttagagggaatctttgccagaggagaccgcaaactgtgtaaagtgattgaagatgcgtatcgcagaggttgtatttttgacgcgtggacggactattttaaagaagatgtatgggaacaggtaatggatgaaaatggtgtttcgcgctatttttataattacagggagcgcggcaaagatgaaattttcccgtgggattttattgatattggagtttccaagaatttcctgtatcgcgaatatgaaaattccctgcaggaaaaagtgaccccgaattgccgggcaaaatgtagtggatgtggagccgccaaatttggttcaggtgtctgcatggaatggaggcaggcatga

SEQ ID NO: 1742 - DNA, 3534 bp, Unknown
  Artificiall/Consensus sequence
atgaaattaaaggaagtaatccgaattgatgaaaaatttcagcattcgatcaatctgaaactggatcagatgcggaaagagccaattgaaaattatattccgacacaggcttctatgaagattctttgtgaatatctgggagaattaaccggaaagaaaaaagaagcatccacgatgctgatcggtccctatggaaagggaaaatcccatctgcttctcgtcttgatgtatctgctgaacccgtttgacgagaaattgagtgcgcatctggtggagcactttaggcaggcggaggaaaaaacgggaaagaaaatacaggaatatatggagcggggaaagaagtatctgccggtggttgtgtcttttggcagcgagtccctggaacagtcctatcgaagaggactgctaggtgctttaaagcgatttggactggaagactgcattcccgacagctattatacggaagcggttcacacgatacagacatgggaaaaagagtatccggaaacgtatgaaaagtttttggcaaaaatcggaaagagcaaggcgcgctcatttgtaaaagaactgcaggaagaaaaggaattgacgatgcgccggtttcaggaaatttatccttccttgacagccggaagtcagtttatgccaatgattcagaccgacattgctacgttgtacgaggaaattcttgcgcggatctgtcggaaaccctatcactacgcgggaatggtagtcatttttgatgaattcagcaagtttatggagagcgagacgaaggaaagcgtttccaaagatatgaatctggtgcagcagatgtgtgagctggcgaaccagtcgtcggatgctgcgcggatgattcagattttcgtggcgcacaagagtatcaaagagtatagcggatatttgtcccaagaggtgattaacacgtttaccggcgtagaaggacggctttctgagcggtattttgttacgacacaaaaggacaattacgaattgatcaagaatatgatccggaaggagtcgtttgaaaaaattccgctggattggaaggaaatcgcctcggcaaattatggcgcagccggttttgaccgggattttacgaaggaagaatttgaagagatcattgtgaagggatgttatccaatgcgcccgttaacgacgtttctccttttaaaagtcagtgaacgcgtaggccagaatgagagatcgcttgtgacttttctcgccggaaacgaaaaaggaacgttgtcagattatgtaaattccgagcgggatgcgaaacagtgcatgacaccgggcagagtgtttgattatttttcgccattgttaaagcgggatctctggaaccgtcgaagtcatctggagtggagcaaggcgatgatggtactcgaaaaggatctgacagaagaagaggcagaaatcgtgaaaaccatctgtctgatgcgaatcgtcggtctttccgagaaaatggaggcgacggcacagacgcttgcgctggcaaccgggcgaaaactgaatgaggtaaaagagcgcctgcagacactcgagaaaaaggaagccgtgctgtttcgcgataaattgaattcgtatgtactgcgccagaagattgatgtggatctggaggaaaaactggcacaatgcgagcaggaaattacgaatttttcgttgacgaaagaattggatcatgtgatgggacatcgctatgaactgccaaaaaaatacaatcatgttcatgggatgactcgttttttcgataccatttttatggagacagagcgttttttggaactgaaatccacggatggtctgtatgaagaagctcagggcgggtcatttgcagatggaaagattcttttactgattgacccttatgtcaaatataaaaaaagtgtaaaacagcatcttaatgaattgagagacgataaattggtagtgatctatccggaaaaaccatttgaggcggaagggttgctgcgccggatccgaggcatccgcatgattcttcagcaggaggactatctgaatcacgacgatgtgcttgtggaagaacttttgatgatggaagaagactgtctgtataagctcaattggatgtttgaaacgcattttgtacccggacgggcaaactgccgcgtatttaccaataataaaaacaaatcccttacatttaaccagcttctgagtgaaatctgcgagcagtgttatggaaaggtgccaagaatcaatcatgagctgatcaatcgccgttttgtatccgcgcagatcaaaaaagcacgaaaagaagtggtccgctgtattcttgaacgaggggatctgcatgaaatggcagaaggaaacagtgccgaggcgacgatctgccgtgccacgttatttcacaccggtattatgacaggtgactgtaaacccggtgtcaatcacatgctgtccgtcatctataacacaatgtttgaagcggcgggaaaacgggtgccaatgacatcgctgtatgaaaaactacggggaacggagattggacttcgcgaaggggtggtgccgatttaccttgctcattgtatcataggctggggaatcagcgctgttttctatgagggaaagaaggaaatcccatttcaggcagaaacggtggaacttgtcaatgagtatccggaaaaatatgatctgtatatagaacggggcagctttaaaaaagaagattatttaaagaaactggaaaaagtttttcctcttccaaaggaatatcaaaatccgggacaaccatctacaagattggaaaaaatcgtaaatgggctgcaattctggtttacccatctgccggcttccagccgtatggcgacctatccggaagaaataaatgaaaaattgtgtaaactgctcgcacacaacgatgaaaacccaagggagcttatatttgaaaaattgccgtttttgatcccgcaaaagaaaaccaacattaattatgtcctcttttgtaaaaaattgatacaggcaaagcaggagatcgattccttttatgaaaatctgatgggggaacttcgtcaggttaccatgacctgcctggaagtcactgatgagacaatcaagccggcactgaaagaatgggcgcgaaagaaacgcacgcagacaaagaccagcgttttatctgcgtcagcggcttcgttgttagaatatatgctgtcgctgtcggaggagtcggaagaggaagtgatcgccgggcttgctaagcagatcacagggagatatccggaagattttcgccaggatacggtacaggaatacaaaaaggcattgcaaaatatatgtaaggaattggaaaatgctgcggggcagacagtaccggaagaagcctgtcatcttatctacacggatccacagggaatccagatggataaatacttaaaagcggttgagacggattctgtcatggtatttgccaaagcggcggtagaagaggcgatttccgaatttggagacagtcttgaaaaggaacagaaggcaaagattttgctggatttattgcagcaggaattggagtga

SEQ ID NO: 1743 - DNA, 1698 bp, Unknown
  Artificiall/Consensus sequence
atgagaggaccaaaagcaccaaaagacccaaccaaaaaaagaccaagcctgtatctgatgttagataaggatattgcgggactgccgggaagggatggcagctgccgggataccaactatatggaaggacgtctggtagagcaggtaaaaggaatctgcggagatgtggacgaagatattctgaaactgttagaatcttttgagggaatccgtaaacttgtacatagtatcggagtgagcattaccgcgcatgaagaagcagaaaaaagcagttttatcgattttacgatcaattgttatggaaaagaggataaatacgttaccggaagcaatatcacggtaaaatgtccatgcaacggcgaggaggttttgatcgaacttgcacaggtgccggtcaatgagatggatgatatcatcggagaattcgattttgattttccgaaggactgtaagagtgccagtgtaacgctcaaattctatttgaatgacggctatcaggtgccggagattcaagtggatccaccgattgattttgcctccgaagtctatcggcaaatgattgagaaatcattgttgaatcttggaaatgtaaaacgactgaaaacggcgattgaaaaggcacagcgtggcgaagaggtaacaattgcgtatattggcggttctatcacacagggagccggtgcaaaaccgattgagagtaaatcgtatgcatacttgtcttatcgtggcttctgtgagcgttttacgccggatgacggtgcacatgtgacatttgtaaaggccggtgtcggaggaactccgtccgaactcggtatgattcgttatgaaaaagaagtgacagattatggaaaaatcaaaccggacgttgtcattgtggaatttgccgtaaacgatgaaggggatgagaccgagggggtaagttttgaaagccttgtgcgcaagattgccaatgcggataataaaccagccgttatccttaattttgcggtatttatgaatgaatggaacctggaagaccgtctcgtaccgatcggaaaaaattatgaccttccgatggtgagtgtaaaagcggctgtcgtaccacagttttctaaaaatacggttgtgacaaagagacagtatttttatgatattttccatccaaccaatgatggacatcgtattatggcggactgcctgatcggtctgtttgagcaggcagcgaaagcaccgatgccggaaaacgacagcgatttcacagtgaagccggtaaaaggcgcagaatttgaaaatatcatattggtggattcaaccaatattgaacagtatggaatggtttcccataagggatttgatcataaagataccgaaatccaatacgtagaaagaaatctgagcagtcaggcttctccggtgctggaaaatggctgggcgaaagcctatgagacaaaggatgcggaatttgttatggagattacggcgagaaatatcgtgcttgtgtcgaaagattccggaacaccaaaatttggaaaagcagatatttatgtggatgataaactggttcttacggcagatccacttgtgaatggatggaatcattgcaatccgcagatcattttgaatgaaacagagtcggcaaaacacgttgtaaaaattgtgatgcatccgggcgatgaggaaaaagcctttacgatccttggatttggagtcactctttaa

SEQ ID NO: 1744 - DNA, 1554 bp, Unknown
  Artificiall/Consensus sequence
atgaatgaagaaaacaacaatccttgggaaaatacgaacaataatggcatgacggacaatacgatttatgtacagccgtcacagacagatgatgcggcaggcacacagaatactgccggaacagatgcagggccgcagccgatgccaagttctgacaatatgtatcgttttcaaaatacgaatccgggcggcgggcaggagccaccgagaccaccaaagcagaagaaaaaaggtggtatgaagaaaacgttactatccgcagtcgtatttggtgtcgttgcagcattttgtttctttgctatcgtgaagatctgtggattgcaggttggaacacagaaatcaaattccggtgagatcggaacagtaaatacggattccggaaatacggaattgactgccatatcaggtggagcaatttcaggtgtatctgatgtgtcaggcattgtggaaaaggtaatgccatccatcgtgtccattacagagacgagtatgcagaaatccatttttggcgaatacccatccgaaggtgcaggctccggatttatcgtgaaacaggatgacaaagaactgctgatcgtcacaaataatcacgtcgtttccggtgcagagagcattactgtcaagtttattgatgacacaacggcgaaagcaacggtaaaaggaacggattctactgcagacttggcagtaattaccgtgaaactcagcgacttaaaagaagaaacaaagggcaagataaagattgcaacattgggacattctgacgatgtaaaagtcggtcagatggcgatcgcgatcggaaatgctcttggatacggtcagtccgtaaccgttggttatatcagtgcgaaagacagagaagttgaagttggcgatgaaaatggaagcggatccaataaaatggtacttcttcagacggatgccgctatcaaccccggtaacagcggtggagcattgctcgatgtaaacggcaacgtcattggtattaactccgtgaaatatgcagataccaaagtggaaggaattggatatgcgattccgatgagtgacgcaattccgattattaatgaattgatgaaacgacaagtgctcagcgacagtgagaaaggttaccttggaattaccggtaagacaatcagcgattctgtcagcgaagcttatggcatcccggttggcgtgtatgtttctgaagtgtccgacagtggcgcagcaaaagcagccggcatcaagaaaggcgatgtcatcacaaagatcaatgatgccaaagtatctacgatcgagcaggtacagaataaggtaaataatacaaaagcaggtaccgagattacggtaacaatatccagaagccaggatggcgagtacaaagagcagaatctcaaagttactttgaaaggctcggaaacacttaacgaactggacaatggatcacaggattcgggaaattcaagtggatccaatggaagttctgacggaagctccgacggaaacagcagtaatccatatggaaatgactcttacgatgattcctacggaagtcagatcatgccttggtaa

SEQ ID NO: 1745 - DNA, 1674 bp, Unknown
  Artificiall/Consensus sequence
ttgagtaaaaaagttaaaacaggaaatgagagagtacgtatcgtacctttgggtggcttggaacagattggtatgaatattacggctttcgagacagaagaaagtattattgtagtggactgcggactggcattcccggaagacgatatgttaggagtcgatctggtaatcccggatatcacatatctgcaggacaacagagataaagtaaaaggatttgttatcacacatggacatgaagaccacatcggagcattaccatatgttttgaaagagttaaatgttccaatctatgcgacaaatctgacgatggcgatcattgaaaataaattaaaagaacacaacctcatgggtgtgacgagaagaaaagtagtatcgtatggacagtatatcaatcttggagatttccgtattgaatttatccgtacgaatcacagtattgcggattctgctgctcttgccatttacacaccggctggtgtgatcgtacacaccggggacttcaaggtggattatacgccggtttatggcgacagcattgaccttgcccgctttggtgaacttggcaaaaaaggtgtgcttgcattgatggcagacagtaccaatgtattgaaaccgggatttacaatgtccgagagaacggttggaaagacatttgacacgatttttgatgaaaatgaaaagagccgtattatcgtcgctacgtttgcgtcgaatgtagaccgtgtacagcagatcattaactctgcgagaaaacatggacgtaaagtcatcgtcgaaggacgaagcatggtaaatattatcaatacggcagtagaactggggtatatacaggcacctgacaatattatcatcagcattgaagaaatgaaaaactattccgatgaacagatcgtacttgtaacgaccggaagccagggagaggcgatggcagcattgtctcgtatcgctgcttccatccaccgcaaagttacgatcaaaccgggagacacggttatttttagttcgaatccgattccgggtaacgaaaagagtgtatcgaaggtgatcaatgaattgtccatgaagggcgcaaaagttatcttccaggatgcgcacgtatccggacatgcatgccaggaagaattaaaattgatctattcgctggtacgcccgaaatttgcgattccggttcatggagaataccgtcatcttttacgccatggagaactggcgcaggagatggggatttcaaaggaaaatgtcgttattatgaaatccggaaatgtgctggaattaaaagaagacagtgcaaagattgtcggtgaagtgcaggcgcagggaatcatggtagacgggcttggtgtcggcgacgttggaaatatcgtacttcgtgaccgtcagcatttgtcagaaaatggattgcttgtcgttgtattgacgatggaacgtggttccggacaggttcttgccggaccggatattgtttcgcgtggtttcgtctatgtgcgtgaggcagaaaacctgatggatgaatgtctggaaattgttaatattgcactggaacgtctgtttgatcgtggaattacggattggggcaagatcaaatccgagattaaagattccctcaatgatttcctttggaaaaagacgaaacgaaatccaatgattcttccgatcattatggaagtataa

SEQ ID NO: 1746 - DNA, 1758 bp, Unknown
  Artificiall/Consensus sequence
atgaaacataaaagtaaaaaatggatgcttcagaccaaacgggcagattttcgcaagatcagtgaaaaatttgggatatctccggttctggcgagatgcattgtaaatagagaagtacaagaggaagaaattggaaattacatacacgcagactggaggcagctgcattcgccgtggctttttaaagacatggcgaaggcggtgcagattctgcgggaaaatagagaaaaattagtggcaatttcttcggattttgactgcgatggaatattttcggcaatcattttaaaaaaagggctggaaaaagttggaatacgtagtgagatttatacaccagaccgggtggcggaaggatatggggtaaatcgacggattgtggatgaggcgacagaggccggcgcggagatcctgcttacttgtgataatggaatcgctgccaatgaagaaatccggtatgccaaagaaaaagggatgacagtcattgttaccgaccaccatgaagtgcaggaagagctgccaccggcagatgctgtcgtagatcataagcaagaggaatgtggatatccgtttaaaggactgtgcggtgccggtgtggcatttcagctgatcggtgcattgtacgaaaaagagggcatctcgcccgatgagcgtgaggacttactcgaatatgcagcaatcgcgaccgttgcggatgtgatggaattaaaaggcgaaaaccgtgggctggtaaaatccgggctgcgggcattggaacatacaaaaaatacaggacttcgcgctttgctggaagtgcaggaattaagtggaaaagaactcgaggcgtaccatatcggatttattctcggtccctgctttaatgcggcggggcgaattgataccgtgacgagagcgtttgaacttttggaggaaaccaataaggaaaaagcactgcaaatggcgcggcaattaaaagacatcaacgataccagaaagcaaatgacagaagaggccgcaaagtgcgcctttgagatattgcaggaaagcggaaaagaagatgagccggtacatattgtgcttttgccggattgtcatgaaagccttgtgggaatcgtggcgggaaggataaaagaagaataccatcaccccgtaatcgtgttctgtcctgtaggagacgggcttgtaaaaggttccggacgttccatcgagtcctatcatatgtttgaaaaattgatggcatgtaaagatctcatggttcgctttggtggacacaaaatggcagccggaatgacactgcatgaaaaagatctcccggaattagagaggcggttgaatgcagaggcgggacttacacaagccgattttgtgccggaattatggattgatgtggcgatgccggtgcagtatatatcgattccgctgatcgaagaattgcagacgctggagccattcggggtaggaaatccgaagccggtatttgcagaacaacatttccatatactggaagcatcgaggcttggaaaaaatagaaatgtgctgagcatgaaagtagcaaatgaaaaagggtatgtcataaaggcagtatattttggcgacattgatgtgtttgaagaatttgtatgtgaaatatggggagacagtgaattgcagaaaatgtatcagaaacagcccaatgaaattgatataggatttgcctattatccttccatcaatgaatacggcggaaatcggacgctgcagatcgtagtaaccgattattgtgtggtacacaaggacaggtaa

SEQ ID NO: 1747 - DNA, 1074 bp, Unknown
  Artificiall/Consensus sequence
atggaaatgacattgagatggtatggcgaaggaaatgacagcgtaaccttggagcagattcgccagatcccaggagtagcaggagttatcacagcacttcatgatatcccggcaggagaggcttggacttatgaagatgtaatgaagagaaaacaggaagtagaagccaaaggtcttaaactgtgcggtgtagaaagtatcaacgtacatgaagatatcaagatcggacttcctaccagagataaattgatcgaagattattgtaaatctttggaagccgttggaaaagcaggcattcaccttgtttgttacaatttcatgcctgtttttgactggacaagaacggaccttgcgatgcctttagaggatggatctacagcacttgcttacgattcttctattatcgatggtatcgatgccagtgaaatgtttgaccgcatcgaaaaagccagcggcggttttgttatgccgggctgggagccaaaccgtagagacgagattatggatctgtttgataaatacaaagacgtaacggctgataaactgcgtgaaaacttcaaatatttcctcgatggaatcatgccaacctgtgaaaaatatcagatcaagatggctgttcatccggatgatccggcttgggatgtatttggccttccacgtatcgtaacatgtgaagatgacctccttaagatcgcttctttaaatagcagcatttacaatggatttacattctgtaccggttctttaggaagtaacctgaacaacgaccttcctaagatcatccgcaatccgaaaattgcagagagaatccattttgcgcacatccgtaatattaaatacgaaaacaaagacttgttccacgaagtatcccacctttcttctgatggaaactttgatatgtatgaaattgtcaaagcattgatcgatatgggatttgacggtgtaatccgccctgaccacggacgtatgatctggggtgagcaggcaagaccgggatacggactttatgaccgtgcacttggtgtcgcttatctgaatggtctttgggaagcaattaagaaaaataacaagtaa

SEQ ID NO: 1748 - DNA, 2037 bp, Unknown
  Artificiall/Consensus sequence
atgaaaaaagagcaaggaagtttagcaattaattctgataatatttttccgattattaaaaaatggctgtattcggatcacgacatttttatccgtgaacttgtcagcaatggatgcgatgccattacaaaattgaaaaaactagagatgatcggggagacatcccttccggatgattataaagaaaaagtggaagtatttgtcaatgcggaggacaagacgatccgttttgtggacaatggacttggtatgacggaagatgaagtaaaagagtacattaaccagatcgcattttccggagcgacggatttccttgagaaatacaaagacaaatcaagtgaagaccagatcatcggacatttcggacttggtttttattcggcctttatggtggctgaccgtgtggagattaatacttgttcttatcttgagggcgagcaggcgattcactgggagtcagagtgcggaaccgaatttgagatgagtgacagcgacaaagatacggtcggaactgaaattatccttcatttgaatgaagacagttatgaattttccaatgaatatcgtgttcgtgaagttttggataaatattgttcctttatgccggttgagattttccttaccaatgaaaatgcagaaccgcagtatgagacgattccaagtgaagaagtaacggaggaagatacggttattgaagagatcgtggaagagccgaaagagggaaaagagggtgaagaggaagaaaagaaagaaccggttaagaaaacaaaaattttgaaacgtccggtttccatcagcgatacgaaacctctttggacaaagcatccaaatgaatgcacggaagaagagtataaggaattctaccgcaaagtgttccaggattacaaagagccattgttctggattcatttgaatatggactatccatttaacttaaaaggtattttgtacttcccgaaagtaaatctggaatatgaaaatgcagagggcgttatcaaattgtacaataatcaggtgtttatcgccgacaatattaaagaggtgattccggaatttttgatgcttctgaaaggggttattgattgtccggatctgccattaaacgtgtcacgtagtgcgttgcagaatgatggatttgtcgctaagatcgcagattacattacgaagaaagtggctgacaaattgaccggaatgtgcaagacggaccgtgaaaatttcgaaaaatactgggatgatatcagtccgtttatcaaatatggctgtctgaaagacgaaaagttcaagggtaagatgaaagattatatcttatttaaagatcttgacgacaaatatatgacgatgaaagaatatctggagacggtagatacgccggaagcagaagtggttgaaaagggcgaagaagacaaagattccgagccacaggaaccaccaaaaacagtcatttattatgtcacagacagaaagcagcagagccagtatatcaatctgttccgcgaggaaaataaaaatgctttcgtattgacgcacagcattgaccagccatttatctcttctttggaaatgggcgatgacaatgtcaaattccagcgtatcgatgctcaggtaacggaagattttgtagaagaaatgagcgaagaggaaatcaaagagaagaaagatgctttgacggaaatcttcaaaaaggctcttggcaaagagaacctggatgttcgtgtcgaaaagatgaaaaatgaaaagattgcttcgatgatcacgatgtccgaagaaacccgccgtatgcaggatatgatgaagatgtacgccatgaacggcatgggtgcaatgggcgattttggcggggagacacttgtcctcaatgtagcaaacccactggttcaatacgtagaaagccacaaagacggcgacaagacggatctcttctgcaagcagctgtatgatcttgccatgatcagccacaaaccgcttgagccggaagaaatgacagaattcgttatgcgaagcaatgagatcatggaattgctggcaaaggaaaagtaa

SEQ ID NO: 1749 - DNA, 1137 bp, Unknown
  Artificiall/Consensus sequence
aaaggaaaggatagagcaatgaaaaataaaaagaaagtaatactgatcagttgtatttgtgctgtcgttgtaattgcgatggccgccggagcggtggttcttatgaatcgttccggaaaagtggcagacgaacagaaagcgccggaagcaacgcaggcacctgtagtgacggcgacaccggaaccgacaaaggatccacatgaaggcatggtgcggagcaatctgaccggagaatatattacggaaaaagcggcagaaaaacggccatatgcggttattatcaacaatattgagtatgccaatgccaatcagcagggaacttcacagatcgatgtattgtatgaagctcttgcagaaggtggaattacgagaatgcttggcgtgattcaggatgtggacaagatcaagaaactgggatccgtacgaagcgccagacattattttgtcagctttgccagcgagtgggatgccatattctgccatttcggacagacaaaatatgcgatttccaagatagaagaactgggaattaacaatttaagtggtctgtcagcggtcggaccggtcgtttatgccagagattattcgtataaggcaccgcataatgtgtttaccaccggcaaaaaaatgaaaaagggagccaaaaaacttggttaccgcacaaaggtgaagtcggacaatgtggcagagcattttacgttttatgaggaagataccgatctcgattccacagacgatacaacatatattaaactgccattttccgattactcaacgtgttatctcaaatatgacgaaaagagtaagacatacaaaaaatatgaatacggcaagaaacataaagaccacaaaaataacaaacagctggctttcaaaaatgttatcgtgcagctggtaaaagagaaaaatatagataaaaacggatatcagcaccttttccttcacaagagaaaaggagaaggatattatcttaccaatggaaaacgtgtgaagatcacatggcgtaagagcgaggcagatcataagatgacatattatgatgagtccggaaatgtacttacgatcaatccgggaaaaacatacattgcggcctatccgacaagcagaaaaaaattgatttcattgaaagaaaaataa

SEQ ID NO: 1750 - DNA, 1941 bp, Unknown
  Artificiall/Consensus sequence
atgaaaaaatcattttttgcaactattttcttatggggactgcttttgctctcctgcctctttttgccggaggcggcttatgcggaggacagcaattccattgagcggattgatatggatgtttcgatcgatgcaaacggaaccgctcatatcaaagaagtctggcaggcttctgtctaccagggaacggaaggctaccggccatatggaaatctgggtgcctgcgagatcaccgatttttctgtcagtgatgacttgggaaaccattatgaactgcaggatcactgggatacgaatggcttttttgtagacaaacgggaaaaatgtggcattgttaacaacggcgatacacttgagctttgctggggaatcaccaaatacggaaaccggacttacacgcttacatacaatattaccaacattatcaatcaatacgaagatgcgcagggactttattttagttttatcccggaacagatgaagcaaaatccggacaacgtttccgtgtatattcactcaaatatgctgaaactaaatgaaaataacgcaaaaatctgggcatttggttatccgaacggcacgattacttttgaaaacggcggtgtgcgcatggattcacaaggcactctcccttcgtcacattatatgacagctttaatccaatttccggaccgcactttttctacagcagtagagcaaggtgagtcttttgatgctatctgcgaacaggcgaaaaaagatgccataactcctgccacgatccggttttatgattatctgatcttcgccatccctttcgtacttttgattggagcttttctgatctggtttatttggggacacgatgacaagccggtcgatatcacagaattttatcctccggatgaccacaacagtgccgaaattgctcttctctataaaggcaaggtcacaaacgaggaccttacttccatgattgtgtatcttgcttccaaaggatatctttccatcgaagccaaaacggaagaaacacttggaggattgataaaatcgagcgattttatcttgaaaaaggaaaaagattatgatggtgtcaactccattgaacaacgtttttttgatggtttatttgccggacgaacgattgtgtcaaaaagtatgctgaccaataaattttaccgcgttttaggagacatcgcagatgatatgaacagtaaagataaccagaagattatttttgaatcttcttctttgtcaaaaagacttcctatcactttgatgatcgttctgtctctgctttgcggtctggtgcgttccctttatgccgcagaaggcgatctgtcaattgccttctttttaagtttgtttcctctgacagcccttcttgtgttgacacaacttccttcgaaaccgggcatcagcaacaaaatatttttaatcgtatggagtatccttttcgggctcagttccgtcatcacatcgttagtaaaattagcttacaccgcaccgttttttctgcagatgcttatcttttccattatctgctcctttggcatggcaattttccgctatcttgtgccaaagcgtaccccatatgggacggaaatgttaggccgcattcgtggctttaaacattttttggaagttgccgataaagaccggcttgaaatgctggtaaccgaaaatccatcctatttttatgatattcttccttacacttatatattgggagtttcagacaaatggattgataaatttgaagatatcgctatcgaaccggctcactggtatcatggaagcaacctttacaccacacgtgcctttgcttcttcacttactacaacgatgtcctctgcccgcatggtcatgacgtcgtctccttccaaagggcgcggtggacgaagtttttccggcggtggcgggggtgccggaggacattcttccggtggcggcttccgataa

SEQ ID NO: 1751 - DNA, 1932 bp, Unknown
  Artificiall/Consensus sequence
atggataacccaaatcaggtacaaagtgaatatggtgctgaccagatacagattttggaaggacttgaagcagttcggaaaagacctggtatgtatatcggaagcacatcagagagaggtcttcatcaccttgtgtatgaaatcgtagacaatgccattgatgaggctttggctggatattgtgatgtcattgatgtacatattaatgccgataattcgattaccgtattggataatggacgaggaattccggtaggaatcaatcataaagcaggaaaaccggcagtagaagtcgtatttactgtacttcatgccggcggaaaattcggcggtggcggatacaaagtatccggtggtctgcacggtgtaggtgcttctgtcgtaaatgcgttgtctgactggcttgaagtagagatttatcagggcgggttcagctacaaacagcgttacgagcgcggaaaagccatgtatgatttgaagaagaccggaacgacggatatgcgcggaacaaaagtaacctttttgccggatgagacaatctttaaagaaacgactgtatttgattataatacgttaaagagccgtcttcgtgaaatggcatttttgaccaaaggaatcaagatcgtattacacgatgaccgcgaggaagaaccggttgtcgaagcattttactatgagggcggtattaaagaatacgtagaatacctcaaccgcggaaaagaaccgttgtatgaagatattatttattgtgaaggacaaaaaggcgatgtgtatgtcgaagtggcgttccagcacaacgattcttacaatgacagctgttttagtttcgtaaataatattacgactccggaaggtggtacgcatcttgccggtttcaaaaatgcgatgacgaaaacatttaatgaatatgcaagaaaccaaaaattgttaaaagacaacgatgctaacctgagtggtgatgacattcgtgaaggattgacagcgattatcagtatcaagattccggaacctcagtttgaaggccagacaaaacaaaaattgggaaacagcgaggcaagaggagccgtggatagtgtcgtaagcgaacagcttaccattttccttgaattaaatccttctgtcgctaagatcatcgtagaaaaagcacttttagcgcagcgtgcgagagaggcagcgagaaatgccagagatctgacaagacgtaaaaccgctcttgacagtacttctcttccgggaaaactggcagactgcagcgacaagaatccggaaaactgcgaaatttacatcgtagagggggattccgcgggtggcagcgcaaaaacggcccgtgaccgtgctacgcaggcaattcttccacttcgtggtaagattttgaatgtagaaaaagctcgtttggataaaatattggtaaatgccgagattaaagcgatgatcacagcatttggatgcggaatcggagatgattttgatatcagtaaactccgttaccacaaaattgttattatgaccgatgccgatgtcgacggtgcgcatattgatacactgatgcttacatttttgtatcgttttatgccggaacttatccgtcagggatatgtatatcttgcgcagccgccattgtacaaggttgaaaaaaataaaaaatcctattatgtatattccgatgaagaacttaatgcaaaattggaagaaatcggaagagacggaagcgtcaatatccagcgttacaaaggtcttggagagatggatgccgagcagttatgggatacgaccatggatccggcaaaacgtattttgttgaaagtaaatatggacgaagaggaatcttctgaaatagatatgacatttacgacattgatgggcgacaaagtagagccaagacgtgagtttatagaggcaaatgcaagatttgtcgataatctcgatatttag

SEQ ID NO: 1752 - DNA, 1485 bp, Unknown
  Artificiall/Consensus sequence
agtggttgctgtgcttcattaagaggaatggagagtgatgaaatgaactggctgcaggatttatttatccgcttattatctccgtggattccgattgttcggaaaatccagccgaaagtgagataccgggttttaacagcttgttttatggcggatcttgtgcttttttgcattgtccgttatgtgttaatgaaagagagttatttttataataccgtttgtggtatcttcctgatgttagtgatcgcgatcttttcattggataagaaactggagcggagaaagtggcataaggggcttagtgtcgcatggtttggaatgtgtatcatgtttacgatctccgactttttcgtcagcaagaaagcctgcggacttgggatcatactggcccttgtactgccgggagtgttttttgtgtggcagaataacagccggaaagatctgttgtggaagagtttaaaagatgccgtaaaaatatcgttccttttgatggcagttatttcctttttgttccgcccgttttttgaagggggaagatatgcgggaatatttacgaatccaaatacgtttggactttatttgtatgtcatttttgccatctatatgtccgaccttgattggaatgtagagacgggaaagaaattccgaaaagcatggccgacctatatccagctggcgctggtattattttacatttctgtttcgcaggcacgtaccgcaatgctggcagtttgtggaatcctgattttatgggtgatacttcggatctgtctgggaaaaacaaatcataagtggaaagagacggtaaagggatttcttcttttggcattgataacggtagtatgttatccggtattttttgccggtgtgcgccatattccgaatttaataggacatccgatcttgtttgaggaagacgtattatatttgtccaatggagaaaaaatagaaggaatcggagataaagtgctggcagagtccgatgcgattgaaagtgtgcagattccggaaccaaagaaaaagaaggagtttaaagaaaacagtatccttgggcgtctgattgcaagtctggatggaaattccacgttgaataaaatttctaatggacgaattacgatctataaggcgtatttaaagaaattaaactggaagggacaccgtcgtattacgttgacagtaaatgggaaaaaagtggcacatgcgcacaataactggcttcaatttgcgtatacgtatggtgtgccggcgatgttcttttacttgattattacgatattgagtgtgatccggtcgattcagttttattggacgaaccggagaagaaatgcgacgtatgcgtttttaatccctgcaatatgtgtgggatttgtaattgcaacgatgacagaatgtctgtttttaccatttgaggtatttccggcatttatgtattggtttgcttttggggacctttttgataattcactggcagaagctgcagaataa

SEQ ID NO: 1753 - DNA, 2340 bp, Unknown
  Artificiall/Consensus sequence
atgagaaaactttgctgcgcttattgcgcgatagggaaagaacaggaggaaaaaatgaatcaaaaaaacaataggaagtggatggcaggagcgcttttgctgacggcgggtctgtgctttgtgccggggaaaacggtttcggccagaatggaagtaaattcgtacggagagttgacggtgtgcacagattcgccggtagtaacgatccgcggaaatatttcttccatcggaaatgatgcgtttggaaatcagaaaatcacacgtttttcgacgcagggaaatgcgtattatacgacgatcaacggagcactttgcagtaaagacgggacaatcctggtaaaatgtccgaatcagaagagcggttcctttacggtgccttcgtcggtaaagaaaatatacgccaatgccttttatggatgtaaaaaattgacgtcagttacaatcccgagttctgtggagtatatcggaagcaatgcgtttgcggattgtacaaatcttcagaccgttcgaatggaggcaagagtggatacgttacgcgaagggatcttcgatggatgcgtggcattgaactcgatccgcattccgggaacggtgaaacagattgaccgcgatgccttccggcgttgtaaatcgcttacgaaaataacgattccggagaccgtcgagagtctgggatatcgcgcattttatgcctgcgaacgtcttgaaagtgtgagcttgtcgtccaaaatggatgccatcccgtatcaggcattttacaaatgtttcaaattgaaaaaagtagacgggatgagcaaaatccggtcgattgacagttctgcattttatggatgtgaacggttggaagatatcatgcttccggcgagcttggagaggatatcccgttacgcattttcgggctgccgccggctgggaaaagttgtcattcctaaaaatacagaaaaaatcgaacattatgcgtttgaagaagcggcctcttcgtttgaggtaaaggccggaaatccgtcttataccgcacgcgggggattgcttttggacgagacagaaacgagtttgatccaggcaccggtgaaggggaaaggtgtcgttcatattccggataccgtgaaaaagatctgctatggtgctctgaccggaacggaatatcgcgcaattttcctgccggcatcggtgacgacagttgaccgcggctggtttgaaggatgtaaatatctggagacgattgttctgccggaacagacggaggcaatcgtgggaggaagttattaccgcgagcaattaaagcgtcttaaacaaatacggatcagcgataaaaataagaatttccgctgccagcagggtgtcatttatacgaaagacggaagagaaatggtctttttcccatccggaaaacgcggaagtctgaagctgccaagcacctgtaagtatatccggggccgccttgattacaatcgtttgagaaagattacggtttctgattcaaataagtattttaaggaaatcgacggcgtcctttacaatgtagccggtacgagtgtgcgtgcgtttccacttgctaagacaagttataagattccgacaaaatgcaaaagcatcggctttttaaagagtcagaaggcagatctcagatgccggaaaataactgtgtcttcgaaaaataaaaaatattatgcaaaaaatggcgtgttatttgaccggaataccgatgaacttttgtattacccaccggcgaaaaaaggcgcttacacggtgccgaaaaacacgacaaagattgcgggagatgcctttaaacaggcaaaatacctgaccaaacttacaatcacgaaaaatgtgcagcgaggttacggtacaaaataccgttttgccggctgcgaccgattgaaaaccgtggaagtaaaagccggaaaattgaattacatccgcatgaattttgatgaatgcagcagtattcgcaaactggtatttccttccaatattatgatgacggatcttcgctggctcccggccggagtaacgatttacggatgggaaaatacaggcgcaagagacactgccaaagcatatgacgggaaatttgtcagccgcggaaccatcccggcggttgttgccggaccacgagtgcgcaagatcgtagaacgttatgtgctttcctggaaacgatccacggatgcgagcggttaccagatttataccggcgatgaaacattgaaaaacatcaaaggcacatcaacaaccaaatgttatgtcaaaaatgtagatgactacggcgaaatctatattcgtgcatatcgcctcgtacatgggaaaaaagtgtatggaaaagcgcggaggttgaactga

SEQ ID NO: 1754 - DNA, 2808 bp, Unknown
  Artificiall/Consensus sequence
gtgagtgagaaatccatggtgatcaatccaaacaagatttccattgactttaaagacaccccttatgcaaaggaaagcggggcgtcggtacagattgccagggacggcagcatttccaattatggaattgagtatacaaaggattgtgcggtacaaaaggaaatggactccaatatgatatataccggcacaactcaaaatgagatcgtgagtgatgtggcgaagaatcttccgaaaaataattttgatccggcagactttatcagccagagtatcaatggcgaggatgccaaagatatcgaggatgaagggacaattttggaagagtacgtcgactcgacattggagcgggcgatagaaaaggtaaagacggagcgtaaaaccaatgcggaggcgctgggtaagcaggtagaaaaggaaaaagaaaagcaggaattttccgatgaactgcaagcccagattgaacttgcggcgcagatggcggcaagggatccggaacttagtgacgaagcgataaaatattacatagagcaggaagcggatctgacaccggcagcagtcggaaatagtgccagtgtgacttccatgccggcggtggcggagcagagggcttcttacgaagaaatgaagccgcagatcgaccatatattggaagaaaatgggatgcagggaaatgacagcgccgaagaagcagcgaaatttctgtatgaagaagatattccggtaacggcggaaaatatagaaaaatataccaaatggcaggagacaaaagatctgccggaggagatcattcaagagcgtattcaggatgctgtgcgggaaggaaccgttccacagcaggcagatatcagcaaaatctcgtatgaggaagccgctgagaaatgggagaatctgaaaaatgtaacagacgaagaaattcgggcattttatccggaagaggctgcctttatcacggcaaaacgtcagctggaagaaatccggttgaaaatgacagcggaagcagctggaacgatggaacgcaagggcattcatgttgatatctcaaatcttgcgcaggtagtggaagaactgaagcagatggagcaggaagcctgtcagaaaatatttgatgagcagggaattgcgtgtggccaggatcaacttgaccaaatggcagagacattgcgggcaaaggaccagatttggcaggcaccggcgagtgtactgggaaaaacaatcgggcaggcagagcagaccactttacaagaaatgtcagaaatttccaatgcggaagcaaatgagcagctggcaaaaaattatgaggctgtgggaacgcaggtgcggagagatctgggagattcgatgacaaaggcatttcaaaatgtcgacgtgatattggatgatctgggacttgaccggacatcggcaaatcagcgggcggttcggatccttgcgtacaatcagatggagattacaaaagagtccgtgctttcgatgaaagattacgatgccaaagtaacttccgtgctggagcagatgaaaccggcagctgtggcgaaaatgattgaaaagcaggaaaatccattggaaatgacaatggatgagatcgaggcggcacttcaggaaattcaggaagaaatgccggatgacgacacgacattgcggaaatatttgtggaaacttgatcataaaggtgacattacgccggaagagcgaaaaagtatgatcggtatttaccgattgatcgataaagtggaaaaaagtgatggagccgtcattggacaattggtaaaagaaggaagagaattgacattttcctcgcttttgtcggcagttcgcaccagacgggcagaaggaaaagaatttgcaattgatgatggtttcggaagtctggaaagtcagcaaagccgtggcgagacaatcagcgaacagattggtgcggcatttggaaatcaagtgatacgccggttgaaaaaagaattgtcgccggaggcactgcgtcaggcaggtgaagatgcgacatgtgagcagattctcgaagcttgcgaaacatcgaaaagtcaggcagaagatgcagcatattatgaggcattggcacaaaatatccgcgagacggcagcattgagcgacgacagcatacaagcgtgtctggaggcggcagggattcctgctacgttgcagaacatccgcgagatgaagcggtatctggcaagagaaatgccggaaaacgatgccttgtttacccgggaagaaagtgaagcagtcattgaggcactcgatcagccggaagaattggaagggctgctagatacactggacaatgaacatttggcaaaggtcgagagtcagaaacaggcagaagacattacctatgatacgctgcagaatttgatacagatggcgggaagcatttctttttaccatcagatgcggcagcagacaaatacattttccgtgccgattgtgacagaaaagggagttacatcttgtaatgtaacggttttgcagggcagcgaagcggaaaaaggaacggttgagatctcactgcattcggatactttcggaaaaatgcaggcgacatttaaagtgaccggcgaccgggtcagtggatttgtgacttgtgaagacggacaggatgtcagtgaactcacgcagaatattgaaaaggatttggaaatgaatggatttgcgatggagcgcatggatgtggcaaagggcgccagacattcatttcatgtaggagataaagaaaaaacagcaaatagcagactgtatcaggtggcaaaaattgtagttaccaatgtgcagagaaaggaagtaactttatga

SEQ ID NO: 1755 - DNA, 1329 bp, Unknown
  Artificiall/Consensus sequence
gtgaaatatcagagaaaaagcaaccagggttttgaccggttcttaattcatgaatggctggaatcgtgtgaggaaatatcagccacggaagaatgcggaaaagagatcagaaagcaggcgtatcaggcatttcgcaaggcggcaaagggagaaaaaccggcagatttacatacgatgcggcggtggtttggactggatggaatttccagtccgaatcgcgaaatggtttttcatattgctatctctttaaaactcagtgtagaaaaaacacaggaatatcttcggaaaggattgcttcttccgggaatccaggtaaatgatcatcgggaatttgtttatctttatgcgattgaacaccagcttgactggcagatgtgtcaggagatgattgtattttatgaaaaacatcttccggaggctatcagtttgttggatgaaaaatgcacgcaaaaattgtgggggttctacgatgcgattcatcatctggaaccaaaagaatttttatatgagatgggaaaaagagcggcttattttaaggggtacagtaaaaatgttttggagcattatctgcatattcaggcggaactaaaaactttgatgagagaagaggcctccgaggatttggaatttttactgcagtcgcagtcatttacactatggtgtaaaaacaatcatattgcaccggaacagcgcagagaggaagaggtgcttttacattaccttcataatgaaagccggcatgctaagtctcttatttcccgggaagaggctgaagattttcggcaactggtaagaaaggcatatggaaagggagtgtaccaatccgacattctgacagaaatttttgcggcggcgatgccaagtgaagcagagagaaagggaaggtaccagaaagatcgtgtggaacatatgggaatccgattgatctcggataaatatctttcagaccttcttcatatcgcccggcagaaggaacgggaaatcaatctcattcagcagttttaccggagcccgcaggaagaacaaacgaaattgaaggtgaaattgcgccatcagaaacagcgctgtcatattattgagcgggaagatctgcttcccctgctgcactatctggcacagaaaaaatataccatgaaaattgacgaagaagaggccgggtatcagaaagaggaagccgtaacctattttgtaaatatgaccaatacggtactggaagcctgccagatggagccgcttgaccggcactaccggctggattccattttattatccagttttcaggaagaggaaatgctttctatatcggatatgattgagggaaagccataa

SEQ ID NO: 1756 - DNA, 2421 bp, Unknown
  Artificiall/Consensus sequence
atgaatttcagccgaagaaatacggttgagcgggcaagaaaattaaaatcacctgccactcaccgtttgaataaatgtaaagtcatggcagcaagagtcgtcctcatctcgctggtcgttatcgccgctgtcgcactcagtggcgtgtccggcatcgtaaacggactgatggaaaccgctccaagcattgacaccatcaatgtcatcccggacggttatgcgaccactatattaaacagtaagggaaagaccattcagacgctcgtaggaaaagaggcaaaccgtcaatatgcgacgctcgataccattccaaagcacctgcaaaatgctttcgttgctatcgaagacgaacgtttctgggttcacgacggaatcgatctgcagggaattttccgtgcgacattcagcggactgtccaatggcggagaatttcatcagggtgccagtacgctcacacagcagctcttgaaaaatcaggttttcaacgggggcgaagaaacgactttcgctcaaaaactggaacgaaaagtgcaggaacagtacctcgccatccaactcgaaaaccgtctgacgaaagagcagatcctcgagtattatctgaacacgatcaatctcggacagaatacactcggcgttcaggcagctgccaaacgctattttgacaaagatgtatcggaacttaccatctcggaatccgccgtgctcgctggaattacgcagaaccccgccggctacaatccgattacacatccaaaacgaaatgccaaaaaacggacaaccattctttcttatatgaaagatcagggatatatcacttccgatgaatatgacaaagccatgaaagacaaagtatatgcccgcatcaaagccgtaaacaaagaaactaccgccacgcagacgacgacttcttattttacggacgctttgatcgatcaggtcatttcagatatgaaaaatgaacttggttacacagagactcaggcctacaacgctctttaccgcggcggactcacaatttataccacgcaggatgcttcgatccagaaagtctgcgacaatgtgatcaacaatccttcgtattatccggcaggatccacgtatcagctcagttaccagcttaccgtaaccgatgccgaaggggttgcccacaattacaatgccggaacgatgaaaaactggtttgccaagaagaaaaagaaaaaaatccctctttattatacggataaaaagaaagccaatcagtatattaaagtatacaaaaaagcaatgtcaaaaggcaccggatgccaagtggaaggcgaaaagattgattttgtcatccagccacaggtttcctttgttgtgatggatcagacgacaggacaggtcaaggccatctgcggcggccgtggagaaaagacagccagccgtactctgaaccgcgccagcacgtcgcttcgtcagccgggttccacgtacaagatcctttccacgtatctgcctgctctcgacacttccggcatgacactggttacccagcaaaaagacgagccatattattatccgggcacgaagcgtcttatcagaaactggtatcgcggataccgcggcaccgtaacgatccgcaaagcgatcgccgattccatgaatgtgatcgccgtcaaaacattggagcaggtaaccccgaaagttgcctatgactatttgttaaatcttggatttacttctcttgtagaaagttatacggatgcaagcggtaagatttacagtgacatttccctgccaatggcactcggcggtctgacaaaaggagtttcaaacctcgaactgaccaccgctttcgcgagcgttgccaatggcggtgtctacaataaagcgacattttacacaaagatcgttgaccatgacggcaatgttctgctcgacaaaacaccggttgtcacaaagacgcaaaataaaaaaggcgaggacgtaacggtcgtcacaacgtcttcgagcaaacaggttatgaaagattcgacggcatatttgctcacgagcgcaatgcaggatgtcgtaaattccggtaccggaaccgccgtaaaactgcgtggtatcaatgtaccggttgccggaaagaccggaacttccaccggaaataaagacttgtggtttgtcggctatacgccatatcttactgccggaatctggggcgggtatgacgccagcgaaaagcagagcaatacgacctaccacaaagcgatctggaaagcgattatggaaaaattaagcaaaaagcataaagatgagaaagcgaaattcacgatgccgtcttccgtcgtttctgtgcggatatgcaccgtatgcggaaaaccattggctgaaaaccactacagttcccaaagcaaaaaggaatatttcgccaagggaactgtaccggaagaaacgtgttcaattcattga

SEQ ID NO: 1757 - DNA, 2181 bp, Unknown
  Artificiall/Consensus sequence
atgaatacaccaaaagcaacaccatttcggaaaatacttttttctttcctgactttacttttattcggaatctttttctttcctgccaccagccaggcggcgactcttaaagtgaagttaaatggcaaaaccacctattatagaaagacacagtctatcgtaagatatcagaacaagaccattacaaaaagttctcgtaaggggcttaccattaaaggcacacgcatggtatcttacaaagatgtttttaaaaagggcttgaaggtaaaaacatcatatagatcctctaaaaaaagacttactttttcacgcaatggaattaaagtaacccttactgtcggcagtaaaaatgcttatgtaaacgggaaaaaatatcgcttaagtgttgcgccgacaaaggtaacttatgttcgtaaacgaacctctacaatattagtacctgcaaaatttttatgtaaacatctcggctttcaatatagggcaaagggttctattctgacaatgacaaaacaatttatgtactcttatcaggaaaaagatgcaaaaactgctgtttattctaattcctttacatttaacgacaaatctaacaaattgacttccatgccggcactaaaaatatccggttcaatgtatttacctgcggaagaaacattaagtaatgttatcggtttaaattacaattataatgcggatacccagacactcaatatagaaaatacggttacgaataaaaaggtaaaattggttttaaatgaaacaacaatgaccgtaaacggggcaccggtttctctttccacaccgatgtatcttgtcacaagaaaagataagaacagtgaagttttatgtattcctgctaaaaaagttctgacggcacttggatattcctacaaatgggataagaagaagacattgatctctgttcatgatctgatttattttaactggacaacagataccaaaaaagcaaccgatgcatctgtcaattatattactgctgcaaaagcaacttataacccagcgatccaatgtatttcttttgaaatcaaaggtacgaaaacagacattatggatcaggttgccgttgctagaagtggaaaagtaattaccgttactatcccaaaaacttccaaatatctacttgaacagttttcctttgcaaagtttgtatctgaaattgaaaaatttgaagtcgtagaagatggaagtgatacgattactatgcggatttcctgttttggagaatctgattttgcttattcttctctggatggaacacttacgatcaatatcatgggagagtatgtaggaaattatgccttaaaattcaaaaagcctgcaggagtaacgattaactcagtaaaaaatgaagatttgtaccaaagcaataaattcaagattatagttcccggaaatcaggtcgacttttataatcaaaatccaattgcgatcagcagcaatgtagttaccggaatttctactgcttgggtaaacggtaatacagaaatcaccgtcaatacctcaaaacttcaggggtataaaatatatgaaaaatctgactcctttgtagttgcgattggcgatcctcgtacgatttataaaaatatcgtcgtattagatgcaggacacggtggatatgattccggtgcaactcataatggaaccaaagaaaaagaccttaactttaagatcatttacaccttaatgaaaaattatttttcctccaatgcccctgaaaccaaagtttactggagtcgaagttccgatgtatttgttactttgtctaaacgagctgcttttgcaagtaaagtgggcgcagatatttttgtcagcctgcatatgaattcagcctctagttccagtgctaacggaacagaagtatattatactgcaacgaataacgcaagcagtttttcaggcgtaaacagtaaaatcattgctactttatttaaaaacaacctggtaacaagacttggcactacaaaccgaggagtaaaaacagcaaaatattatgtcacaaatcataatactgtacccgccgttttgatcgaacttggatttatttccggaagccgcgattatgcaaagttaacaaatccgtcattccaaagtaattccgctaaggttatatatgatacaatcaatgaaatatttacaacctatccaacagggcgtaaataa

SEQ ID NO: 1758 - DNA, 2763 bp, Unknown
  Artificiall/Consensus sequence
atggcaaaaatgaggatattcgaaattgcaagaagtattcaggcaaaaaataaagaaataaaaagtggcgatctggtaagacttttaaatgaaaatgggtttgatgtcaaaggggcaaacagcaatattgaagataaagaaattgcttttttgttacagacattcaatgatccgaaaaaagtggaaaagatattagcatcgcataatacggaagaggtcaaagaggaaaagaaatccgagaagaaagaacctgtaaaagaacaaaaaacggcagaaccggtaaaagagaaaacagaagaaaaaaaattggaagaaaagcaggcagaagagcttgtaaagaaaccggttccggaagaaaaaaagaaagagaaaaaagaggagaacaaaaagaaagtgcctgaaagagaacaaaagaaagaaatgccagaaaagaagaacggaaataatcaatccaattccaattctaatgaccgtcgccgcgataataaccgtgacaacaataaccgtggtggaaatgatcacagaaataaccgtaataataataaccgtgataacaatcgcgggggaaacaatgaccgcaatgcaaataaccgcggcgaccgacgaccaaataacaataaccgcaatgaccgaaacaatgaccgcaatgcaaataaccgcggtgaccgcaacaatgaccgtaatgcaaataaccgcggtgaccgacgtccgaataataatgattatcgtggtggaaataataatcgtggtaataacaacggacgcggtggaaataataatcgtaacggagaaaaggttctggagcgctttgaaaaggcccagagtggatttgatggaatcaaacaggaacagaaaaattccagaaaacgtaataaaaagcctgcggataagggcacatataagaaatcaacaaaagaagaaatgagccgtattcggagcaaaaaggatccaaaccgtaaaggtgcgtttattaagccggaacctgttgttaaagagccggaagagacaattaagcagattacgattccggaaagtttgacaattcgtgaattggcagataagatgaagatgccggcggcagctcttgtaaagaaactgtttctgcaagggcaagtcgtatccttgaatcaggatattacgtttgaagaggcagaagaaattgccctcgaatttgatattattgctgaaaaagaagagaaagttgatatggtggctgaacttctgaaagaggacgaagaagatgaggcagatcttgtaaaacgtccaccggttgtctgcgtaatgggacacgtagaccacggtaaaacatctcttctggatgccatccgcgaagcaaatgttacttcccacgaggcaggcggtatcacacagcacatcggtgcttatgttgttgagatcaatggagaaaagatcacattcctggatacaccgggacatgaggcatttacttccatgcgtatgcgtggagcccagtctaccgatattgccatccttgtagtagctgcagacgatggtgttatgccacagactgtcgaagccatcaatcatgcgaaagcagccggcgtagagattattgttgccatcaataagattgacaaagagggcgccaatgtggaacgtgtaaaacaggaattggcagaatatgaactgattccggaagactggggcggaagcacagtgtttgtaccggtttctgcacatacgaaagaaggtatcgaacagcttcttgagatgatcgtgcttacttcagaagtgctggagttaaaagcaaatccaaaccgtaaagcacgtggtatcgtgatcgaggctcgtttggataaaggacgcggaccggttgctaccgtattggtacagaaaggtacacttcacatcggtgatcatgtggcagtcggacctgctcacggaaaagttcgtgcgatgatcgatcataagggagagcgtgtgaaagtggcaacgccttctactcctgtagaaattctggggttgaatggtgcaccggatgccggagaaatctttgttgctaccgagagtgataaagaagcaaaacagatctcacaggcatacattgatcagagtaaggataaacttttggaagagacaaaatccaagaaactatctctcgatggtctgtttaaccagattcaggcaggtaatgtcaaagacctgaatcttattatcaaagcagacgttcagggatctgtggaagccgtaaaacagagtttgttaaaacttggaaatgaagaagtcgcagtccgcgtgatccacggtggtgttggtgccatcacagagtcggatgtatcgttagcaagtgcatccaatgcgatcatcatcggatttaatatccgtccggacaatactgcgaaagaagtggcagagcgcgaaaatgtcgatgtacgtttgtaccgtgtcatttacgatgcgattgaagatatcgaaaatgcgttgaaaggtatgcttgagccgatctatgaagagaaagttatcggtcacgtggaagtacgccagacattcaaggcttccggagttggtacgatcgccggttcttatgtactcgatggtaaagtacagcgtggatgccgctgccgtgtataccgtggtgacgatatgatctttgaaggtgatcttgcgtctttgaaacgattcaaagacgatgtcaaagaggtagcagccggatacgaatgtggacttgtatttagcaacttcaatgatattcagatggaagaccgtgtagaatgttatatcatggtagaagttccaagatag

SEQ ID NO: 1759 - DNA, 1338 bp, Unknown
  Artificiall/Consensus sequence
atgaaaaaatggatttctaatgtttttttactcggtatgctgtttgtttttgccacgatcattccggaacgacagacaaacgcagcagaagagtatacgtattatcttaccattaaccaagtgtaccaatatgaaattacgaaagagcaatttgagagcattcgtggaagctgggattcgctgacagcagaaggtgtgttagagattgccagacagatcgtgccgccggagcagatcccttcccgggttacgaatatcggtattcgcgcagtaccaaaaaatagtgcggagggaacacttccggtttacccgtttgattcggaagaagattctgcagcggataatgattttgttatttcgcagggcattctgctgcggtataagggaagtgaggaagtggtgaccatcccggaaaatgttacatcgatttatcagggcgcctttatgcagaatacggcagtaaaaaaagtgataattccaaaaaaggtaaaaaatatcgcaaaagcttctttttatcaatgcccgaatttgaagattatcgtttgcgcaggaaaggcgggttctgtcggttcctatatgatgtatcaatgcaatgcccttgtaaatatggtggcaccgaaagggtctaaggaatatgcctatgcaaaagaacatgaaattccggttacagtcagtgaaaaaacagcattagaggcaaagaaacttcatctcctgaaaggggataaacatacggtaaaattgtataatgccctgggaaatgttcgctggagttcttctgcaccttccatcgtatcggtagatgccaaggggaaactgcaggcaaaaggagtgggcaaagcgaagattacagcgcggtttggaaaaaagaaatatactcttacggtgcaggttcagacaaagtccgaagataaaagagtagatcaagtaataaaaaccatgatcaaaaagggaatgtctacgcgtgataaagtaaaagccgtgcataactggctgatccgcaatgtcaaatacgattatgacaattatctgcgggggacggttccgaaggtgtcgcatacttcgaaaggggcacttgtgcgcggactggcagtgtgtgatggatattccaaggcctttatgaaaatcatgagaaaattaaagatcccttgcaggatgctcgccggggtatcggaaggcggcggacatgcatggaatcttgtaaaagtaggcggaaaatggcttcatgttgacgtgacttttgacgatcctatcgtaaatggcaaaaatacaaacacgagaccacgatatacgtatttcctaaagacggatgcccagatgcgcaaagaccatgcctggtga

SEQ ID NO: 1760 - DNA, 1629 bp, Unknown
  Artificiall/Consensus sequence
atgatggatcaattgattgccataaaagataaattgctggctttttggaataaatacacgacaaagcagaagacgatcattatctgtgttgtgttagcggtgttttttgcgatcgtgatattgtcctatgtgttgacgaggccggtatatacgcatctggcttctttttccgatgccagtctggcaagtacattatcagattccctcgacagtgaagggattacatacaaaatggagacagacccgagtacagggattacttcgtttgatgtagaacagagcaaatattccgatgccgtactggcgatgggagccaatggtatcgtggataaagagatgagctgggatgatgctttaaaaagtgatatgacgacatcttctctggaaaaacagaccaagatcacactggcactccagtcttcaatcaaagagaatctgcttaaatttgatggtgtggaagatgctacggttatcattaaccgccaggaagatgataagaagtttatttcagcaacaaaagaaacagcggttagtgtgtctctgaaattggcagatggaaaagagttaccgacggagacagcgacggcgatggcttattatcttactaacgcagtaggaaatacgacgacagacaacattgttatcgtggatacgaaggggaatcttttgtatggtgcgaaaacagataatacgcttggtggtacgatttcgggaaccgaagattataaggcaaaattgcagcagacattttccgaacgtacggaaaaaatgcttttgaaagccggctatgacgatgccgactgcagcaagacaaatattaaatttaacatggacaaagtgacggaactggttacgacgtattcagtggcagacggtcaggaccagggatactattccagttcgtatgagtactcttctacaggggcttccggaagcggtggtacaccgggaacggattcaaacagcgaagagacagattatatgatccaaagcaatggaggttctaattcggaaacgattttgaataaatacaattacctgccaaatgaagatgttaaaaatatcgaacatgaggtaggggctgttgtgccggaagaatcttccatgggtgttgttttgacaaagtacaaaaagatatcggaagagtcactgcaggaaagcggagctcttgataatatttcatttgaagagtacgcagaacagaatagtgatccgacgacgcttgaagtgccggaggaaattacccaacttgtttcggcggcgaccggtatcgcgcagaataacataacgatcattgcacaggaacagccggtttatgaagcagcagaaaagactggatttacaggaagtcttaccaactacctgatgatcattcttgccgtattgatcggtgcccttcttatctttgttatcatccgcggtacttcaccggtgaaagtaacagagacagagccggaactttcggtagaagatctgcttgcaacgacaaaagaaaatgaggaaaatctggaagagattgaacttagtgataaatccgaaacacgaaagatgatagagaaattcgtggatgagaatccggaagcggttgcgatgctactgcgaaactggatcaatgaggactggggataa

SEQ ID NO: 1761 - DNA, 1911 bp, Unknown
  Artificiall/Consensus sequence
atgaaaaagatattagaagaaacatatgatgctgtcgttgtcggtgcaggccatgccggctgtgaagcagctcttgctctggcgagacttggattttccacggcactttttaccgtcagtgttgacagcatcgcattgatgccatgtaatcctaatgttggtggatcgtcaaaagggcatcttgtcagagaagtggatgcactcggtggcgagatgggaaaaaatattgatgcaacatttattcagagcaaaatgttaaataaatccaaaggaccggctgtacattcgcttcgtgcgcaggcagacaaaaaagaatacagtaaaagaatgcgtcgtgtactggaagaaacagaaaacatttctattaagcaggctgaagtgacagaattgttggtagaaaataatatattagtaggtgtaaaaacttatacaggcgccattattcattgtaaagtatgtgtattatgtaccggaacctatcttaaggcaaagtgtattacaggagagatttctacctatacaggaccaaatggtctgtctgccgcaaatcatctttctgattctttaacggaacttggtattaaaatccgtcgtttcaaaacgggtacccctgcacgaattgatggaaatacggttgatttttctaagatggaaccacagtatggggatgaaaaacttgtaccattttcttttaccaatgatcctgcagacatcgagagagagcaggtaaaatgttaccttacttataccaatgaaaaaacacatgaaattatccgtgataatttagaccggtcacctctctattctggaatgataaaaagtacgggaccaagatattgcccttcgattgaagacaaagttgtccggtttgctgataaaaatagacatcaggtttttattgaaccggaagggttgtatacttcagaagtgtatattggtggaatgtcaagttcaatgccggaagatgtacagtatgaaatgtatcgttctgtcaaaggacttgaaaatgctagaattgttcgaaatgcttatgccatcgaatatgattgtatcgattctctggagttgaaaccatctttggagtgtaagaaagtagaaggactttttagtgccggacaggcaaatggtagttccggatatgaagaagcagcagctcagggtattatcgctggtatcaatgccgcaagaaaattacagaaaaaagatcctattatattggatcggtcacaggcatacatcggagtgttgattgatgatcttgtaacaaagggtaccaatgaaccttatcgtatgatgacatcgagagcagagtatcgtttgatccttcgccaagataatgctgatttacgattaactccaattggatatgaagtcggattaatttcaaaggaaagatatgatggtttacttctgaaagatgaactaatccaaaaagaaatgaatcgtatggagcatacttctgttggtaatacagataatgtacaagaacttttaaaacaatatggaagtacaccgttgattagtggaattactttggcagaattgattcgtcgtcctgaattagattacgataaaattgaatcaattgataaagaaagaaaaccacttccttatgatgtatgtgaacaggtaaatattaatatcaaatatgatggatatatttcacgacagatgaaacaggtaaaacaatttaaaaagatggaacaaaagaaaattccttcaaccattgattattcaaaaattaatagcttgagaattgaagcagtgcagaaactgactgaaattagaccggagtctgtaggacaagcggcaagaatatcgggtgtttctccagcagatatatcagtattacttgtttaccttgaaaattataatagaaatgtttcacgtgaaacattggaggaagagtag

SEQ ID NO: 1762 - DNA, 1674 bp, Unknown
  Artificiall/Consensus sequence
atgagtgagaaaagacaagagacatcccagggaagcgattttttaaagcagggaagtatccttgccatggcatccctgatcgtacggtttatcggtatgatctaccgaatccccatgtccaatatactgggagaagagggcaatggtatctatgctgttgcagtagatgtatatgatattgtgttgattgtttcctcttacagtattccgctggcattatcgaagattattgccgcccagagtatacaaaagcagtacaaaaataccgggaaaactttccggctgactcttttatttgccgtggtttccggtggattatttggcatccttttgtttgccggttccggatttatcgagacgcatatttatccggattacgccggagtgagatatccgcttcgtatattggcaccgacgatatttatcgtcgcccttttgggagtgttccgtggcttcttccagggaaagaaaacgatgatcccgacggcggtgtcacaggtcgtagagcagattgtcaatgctattgtgagtgtagccggtgcctattaccttatgaaatggaacgcagacagtccgtttaagagtggatggggcgctgccggtggtacactcggaacatgcatgggagcattttttgcccttcttctggtgggatttgtttattggatctatcgcccgatccagaataaactcgagaggaaagatcagaccaaacaactgtattctgcaactcatatttaccgtatgctgattatgacaattcttccggttattttaagtcagacggtatatcagatcagcggtttagtggactattatctattcggggatgtacttggaggcaaggggattgactccgttacgatcaagtcgatggttgggatgtacagttccaaatatcgtcttttgacgacactgccaatcgcgatttcgacatccatcgcatcttcgatgatcccgagtgcagtagcggcgtatacaaaacgggatgagaaacttttaaatgacaatatctcttccggaattaaatttaatatgatcattgccttcccatgtgcgattggatacatggtgatcgggcagggcttgattcgcatgctgtttccgtcgtcggattatattaccggtggtaaattgatgcttgccggttctgtcgccattatcttttatgctatctccaatgtaacaggaggagctttgcagagtatcgataaaatgcgtctgccggtcattcattcggccatttcgcttgtcattcacatcggcatcgtagtggcacttttgcatgcgacagaacttaatgtatatgttttagtgatcgggaatgtgacatttccaattattgtaagcgtgttgaatattttggcattaaaacggtatattccaacctttgaagtgaaacctcttttgacgtttggcgtgccgctttctgccagtctgtggatgggggtcgcagtagcgatcgtatatactcttatgaaccgcctgtgcctgacatttttaggtggttatatggcgaatgcactggcatcgttagtatccgtcgccgtcggcgcattggtattcttctggatgtttttatcgctgaaaggaatgtcaaagcaggaattgtttgattttccaatgggacgtaaattatatcttgttgccagaaaattacgacttatggaatag

SEQ ID NO: 1763 - DNA, 2037 bp, Unknown
  Artificiall/Consensus sequence
atgagatatgaggacagcattcgccagataaaaggcgtcggagaaaaagcagaacagcgtttccataaattggatatttggaatgtcggagatcttttggaacattatccaagagaatacgatgaatttcatgatctggttaagatcgcagacgtaaaagaaggcgagatggcagctgtagaaggcgttatggcgtgccgtccttcgattcatacgaccgcaaggatgaaaatcttatccatggtactcgaagatgaaaccggccggattacggttacgtggtttaatatgccgtttttagcaaatcggctgaaaatgggaacccgttatattctgcgagggaaagttggccgcaaaaacggaaaacttgtactcgaacagccgaaaatgtatagtaaaaatgaatttttcaagcaggttggaaggctgcatccgatctatccattgaccgcagggcttacaaatcatgcggtcgaaaaggcagtgagtgatgccatcggttcgctggaaggggctgcggaatttctgcctgctgatcttcggaaacgtcaaaatcttcttgcgtatcgtaaggcaattcatgacatccatttcccaaaaaatcaactggaatatcgaaaggccagaaaacggcttgtatttgatgagttctttctatatcaggcagccttgcaggcaatccgcatcaaaaattataagccgagttctcatgttatgacgcaagataaaaggctggaaggatttgtaaatgatttaccctatgagctgacagcggcacaaaaaagagtttacgaagaaattgaaaaagatatgaccggcggaatgacgatgaaccgtctggtgcagggggatgttggttccggaaagaccgtagttgccgtgatggcattatttcttgccgtgtgcaatggagagcagggagcctttatggtgccgacagaagtgcttgcgatgcagcataaggagtccttggaggaaatgcttgccccatatggagtaaagatcgggctcttgatcggctcgatgacagccaaagaaaagcgggaaggaaagcagaaattggcagaaggcgaatgggatgttgtcgtgggaactcatgcgatattgcaggataatgtggaatttgcggatcttgcccttgtcatcacagatgaacagcaccgttttggggtgcggcagcgcgaaaaattgatggaaaaaggagatacaccgcatgtccttgcgatgagtgcgacgccgattccacggacgcttgcccttgtattgtatggagatatggatttgtccatcatggacgaacttcctgccaaccgtctgcccatcaaaaactgtgtcgtggggaccgattaccgtccacaggcgtaccgttttatgaaagatcagattgaaaaaggacggcaggtgtatatcatctgtccgatggttgaagaaaaagaagaggttgcacttgagagtgtagtgatgtattcggaacagttgaaggagatttttcctgccggaattacgatagaatgtctgcatggaaagatgaagcccaaagaaaaaaatgaagtgatgcagcggtttatcgagggaatgacggatattctcgtgtcgacgacggttatcgaagtcgggattgatgttccgaatgcgacagtaatgatgattgaaaatgcagagcgttttggccttgcccagcttcatcagctgcgcggccgtgtcggacgtggaaaagagcagtcttactgtattttaatgtatggaaaagagagcaaagaaggaaaagaacgtttgtcaatccttgccggctctaacgatggttttgagatcgccagagaggatttgaaactacgtggacagggcgatttctttggagtgatgcaaagtggggacaagttgttttcacttgccgatatctatgaagatgcgccggtgttaaaagcggcaaacgaggaagcaaagaattatgcctttgatgagatcacgatgttttataagaaaaatcgacgtctggtggaaaaattaaattcctatatgggtaatgtttcgttataa

SEQ ID NO: 1764 - DNA, 2094 bp, Unknown
  Artificiall/Consensus sequence
atgaatgaaagacaaaaatataaatggaaacaagatttatcctggctcaaaaacaggattaaatttaaaataaaccgtatcttttttatgacgcaggacaaaatggtaatgttcgaatcctatcacggaaaacgctgtggtgacagtgttcgtgccatttatgaagaaatgctcaaagatgacacatttcgcgattatacttttgtatgggcattttccaaaccttccgaacatgaggatcttttggaaaatccgcacaccctcgttgtaaaaaaaggaagtgcagaatatttccggtattatgccgctgcgcgtttttgggtcaataatgtcagcattcctgattttctgattccgggacgccatcaggtgtacatcgaaacctggcatggcaccccgctaaaacggcttggctgcgacattacgacagacagcgacccgagacagtccaaagagcggatgcaccgcagataccggacaaaagggaaaaaggtgacacattttctgtccccttcgccttattatacagaaaagattgcttctgcgtttgatgtagatccgtcgcaggacgggctgttcatcaactccggatatccgcgcaacgacgcattgttggaaccatccgaagaaaaaacagtggaatttaaaaaatcccttggcatcccggaaggggctaaggtaatcttatatacacctacgtggcgcgacaatgagtaccagaatggacatgggttccaatacgaaagtccggtaaatctcggaaaattgatggaacttcttccggaaaattacattttattattccgcgcgcaccatcaggtaggaacttccgaagttattcaggaaacggatcgtattttcgatgtaacagacgcagacgatctgaatgacctgtacctcattagtgaccttatgatcacggactactcttctacgatgtttgattacagcgtgttaaagcgtccgatggtatttcatatgtatgatctcgagcggtatgagcatgagatccgtggattttattttgaccttgacgagcttcccggtccgatcaccaaaaccgaggaagaactggcggaagcgatccgtgacggcatagccaattttgattatgacaataataaaaaatatcaggcatttcacgataaatttaacccttgggaagatggacatgctgccagacgtgtcattgagcagtgcatccagatcccaccgcataaaaagggactttgggaaaaactggtactgaattacaaacgtaccttgaaccgcgtgcatattgtttatctgatcgtgaaatacaatattggcggatttttcaacaaacacggactctttcttgacaataacagccggcgtctgctcaaaatgaaagattcacacaggggagaacgctgctttttgattggaaatggtccaagccttagtccggatgatctgcatatgctgatcgacgaatacacgtttggaaccaatatggtgtataagatttttgaccgcacggactggcggccaagtttccactgcgtctccgacagtatttatgcgacaaaactgcgtgatgaactttacaacaacgttaaatcaccactttttaccattgaaaagacctatcggaaaatgacaaaacgaacgttggaaaccacgtatgtacacacgattgccagcgaacgatacaaagtcaagggaaatatttttgcctattgtatggtaaaggcaacggttctttccctcgccgcagaatttgcttttcatatgggattttccgaaatttacctgctcggcgtagactgtaccaatccacacgccgccggcggtcattttacggataattatacaaccaaagaaattgccctgactgacatttcccgtatcaaagaacgtatgaataaggaaaatgtgacgacggagcagatcggcgaacatattatcgaccgatcgatggatgtataccgactgttaaaaaaatatgctgataaacacggcattaaaatatataatgcaacccgtggtggaaatctggagatcttccctcgtgtcaaactggaagatgtattagcctccgaacgcccgccgcacaaacagaaaggatga

SEQ ID NO: 1765 - DNA, 2187 bp, Unknown
  Artificiall/Consensus sequence
atgaaaaaagagaacaatgtaaaaaaaatgagatggaatatgaaaaatccggacagtttaaaatggtattttttgatcggcgcgctgatcggagccgtgttgtttgtgctgatctatggatttagtgttttgaatgtgacaaacgatgcctggcttatgacgggaaaagatcttcagcagcattacattggctggaaatattaccgcgatgcagcatggaattttccgattggtttgcatgatggtttaacacatccatatatggtaagtgttctttacacagattcaattccattatttgctattttctttaaagcactgtctccactgttgccggagacgtttcagtactttggattgtttggcttgatgtgttatatgttgaacggtggttttgcggcattgattgtggcaaaaattcggaagaataaattgtactgtgctatgggaagtgtgttctttatcctttctacacctgtattgcagcgtatgtttggattgttgacacaaaattctcgtcatacttcactggcagcacactttttgattctggcgccgattgtgatctggatgtaccgtgatcgttttcagaaaatttggaaagccgcagctgcatttgcaattctgggagctctctgtgttttgattcagatgtacatcatttttattgtaggtggactgatgtgtggctatctgcttcatagtttattggaagagcgtaaatggaaacgtgtatttattgtatttggaagttttgtggcagcttttttggtaaccttctttgtggttggtggatttaccgatgtgctggattcaggaagtaacggatttggattgtattccgccaatctgaatgcgttaatcaacccatatgaatattcttcgttcttccctgaaatgggaatgcgaagcggccagtacgagggatttgcttatctgggatttggtatgatcgtattgtgtgctattggtatcggattattgattcgtcgtatgattcagatgcacaaagaaaagaaactgtggattcggatgaaacagtttattaaaaagcatgccagtggcctggtttccctgtcgattgttgtcattgtatttgggtctttggcgcttacaacctgggtatatattggaaaatatattattttacaggtataccttccgcaattttgttatgatgttcttgctattgtacgttcttcaggacgttttatctgggtgatcatgtatatggcgatgatttttggactatatatggcagcaagaatgatccgcaataaaaaagtatgtacgatcattgtcgcagtgtgcctttgtcttcaacttatggatctggcaaaaccaatttcccggattcataaacagtatacatcagaacctgtggcggaagagagtatggtaaaaaatgctttttgggatacgcagttaaaaaattataaacatattgtatattatccggtagcaggatacggtttgtatcagatgatgcaggtcggaacaaaggcttctatggtagaggggatggatgtaaattatttttacatgtctcgttttattaaatatagtttgatcgaaaaagaaaataaagagattaaaaagaagtttatggataatgcactggatgaagataccctttatattgtagattaccgtagtgcacataaatataaaaatatggcaaatttttatgaagtagacaataaaattttagcttcgaaaaaaccaattgcagatgttccggtttatcgggatgtatatttgagcgcagaaagtccttatgtcgaacttgatttttcagaccagggtcttggaaagaaatttgcacacagcggatggaatgagacagatttcggagatgatggaacttggacttccggtcagagcgttgttcgtcttttgtcaggaggcgctaagaaagcgcatgttacagttgaatatgaagccggaaagaagaaaggaacaacaaaaattaaggttaatggaaaggaacgagccaagttaaaaaataatgaatccggcattgtcgagtttgatacaatgcttaagactacgacaaatgagcataagggtgaaggtgttaactggctgttctttaacacggatagtgtatttaaatcaaaacacaatgatgatgatattacttgcggaatctacgttaagaagattacggtaacgtatctgcggtag

SEQ ID NO: 1766 - DNA, 2142 bp, Unknown
  Artificiall/Consensus sequence
atggatattaataaaaaaatagcagaagaattagagattaaggtatggcaggtagaggctgtcgttaagctggttgacgaaggaaatacgattccttttatcgcccgttaccgaaaagaacagcatggggcattgaacgatgaacagcttcgtaatctgcatgaaagactgatctatcttcgcaatctggaagagaagaaagaacaggttctggcaagtattgaagaacagggtaaactgactgacgaattgaaagcccagattcttgcagcacagacacaggttgtcgtggatgatctgtatcgtccatatcgtccgaaacgccgtactcgtgcgacgattgccaaagaaaaaggattggaaggacttgctaatattatcctgcttcagatgacagagcagccattggagaccgaagcggaaagttatctttccgaagaaaaagaagtgaaaacagtggcagaggcgattcagggagcgatggatatcatcgcggaatccgtagccgatgatgccgattatcgtatgtatatccgtaaacttacgatggaggaaggacttcttgtatctgtcgcaaaagacgaaaaagaaaagtcggtttatgaaaattattatgaattcagtgaggcggtaaagaagatcgcgggataccgtattctggcgattaatcgaggagaaaaagaaaaatttcttaccgtaaaaatagaagcaccggaagaacgtattttgcgttatctggaaaagaaagtaatcacgaaagaaaatccatatacaacgccgtgtctcaaggaagtgctggctgacagttataaacgtctgatcgcaccatcgatcgaacgtgacatccgcaatgaattgacggaaaaagcagaagacggtgccatcaaagtatttggaaaaaatcttacccagcttctgatgcagcctccgatcgccggcaaagtggtacttggctgggatccggcatttcgtaccggctgtaaattagctgttgtggatgagacaggaaaagtattggatacgatcgtcatttttccgacagagccacagaaaaaagtagaagagtccaaacgtattgtaaaagggctgattgataaatacaatatttccctgatttccgtcggaaatggaacggcttcccgtgagtccgagatggtgatcgtggagatgttaaaagagattaataaaccggttcagtacgttattgtaaacgaggcaggagcttcggtttattcggcaagcaaactggcgacagaagaatttccgaattttgacgtggggcaacgtagtgcggtttcgattgcaagacgccttcaggatccgcttgcggaattggtaaaaatcgatccgaaatccatcggagtcggacagtatcagcacgatatgaaccagaagaaattgagtgaagcattgacggcggtagtcgaagactgtgtaaacaatgtcggcgtcgacctgaatacggcatcggcttccctgttagaatatatctccggtatttccaaaccgattgcaaaaaatatcgtagcctaccgcgaggaaaatggtaaatttacaagccgcagacagcttctcaaagtggcgaaacttggaccgaaagcgtttgaacagtgtgcgggatttatgaggatcagcgatggaaaaaatccattggatgcaacgagtgtacatccggaatcttatggggcagcagaggaacttctttcccttctcggatttggtaaagaagatgtccgtggcggtgtagttggtctttctcttttggcaaaagaccgtaaatccctttccgaaaaacttggaatcggtgagatgacgctcaatgatatcatcaaagaattggaaaaacctggaagagacccgcgcgacgagatgcccaaaccggttcttcgtaccgatgtgcttgagatgaaagatctgaaagagggaatgatcctcaaaggaaccgtacgcaatgtcattgattttggcgcatttgtagacatcggagtacaccaggacggcttggtacatgtttccaaactgacaaataagaaattcgtgaaacatccattggaagtggtaagtgtcggagacgtggttgaagtaaaagtgctgtcagtagatctgcagaaaaaacgtatccaactgtccatgattttataa

SEQ ID NO: 1767 - DNA, 1755 bp, Unknown
  Artificiall/Consensus sequence
atgggttacatggaaaattatgaagaatggttggcaaatccttattttgatgaggatactaaaaaggaactggagtcgatccgaggggatgaaaacgagatcaaggaacgtttttatgcggatcttgaatttggtacagcgggacttcgcgggattatcggagccggtaccaaccgtatgaatgtatacaccgtacgtaaggcaacacagggacttgccaattacatattgagccagaaaggcgagaaaaaaggagtcgcaattgcatttgacagccgtagaatgtcaccggaatttgccgatgaagctgcctgctgtctggctgcaaacggcatcaaagcctatgtatttgagagccttcgtccgacaccggaactttcgtttgccgtcagagaacttggctgcatttccggaatcaatgtgacagcaagccacaatccgccggaatacaatggatataaagtatattgggaggacggagcacagatcacaccgcctcatgacacaggaattatggatgaagtaaaagcggtgacggattatgcgaccgttaagacgatgccaaaagaagaggcggtcaaagccggattgtatgaaaatatcggcgcagcgatcgatgatcgttatatggaagagttgaagaaaaatgtgctgcatccaaactgcattaaagaagtggaaaaagatcttcgcatcgtatatacaccattgcacggaaccggaaatattccggtgcgccgcgtattgaaagaattgggatttaccaatgtctttgtagtgccggagcaggaacttccggacggcgaatttccgaccgtcagctatccaaatccggaggcgagagaagcctttgaactggctcttgcccttgccaaagaaaaggatgccgacctcgttttggcgacagacccggatgccgaccgcctcggtgtttatgtaaaagacagtaaatccggcgagtacatctgcctgaccggaaatatgagcggttcgttcctggcagattatgagatcggacaaaaactggcattggaaggcaaactgccggaagacggatatatggtaaaaacgatcgtaacgaccaatcttgtcgatgccatcgcgaaatattatggcattaaagtcgtagaatgtctgaccggatttaagtggatcggccgtgagatcttaaagagtgagcagagcggagagggtacgtatctcttcggatttgaggaaagttatggctgcctgatcggaacccatgcccgcgacaaagacggtatcgtggcttccatggcactttgcgaggcagcagcttattataaaaaacgtggcatgacattgtgggatgctatgatcaatatgtatgaaaaatatggatattacaaagacgatgttatcgcgatcacgcacaaaggcatcgaaggactggagaagattaagtctacgatgagcggtcttcgtgaaaatccgccgatggagtttggtccttataaagtgacagcgattcgtgactatgaccgcgacaccatcaaaaatatccagactggtgaagaaggaaagacagggctgccaaaatcaaatgtattgtatttcgaattgaccgacgatgcatggctttgcatccgtccatcgggaaccgagccaaagattaaaatttattttggggttgttggcaaggatatggacgacgcagacaaaaagtcaagggaattggcagaaattgtaaaaaaaaacgcttctttgatttggaggaggttgaagaaagagtga

SEQ ID NO: 1768 - DNA, 1380 bp, Unknown
  Artificiall/Consensus sequence
atgaatatgaaaatcacaaatcaaatcacacgttattacattttattttatgcactttatagtatgacacagcgaattattcctatttctgttttttgtgtcggtcccttagccgggattctttataaactgattgttggtctcggcggctgtctggcacttgtttatctggtttccggatttaaaaaatggaaaatgaattcccttttcgccctactgggcggctttatcctggttttatgtattaccacactgctaaatcgcagttataatttttttgacaatgtacttggcgtcatcacctttggggtccagctcattctgtttttcagttattaccatatgacagagaaaaaggagttttcttttacaattcaacttactgccgtcgcatcgagcatcctttggaacatctgctgtgcaatttcccttgcccagtaccttttgaatattcagtaccgcactttaaatcctattggaaataccgtgcgacagggaattgtagatggcagactgtttggtatcttctccgatccaaattttgctgcttttacttcctttttagtgctgatgctgcttgcatacactttttattgccaaaaaacccggattctccgtatttatatcggaatcagcgtcgtgctcaatattgcatatatcgtattttcaaattcacggactgtatttttatgcgtgatcggcaccgtatttttctttgtattactgcttacctaccgtcgttatatcgcagacggaagaacgtcggtcaaacgttttcttctttatgcagtacgaaaccttgcgctttctttggctggaatgattgctgtctattctctgctcttttatccgatgcagaatatcggcaaacagatggagccgcagcgcagcgaaacagaccttgtccgcgatgacgtaggcggtgataatgtaacaaataaccgctctacgatttggattcattatcttgatctgtataagaaaaaaccggtatttggattttcaatcaacaccgcacttccttatgccaccgagcatgatccggaaggctatctcgcgcagacacagtatgttacccacaatgggtatctgtcgcttctggtggaaaccggtattctaggttttgcactgatggcatgttttattatcttgatgctgattcgaaatgtaaaacgcattcaggcaaatgaaaaaatcagcccggactacgctctggccttaagccttgtggtcgccgtgctgatcttcctcgtttgtttccatgatattttctttacggtaaatatcgaaaccatgctattgtatctgtcaatgggcgttttatttatcgagacagattcacaaactgctcaatcaactctttccactcagacagaatag

SEQ ID NO: 1769 - DNA, 1851 bp, Unknown
  Artificiall/Consensus sequence
atgaagacgaaaaatcaaaatatcatcggagcggttttggtcattttgatcgtgagcctggttccgctcgtggtatctgcttttaaatatgaaacggggatggcggaatatgcgtggttctccggttcgacggtgcggtatgactttttcctgttttggaaagggcagcttctgcttttactttgcgcactgatggcattttacgcagcgctcaaatgtctccttgtaaaagaagggatgccggacagtaaattggagaaaaaatacattatcccgctggcgttgtatgccgtgctggcgtttgagtcaaccattttttcgaaacataccgatgcggctgtgcgcggcggctatgagcagtgggaaggaatgcttattttgggggcgtacgtggcggtattgttcttttcgtattggattctgcagggggcggtggaactccgcatcgtcgcatacggactgcttgccggagtgtttgttatgacactgattggtggaatgcaggcgtttggatatgacttcttccggacagatgccggaaaagcggtaatgaatctgatgttagacaataaactggactttacgttcaatttcgaaaaaggcagagtgtacgcgaccttgtacaatccaaattatgtgggttcgtatgtggcacttttgctgccggtcattttgtcactcgtgtcaggaaaacggaaaacaagtgccgtatttgtgagtgttgtgtcggtgattacgtctgcgctgctccttgtgatgctgtttggctcgcagtcattgaccggctgtatcggtgtcgcagcgagtcttgtcctgtttttgattcttatgattccgaatatgaagaaaaagccgctgccatttgtcatcggcggagtggtctgcgccgtggtttgcgtgttcacggtgttctgctatcagccgcttttcgaatacggaatcaataaaatgttccatccggcgccgaacaatcaggtgatacgaagcatggaaggaaaagacggcacgctcaaaatgacgatggacaatggcgatgtgctaaatctgaaagtcaatattgcggagggcgaataccgctatgaggcgaccgacgaaaagggaaattcctacaatttatatgaagatgagacagcggagcgtatgaaattttccgacaagaaatatcagaccattgagatcgaagagaaaaagattgagtccaaaaatcagacctacaatgggtttattatttatacaccgtccaccggacgcagttataccattgcaatgcagggcgaaaaatacgaggaagccggtgtgaatcagacggaataccgcattgtcacgccattttacaaattggatgaactgcgtcatatcgaaacctttggctttgaggacaatctgcattttggaagccgccgcggctttatctggtcaaggacgctgcctcttgtgaaaaaatacattttgcagggttccgggccgaacacatttatctatgcgttcccgaatgacgattatgtcggaatggtaaatgttggatatggtgggtccattgttacaaaaccgcacaatatgtttttgcagattgcgattcagacaggcggcatttctctgctggcgtttttggcaatatttgtaatatattttgtggaaagttttcgtatgtattttcgcaagacggcatatcgttcttcggagatttttggcatcggaatcctgctcggtacatttggctaccttgtgaccggccttgccaatgattcgacggtttgtgtggcgccggtgtattggtgcctgctcggggtcggaatggcggtaaaccgttataaccggaaccgggaagaaaagaaagaggcgaacaaatga

SEQ ID NO: 1770 - DNA, 1407 bp, Unknown
  Artificiall/Consensus sequence
atgaaatgtccacgttgtgatacgataataacagaagatgctccggtctgccgcttttgcggacaggatcttagagcactgtatcatgcgcgcaaattgtcaaatgcctattataatattggcttggaaaaggcgaaggtgcgcgacttgacgggagcaatcctggttttgaaaaagagtttaaattttaataagcataataccgaggcaagaaaccttcttggtctggtatacaatgaaatgggcgagacgatcgcagcgctcagtgaatgggttttaagcgattatctccagccggaagacaaccgggcaaagtattatattgatgttgttcagaaaaatcaaagtacactgcagacggtaaaccagaccattaagaaatataattcagcattgaaagaggcaaaaaatgacaatgaggatctggcgatcatccaattgaaaaaggtagtcagtctgaatcctaaatttgtgagagcctatcaactgcttgcccttttatatatgaagagaaaggattatgtaaaggcggcaaaagtgctgaaacgtgcacgaaagattgactttaacaatacgacgacactgcgttatatgcaggaaatcggcgatacgtttagtgagccgaaaggcaaggaaaattctccgaaagcatttgcaaaacaggcggagaaagagacacaggcaaacacggcaaatgtgacgccggtgggaacataccgggaagaaaagaaacgatggatgcccgccgtcaacattattattggagccgttatcggaattattgtaagtgtggtgcttgtatatcctacgatgcagggaaatatactgggaaataattccagcgatattacagaagcaaaggaaatgctttcggttaaggaagcacagatttctacgctggagaaggagaaaaagacgctgcaggacaaagcggatgcgttacagaaagaaatcgacgatggagaaaccaagaagagcgcggaagtggaaaaactcaacaatcttgtaatggctgtaaaatactatcaggatggtgaccggcttctggctgcttcgacggtaaatggctacaaagacagcgattttacgacgcaggaagcgaaggatcttctggcggcagtatcgaaaaagattactgcggcagatgtgcagaaattatttgaagaggggcgtaaagcctttaactcaggtaaatacagtgaagcagaaaatcttttgaaacaagttctttcggttgatgagaaaaatctcgatgctctgtattttatgggacgcgtgtaccatcagacaggaaagacgaaaaaagcacaaagttattatcaaaaagtcattgataccgataagaacagcgcccgcgcttcggaagcgaagagccggttgaatcagctgggtgtcaaaacggattga

SEQ ID NO: 1771 - DNA, 1785 bp, Unknown
  Artificiall/Consensus sequence
atgtggaaaaaaatgatggaattaaaacagcagatacaaagtgaatatatcaaaaataaaaaacagtccgaccgtatgtcgaatacgaaactgatcgtattcgctgcggctgtttttggtttcgtcttgggagctgtatttgaacccataaaattactttgctattttttggcaattcttgtgacagtttgttttatcatcttactggcagttcattctaggttgttagaaaaatgtgaaacagaagaaaaacagttgcagatcatagagaaatacgaaagcagacgaaatgatgactggcagagttttacagacgatggcagctcatttatcacagaagaaaataaagatcttatggacttaaatatacttggaagtcattccttgtttcaatggttaaatatcgcgtacacaaaaagcggaaagcgcaaactcatgaaacagcttacgaaaacagagtttgatgaaacttcgtggaagcagacgcagtgcgctgtaaaggaaatgacagagcatctcttatttggcataaaatttcaggcaatcttatcggaaatacggaatatccacaaacttgatctggaagaaaagaaattgtacccgtcggaatgcaaaaagccggaatggatttctattatcatgggaagcgtgtttgcacttgccatgcttgttagtcttgtgcttggattgtgtgaaatgatatcgtttgggacagcaggaattatgctcttaatatgtctctgcaacctttgcatattctcctattttcatggggctgaatacgaagaaatagaaaaatgtatccgtgcatttggaaaaatggagaggttaatttcttttgtttcggaagaacaatttaaggaagatgtggtgtgtcagtatcaggaaaaaatacgccttggaaaaatgacaatgcacagaatcagtaagattgcatcgctttattatgcaaaagaaaatatgttttcaaatgtattatttaatgttgtatttattttaaatccattgcttgtttttttatatcgaaatacaatgaaagaaggaagtgctatcctatatgacacaatggaaagcatcgaaaaaatagaattatttatagcactcgcaggggttgcctgggtgaaagatacggtatgtatgccgaaaaaaataaaagagatttcattttcagcaaaaaatatgaaacatcccttacttacggagtcagaatgtatcgccaatgatttttcctgcggagaagaaattgttattataaccggttcgaatatgagcggaaagtcttcttttatgcggatgattggagtaaatcttgttttgatgtatgcgggagcttatgtaaatgcggaaaagttttgtgcaccgtttatgcgaatctttacatcaatcggtgtacaggatgatattagccgaggaatctctacgttttacggagaacttctaaggataaaaaaagtgctggattatgccgaaaatacagcggaaaatgaggttcctttcatcgtatttatcgatgaaatttttaagggaacaaattacaatgacagactttttggtgccaaagcggttgtgcacaaattggcagaaaaaagttgtatcacgtttattacaacacatgactttgaactgtgtgaagtgccggaaaagaaagtgagcaattatcattttacagaaaattacgacggagatctgatcgtatttgatcataaaatccgattcggccaatgtaagacaacgaatgcacgttatctgatggaacgcatcggtgtgctttctccttcaaattga

SEQ ID NO: 1772 - DNA, 1314 bp, Unknown
  Artificiall/Consensus sequence
atggaggaaagcatggcaggcaaaagtaatgataatacaacaaagattcgctgctctttttgtggaaaaacggaaaaacaggttcgcaaattgatcgccggaccgggtgacgtgtttatctgcgatgaatgtatcagtctttgtgacgagattttggaagatgaattgcaggaattgtatagtgaccgcgatgcagaagaggaagtcgagatcaatcttttaaaaccgaaagagattaaagaatttttggacgaatatgtaatcggtcaggaagaagcaaaaaaagcattgtctgtagccgtttacaatcattataaacgagtaatgtcgcagacagacatggatgtggaattgcagaagagtaacattcttatgatcggaccaaccggttcgggaaaaacctatcttgcacagacgctggcgaagattctgaatgtaccgtttgcaatcgcagatgcgaccacattgacagaagccggttatgtcggcgaagatgtggaaaatattctgcttaagatcattcaggcggcagattatgatattgcacgcgcagagcatggtatcatttatatcgacgagatcgataagattacgaaaaaatcagaaaatacgtcgatcacccgagatgtttccggagagggtgttcagcaggcgttgttaaagattttagaaggaaccgaggcgagtgtacctccacagggaggcagaaagcatccgcagcaggaatttttccatatcgatacaaccaatattttgtttatctgcggaggagcttttgatggtctggataagatcattggttcccgaattgataaaaaatccatcggatttaatgcggagatcgcagacaaatcggatacccggatcggagacctgttccgccaggtacttccacaggatttggtgaaatttggaattattccggaatttgtcggacgtgttcctgtgacagtaagtttggatcttttggatgaagatgcattgaagcagatcttgacaaagccgaaaaatgcgctggtaaaacagtaccagaagctgttggaactcgacgatgtcaaattgacatttgaggacgaagcaatccaggaaatcgcacatcagtccattgaacgaaagacaggtgcccgcggacttcgtgccatcatcgaaaactgtatgatggattacatgtttgaacttccatcgagagaggatgtcaaagaatgtaagatcacgaaagctgtggtagagaagacaggaaaggctactttgatcggcaaagacgacgagatcttaaagatcgagacggagaaaaaagacgaagaaagtgcctga

SEQ ID NO: 1773 - DNA, 2463 bp, Unknown
  Artificiall/Consensus sequence
atgaataaaaagaaaatgacatattttgagagtaacataaaaatagtagaagatttaaagaaaggtgagaactctatgaaacgaaaaattgttatcgctggtgcggtaattgcgtgtgcggcagcatgtcagtttgtcaatgcagatgcggcacaggcggcgaagaaatataccatcagcaaaacgacgaaaccatgcaccagtgcatacataaggaacaagggatacaatgccaaatccaaaaactactttacgattaaatcgtatcttgaaaaattgaaaaagcagggtggtggtacccttgttttgaaaaaaggaacttacaaaatatgttcgacattgacggtgccaagcaatgtaaccattcagttaaaaaatggtgttgtgctgaaaaagacggacaagacaggaagcaagtcattgaaggccggaaaagtgatgttcaaactgacaagtgcgaaagccaaagattacaaaggtacgaaaaaagttgtgatcacaagtaataaaaaggctacgatcgaccttggcaaagtaaagaatgcagttgcaatcgatatgggacataattacaatgtttcgatatcgaatttgaaattccgcaataaaaatgcgggaacatacattaatatcgccggaagccgtacggtgaaagtgacaaattgtacattccagggtaatgccgcttataccggaggaagttatcaggcagcggtactgatcaatgcgtatggcagaactccttgtaagacggtaaaggtaaccggaaatacttttacaaatcttgaaaatggtatccgtacgaccaaatacaaaaagcaggtctattcggagggcgtttccattcaaaataataaattcaaaaatatgacggttagtgctgtgaccggaaaaatgtggacgggtgcagcaattaccggaaatacgatttatcgcagtgatgccagtaaagggaccgcatttgcgttccagttgtacagcatgactgagccggaaatttccaaaaacaagattgataagtgccgcacaccgatttattttggaagagcttcgaaaattgacaattccatctcggaagcaaagatttcttcgatggaaaataacacggtaacaaatgctgtggtttactatgtcattcagaaaaacgacgcagagtcaagattgttgtattttaaggacaaaaatgaaagagattttcgcattacaccggagacgacaccatatcgtggacattacgagacggcatccggatatacggcaaacagcggacaggcaaagacttactatgtattccgttcgtatatggagcagttagagtataccggcggcggtacgatcacggtagcagccggaacgtatacattgagccattctgtctgcattccatccaatgtaacggtaaactttgaagatggcgtaaagattcagaaagtaaaagcggtaaataccaacctggcaaccaacaaaacgatgtttgaactggtgccaccttccaaagaaggcgtgaaaaattcagtgggcggatacaacggttcccagaatgtaacactgcagggaaatggaagtacaatctttgattgtgcctatacgctgaacgccatggcagttgttatgggacatgctcagaatatcaacatccgcaatattgcatttacgaacgaaaatggttcgcattttatcgaactaaattcgtcaaaaaatgtcacagttgaaaattgttcctttacggactttaagatttataataataagagtcataaagaggcgattaacgttgacacgacagactctaacaacaatgggtttaattatgagtggtccaatcatgaccgcaccgcatgtgatacggttatgatcaataattgtatgtttaccaatataggtgtagctgtaggaagccatacgtattccgtagctatgaatgatgtaaatacacaggtgtatcatgaaaatatcacgattcagaactgtaaagtaagtcagacttacaatgccggtattcgaatgcttaactggcggaatgcagtcattaataacaatgaatttttaggtattcaaggattggaagacaacaaaggatacaactatacctgtattcttgtgaaaggtgctgtaaatcctacgattacgaaaaatacgtttgaaaaagcgggaatgaagaaaaattatgcagttgtcatttatgagaagacgcagccggcaacagatggtgcgattgcagccggatatgtcgatacctatagtgtgttgagtgaagaaaaccgagcggctcttcgtgacaatacggtaaaaggtttgtgttataagagattccttacgaagtatgcggatggcactaacgatctgtatacggaagatggtgtgacaaagaatccaaacaatctgtttaacgattcaaacagtgctacggatggagacaacgtaacgattccggacgatggaaaagaagacgcaaccgaataa

SEQ ID NO: 1774 - DNA, 1479 bp, Unknown
  Artificiall/Consensus sequence
atgtttacgatgttgttagaaaaaattgaaaaatacgtggcggattatgatgtgatcccggtaaaaaaagaaatttatgcggatctcgtgacgcccattgcgttattgcagaaaattgcagcaaagaaaaaacgtttttaccttctggaaagtgtagaaggaggagaaaaatggggacgttattctttccttgggtacgatccggtcatgagggtatcctgcttccgggataaggtcgagatcgaagaaaagggagaaaaaaagacaatcaccacaaacgattcgtttcatgtgatccgggatattttaaagaagtaccgttcgccgaagatagaagatatgccaccgtttaccggaggatttgttggatattttgcctatgcgatgattgagcatgcagagccggtgttaaacatcaagcgaggcgaatttaatgattacgatctgatgctttttgataaagtgattgcgtacgaccaattaaaacaaaagatcattgttgtaggaaatgtaaagaccaagggggatttgcaacagaatctgcaaaaggcagaaaaagagattgatgacattatcactatgattcaggaggagacgaaattaccggaatttccttcttatgacaaagtgaaatttgaatgtaatgtatccgaaaaagaatatgaagatatcgtcgagaagacaaaagaatatattcgagatggagatattttccaggcagtaatttccaggcggtttgtcagcccttatgagggaagcctgattcagccgtatcgtgtgctgcggacgacaaattcttctccatacatggtttatatgaacctggatgatgtggagattatgagtacctcgccggagacgctggttcgcttgcaggatggcagattgacgacattcccggtcgcaggatccagaccgagaggaaaagacgaagcggaagatgaagcccttgtcaaagaccttctcagtgatgaaaaagaattgtcggagcacaatatgctcgtggacttgggacgaaatgatctgggacgtatcgcagaatatggtaccgtggatgtgacaaaatatatgatgatccacaaatattcaaagatcatgcatatttgttcgcaggtggaagcagatatccgaagcgatgccgatgcgctggatgctgtgaaatccgtgctgccggcaggaaccttatccggagcgccgaagatccgggcttgcgagatcattgacgaactggaaagcgaaccgcgtggaatatacggaggagcgcttggctatcttgatttcagcggaaacttagatacctgtatcgccattcgtatggcagtaaaaaaagacggaacggtctatgtgcaggcaggaggcggtatcgtcgctgacagccggccgagactggagtacgaagagtccggcaataaagcaagggcagtgatcgatgcgatacaaaatgcaggaaaagatatgacaggaggtttgatgatatga

SEQ ID NO: 1775 - DNA, 3798 bp, Unknown
  Artificiall/Consensus sequence
tcggatgcggcagagggactgtatctgacatgtgatggatatcagttaaatgcccagacggcatatcagatgaaaaatcgccaggcgacgttgatcctggggtcggaagattcgccgatctatgcggatccgaatctgtatgagatcaaatggtcgatagagaccggaaaggatatcgcagaaattcagcagggaagcagccagatctatggtatcgtaacggcaaaaaatccaggtgaagtaactgtacttgctacggtttacaataaagtggcaagtggtctgggaccggttatcggtagtgttacctgtaagattcaggtcgtatttgcagtagatacttcacaaaatgataatgtgttcaaaaagccatatgaggattcgcaggataaggcgatcttccttcgtacgacggacaaaccggtaccgcttacattgaactatggtagttccagtgaagcccagtggacggtggctaactcagaagtagcagaagtgtccgcggatggtattgttacgccgaagggtgctggtatgacgaaaatcacggcgacgtatacgccaaaggacagtccggagattacctattcgacgacgatagatgtatacgtttatccgagtatcagcgaaacggattccaattatggaaatctgaagacgataaaaatggataccggtggaacgatttatacggatgcaaactttatgaataatatcgaaggcataaaaaataagatggactgggttatcaagcgggacagcggtggaaccgaagaggtcatcgcggattcgcttaccaagaaatcggatctgattgagatcagtccggaatccagccgttccaatcagcttcgagtaaccgcaaaagcgggattgtaccgtgtgtatttttatccgcatggtgcgtatgagagcgagcagaagtacatagatgaagatgtgtatgcaccgacggtattgaatttgtatgtgtatgcaagtccgaatgattataaagaaacgattgccatcggagatacgtatgatatcgcaaaggcatttaacctttcgacggaagaatttttgaaatattttgaagtgcagccgaaagattttaaaaactatgcttcttataaagatggtgtgatcaccgcgctggataagaacagccaggttacaacaaaagtaaacgcagaagtaaccgttcgtccggagtatgagtcgtatattcgctcacttctcccggataatagtaccgtgatggataaaggatattttaatatcgagatcaccatcgccgatgtatttaagttgaatcagaactatattacggtatacaagggaagtgagaccaatttaagtgcttacttcaatgatactcaggttttggaagttgaatggtcttccagtgatccggattatgcgacggtagatgagaccggtaaagtgaccgcgaaaaaagtaacgacagatgatgttgtcatcacggcggtatatcggaacggagctggttcgccgactgccaaatgtatggttcgtatcgtagatacaccaaataagtttgatatcgatccggccaatgcaaaattaaatgttggcgagagtatcgttgtcaagatcaagggaaatccggatgtatcacaggttccgacttcctggtggtcttacgataatagatatgtgaatgtagaattcgataacaatggtaagacggcgaccattacagcaaaagcgccgacaggagacggatcgacgacagaagttgtatttaacaatccaaacacggatgagaaagacgatccaagatgtaagatcacgattgttgtaccctatgagacgattaaactgacagaagagaatctgacgatgaaagtaggtgcgacacaccagttaaaatacacgtatacaccgaataatgtaacggataaaacaccggagtggacatcattggataccaatgtcgtaaccgttgatgaaaatggttatctgactgcggtaaatccgggtacgacgattgtaatgttatcgccaaaatacaatccaaataaagtatatgcccagtgtacggtcacggttgtgtcgaagtgtgaggaaatcacgctgactccgaatgaactgaccctgaatgtcggcgatacacagtatgtagatgtcgcgctggcaccggacggatgtaattctgagctgacgattgaagtgggcgatgaagatatattggattatgaatacaaaccaaataaccgcatcattaatattaccggtaaaaaagcaggtgtaacgaccatcaatgtaggcgcagacgatgcgacaagaaagtccataaaggtaacagtgttgcagccatgtaatgatttggcgttctcgccaaatgcctatgagatgatcgcgggagagacatatacaccaaacttggttaagacaccggatgacagtaccgatgccattacctgggtatcttacaatccggaagttgcggatgtagatgaaaaaggtgtgatcactgcaaagaagacaggggtgacctttattcaggcgacttcggcttccggaagagtggcagtcattcagatcacggtaaaagagacattaacagcagttaccttaaaaccggaaaaagcgacgattgaagtaggagaaagcatgacgcttacgccggacttccttccggcagctgcttatgataagtcgatggaatggagcattgcagacccttctattgcaaaattggagaaccaaggggaatccagtgtgaaagtaaccggtttgaagggcggcattacgttgatcaaaggtgttgctaagagtggcggctttgtagtaagctgcttgttgacggttacagagaagtctacatctgtagaagttaatccgacctcgaagtttttgcagaaaggtaagaggtttacgattaaagcgacggttacttctgcgacagcgacgaataagtccgtaaaatggaaaagttctaaaaaatctgttgccagtgttacttcgaagggagttgtaaaaggaaagaaaattggaaccgcttacataacggcaactgccaaagacggctccggtgcttttgcaagatgtaaagtacgagtagtacgaaaagtgacgaagattacattaaataaatatacagcaaaactgctggtcggaaagactttgaagttaaaagccaaagttcatccgaaaaaagcaacgattaagagtgttgcctggagttcaagcgataattccatcgcgacggtagatgcttccgggcgagtgcagggtctggcagccggaatggttaagattcgtgctaaagcgaaagacggttccggaaagtcagcagtatgtctgatcacggtttcagatccgattccggcgaccggagtcgatgtgacaaataatgatctgattgtagcaaaaggacgtcagattcagtcgggtattacgatcgcaccttccaattcaacggataagatcaaatattattcagataatccggcagttgcgcgaattaacaaacgtggaaagatttatgcaaatcgcgtaggtcaggctacggtttatggtgaaacgtccaatggacaggtaggatatgccgatgtcctcgtcgttacgttgaatcgaagaagtctgccacttcgactgtatgatacggagacacttcgggtaaatgagatatcgacaggagtaacctggcattctcagaatccattgattgcttcggtagattctaccggaaaagtagtcggaaggcgaagaggtgttacgagaatttatgcgacggtaagaggtttgaagttgtcgtgtaaagtaacggtatcggatatcaatggatag

SEQ ID NO: 1776 - DNA, 1365 bp, Unknown
  Artificiall/Consensus sequence
atgaaagacagagaagaacttatttggaaagcagtaaaaaaatgtaaattagagtcggctttctggaagctgacaaaagtatttccgagtacagagggaatggtttctgtgttataccgcaggcaggaacaaaaggagcagattcagaaaatatggtgtaaaagaattgggatcgctgttctttttctgattgcatttttattcttatgctacatggcagggaggacttctccgccggaaaaggcgatacaaaatggaaatgtgatcttcagagagggcgaaggaaaggacattacttttaatctgtcgacacaggtggatggagaaaaaaagcaggaaacgttgtcgatatcgttggaagacagagagttcagcagggaagaattttcaaaactggatgaaaaatgtctggcttacctgaatgaacagttaaaggggcaaaatgcctctttggaaatggtaagcgcgccgttaaattttgtctccaatgtaccgaaaaccgggattgaattctcatggatccttccagaagattatatcaatgcagatgggaccttaaattttgcaaaaattcccgatgagggtgtacagacaaatgtggctgcacaggcaaaatggagaaactgggaaaaagaatacacatttccacttactataaatgggagtgttcttccggagggtgagcgtgcaatcaatcaaattaagaatgtgatgctcgaaaaaatcgaggaacagaaaacgcaaaaggaaattgcgttaccagcgaaagttggcggttacgaggttcactacagcgaagtggagcagaaaaaaaagccaccatattatcttttatctgttcttgcaattcttttttttcctgttttatggaaaaaagaagaaaggaaaaagctggaagatagacaaatgcagttgaaactcgattatcccgagtttgtcaataaaacgatgttattgtttaacgcaggcttaacggtccgcggatgttttgaaagactgggagaagagtatcaatatcgcttgcagaaagggggtgaacgccgttatgtatatgaagaggtcttaacggcctatcaggaaatgacaaatggtgcgtccgaagcagcatccatagaacatttcggaaaaagatgccggcagctttcttacctgcgatatgcctctattattaaccaaaatatgaagaaagggacagaaggatttatcgcattattggaagctgaagcggcagatgcgtttgaaaaacgcaaagaatggagcagacagttaggagagacagcaggaacaaaattactgcttcctatgatgctcatgtttggcattgtaattagtatcattattatgccggcctttatggcgatgtaa

SEQ ID NO: 1777 - DNA, 1653 bp, Unknown
  Artificiall/Consensus sequence
atgaaaaaaagcatcaaatatctattgggcgcagcgatcgtcgttccggcgctggtgtcgtgcagcgattttctggatcagaatcccgacctgcgcaccacgctggattccgaggagaaaatcgccaacatcctcgtttcggcctatgtgagcggagcgggcagttaccagctggtcgccgaactctcgtcggacaacgtctgcgaccacggcatcaaaaaagactacaaccagttctatcaggacgtttacgaatgggccgaggaggttaccagcaacaacgatgcgccgcgcaacatttggagcaccaactataaaaacatcgccaacgccaatcaagcgctggcggccatcgaggaactgggcggccccgccacggcgaaactcaaggccagcaaaggcgaagcgctcctgtgccgcgcctactcgcatttcgtgctggcgaacatgttctgcatgccctacaatcccgcaacggcgggtgattacatgggcatcccgtatatggaccacgccgaaaccgacctcaatccccaatacgagcgcggaacgctccgtgaggtttacgagaaaatcggcctggacatcgaagagggcattcccctgctcgacgacacctcctattcggtcgccaagtatcatttcaactacaaggcggcctgctgcttcgcctcgcgctattacctcttcattcaggactgggacaacgccatcaaatacgcgacgaaggtgctgacttccaatccggagtcgctgctgcgcgattacgatgcgatcgcggccctgcccaacagttccagccggcatcaggcgtacgtcagctcgtccagcacagccaatttcctgcttcaggccgccacctcgaacagcggactgcttttcgactggtacagtaccgccggacgttattcgcacggtaaaattcaagggacctacgagaccgttcagccgaaaaagggcggcccgtggggcagcggggtgagcttcaaggccgcgcatgcagtgctctcgacctccggcaaatacgtcctgccgcgcacgtggcgcgtattccaatacaccgaccccgtagccgggaccggctataacaaggccgtgtcggtgctgttctgcaccgaagaggcgctgctcaaccgggccgaggcttacatcatgaagatgagcgaggacccggatgccgtgaacagcgcgctggcggacatgaacctctatgcctcgaacctcttttcggcgggcttcagccccatgacggaagcctcgatcaggaaatgggctacggagacctatcccgactattccgaactttacgtcggaaagacctctgccagcagtccgcagacgctcaaccccaagaagaaactccatgccgctccctacaacgcgctcgaagagggcggcgcacaggagaacatgcttcaggcgttgatcttcatgcggcgttaccagttcctccacgaaggcatgcggtggttcgacacgcgacgcttcggcatcacggtctaccgctacctgctggacgaggacgatgaaaccgtcgtgcaaatcaccgatcagatcagcgacgaaaacggcacgccggacctgcggcgcgccctgcaactccctgccgacgttatcgccgccggtctgacgcccaatccgagaaacaaataa

SEQ ID NO: 1778 - DNA, 489 bp, Unknown
  Artificiall/Consensus sequence
atgttgagcgacgagaacgacaacttcgtgcgtgattacgaggtgttgtacgatatgacgttgctcgatttccataatttcatcctgcagtcgctcgaatacgaggagtgcatggcttcgttcttcacggctgacgatcactgggaaaaacaacgtgaatttaccttcatggatatggacgacggcagcgagaatgcccccatggctatggagaaggtgacgctgggccagattatccacgatcgtcgcgaccgcctgatctacctcttcgacctgtttggcgaccgggcttatttcctcgagttgaccggagcctatgaagctgacaaggatggcgcttatccgcgcgaaatctacgcacaggccgatgctccggaccagtacgatccttcgaagaaccgcgtggagggtgaaggttcgatcttcagcgaggtgatgagcgatttcaacgatttcgagggcgacgataattacgacgatgcctactaa

SEQ ID NO: 1779 - DNA, 879 bp, Unknown
  Artificiall/Consensus sequence
atgaaaagtgcgctgtatcatattctgctgctgctgagcctgctggcgtttccgggcgccgcccgttccgcctcttcggccggagaggccgcggattcggtcgctgcggccggtgctcccggcgcgtcggcctcggagatgcgcgtcaggaagcgtttcctgccgacatcgagacgcttcgaccgtgaaatcaacaaggggcggttcgtctacaagggtgagacgatgatgggcctgacggtctcctacgggacgctctcgtccgaggatgccgacatgttccccgtcttcgagaatatcaacctcaaaggctccgtcactacgataaatcccttcgtcggctatttctaccgcaacaacaactgcttcggggttcgtttcgggtattcccacctgtcgggaacgctcgataccttcgacgtcaatctgggggagagcaacgacctggatctcgacgtaccgtggctggatctttcgagcgagcgattctcgttcggggtgttccaccgctcttacatcgctttggacgagaaggggcgcttcggcctctttgccgagatggagctttcgttcgccacgggagagaacaacttttcctacaagtcgggcgaggattttaaattcaccaattcggaaaacatgaccgtcaaggtatggttcaatcccggtgtcgccgtctatgctttcccgaacgtttgcgcgacgctctcgttcggactcgggggctttaagtatgcgtcgacgcgccagttcgacgagcagggcgcccaggtagggtcgcgccgctattcgaagatgaacttccggctcaacctggccgatattcgtttcggcatgacggtgcacttgtggaacaaaaggaaaggagggcgcggatga

SEQ ID NO: 1780 - DNA, 1626 bp, Unknown
  Artificiall/Consensus sequence
atgaaacgctggcatacatatcttttcgccggatgctgtgcgctttgcctcggggcatgcacgggtaatttccgggacatcaacgacgatcagtcgggtactacggacaaggagttggaggccgacaataacggcctgggctaccggctgaagatcgtccagcagggagtctatttcaactatgactacggcaagggcaagaactggccctttcagatgacgcagaacctcagtgcggacatgttctcggggtatatgcacgatcccaagccgctgcagggcggaagccataattcggattacaaccttcaggacggctggaacagctccatgtggcagttcacctactcctacatcatgcccgagatctaccggctggaacagacggccgaagagctgatgccgccgttttacgccattacgaaaatcctgaaagtgctggtcatgcaccgcgtgaccgatttttacggaccggtgatctactcccgtttcggcagcagcggcgccgaatatgtgcccgacagccaggaggaggtctacggacatttcttcgccgatctggacgaggccgtgcggatactctcggagtatgtcgcacagcatcctgcggccaatgagtttgcacggttcgacctgttgctcgacggcagttatgtctcgtggctgcggttcgccaactcgctgcgcatgcggctggctgtgcggatcgcctccgtggctccggagcgggccgccgaggagtttcggacagggctggaagacgcttacggcgtgatcgagtcgaatccgggaaatgtcgccgtagatgcctcgggcgtcttcctgaatccgctgggagcgatcaaccgcagttggaacgaggcggtgatgaacgccgcgatggagtcgattctgggcggatttgaggacccgcgcatggaaaaattcttcgaaccctgccgcgccgacctgatcgtcacggaggagggcggaaaaacgatcgaaattgccggagagtttcatggaatccggcagggaaccgcgttttcgcacaactattacgcggcgttttcgcgtctgacggtcgaacagacgaccgatgccgtcctgatgacggccgccgaggtctggttcctgcgcgccgaagcggccctgcgggggtggaccggcgagagcccggagaactgttatcggcggggtgtgagcctttcgttcacccaatggcaggcggcgggtctcgaacgctatctggagagcggtgcgacggcggcggactaccacgaccccgtcgatccgcagaacgacattgcagcccggtgccgggtgacgccccggtgggacgagtctgcggacgacgagctgaaactcgagcggatcatcacccagaaatggatcgccatgtatcccgaggggtgcgaggcatgggccgaacagcggcgcacgggttatccgcggctgttcccggtgcgcttcaaccacagcaagggacagagcatcgacaccgagacgatgatccggcggctgcctttccctgcgaccatggctacctctgatcccgagcagtacaatgcgctgaccggcgtgctaggaggtgcggaccacggcggcacccgtctgtggtgggacaccggaacgaacttccggtag

SEQ ID NO: 1781 - DNA, 1179 bp, Unknown
  Artificiall/Consensus sequence
atggaagacctgaacaccccgatggctcaatggctggctgaagccggatggaacgagtcgtatatcacgctgacctccaaagcgatcatcattctgggcatcctgctcgtcgcctccgtggtgacggtcgtgttccggcggctggtcgtcccggctctgcagcggatcagcgcccggaccaaagccacctgggacgatcatcttttcagcgacaaggtgatgcgccgcgccgcacgactgcttccgccagtcgtttggtacatgctgctcggagccgccttctacgacatgcccgtgctgctcggtattctccacaagggatgccagatctacctgattgtcgtcttcctgcaactcgtcagcacgttcctcgatacgctcaacgacatctccagccagcatgaaacgctgcgcaaccgcccgttgaaaggagtttaccagatgattaacctgctgacgatctgcgtcggggtgatcctcatcgtcagcatcctcatcggtcagaacgccacgaccatcctggccgggctgggcgcctcggcggctatcatcatgctgatcttccgcgacagcatcctcggactggttgcgggcgtacagctgtcggccaacgacatgctgcgtcccggcgactggatcacgatggccaaatacggtgccgacggttatgtgaccgaggtgacgctcacgacggtcaaagtccagaatttcgacaagactatcaccaccatcccgccctatgcgctggtcagcgactcgttccagaactggcggggcatgtgggagagcggcggacggcgcatcaaacgttcgctgctgatcgacgctaacacggtgcgtcccctgacggccggggagctggccgggctgtgccgcaagggactggcggaagccggcgatccggcagaacccgtcgtcaacctctatgccctgcgggaatatgcggcatgttacatcaaacatcatccggacatccaccccgacctgatgcagatggtccgggcgttgcagcccacctcggagggtattcccattgaggtctactgcttcacgcgcgacaccaactgggtagcctacgaggccgttcagggggctgttttcgaccatctgctgtccgttctgcccgaattcggcctgcgcagctatcagcgttcctcggaccgcgatccgcaggcgtaa

SEQ ID NO: 1782 - DNA, 1284 bp, Unknown
  Artificiall/Consensus sequence
atgaaatcgctgcataaaacaatcatgctcgccctgctgctcctgacgggagcctgcggcagtatgctcgacattgaaccgcattcggcggtatctccgacagtggtcggccccgacgatatcgatgcgctgcgcatgggtatgtacaacaaggtgcaggagggtcccacctactattcctatatcgctttcgaccttttcggcggcgagctgatgaccagcaccggccggccgatcgatctgataaactcgctctccaatgcgctgcacacgttcgtcagcagccagtggaacggttattacaaggcgctcctgcaagtgaacaacgtcatgtcgattgccgaaggactggccgacagccctttgaaaaaccgcgtgctgggcgagtgccgctatttccgggcttacatctatctgtgcctggtaacccgtttcggcgatgtgcccgtgctgcgtcagaatacgcaggccaaggtttcgcgcgatccggccgcggacgcctgggcgttggtcgaggaggacctcgatgcggccgccggctacctgaacggactgaccgccgacagctattattatgtttctccgcaggccgtcacggcgctcaaagcccgtgtgaaactctatctgggcaagaaaggggaggcgaaggagcttgccgaaagtctgatcggaaattcgcgtttcgcgttggacagcttcgacaagatattccgcggcaaggccaacacggaggtgatcttcgctttttcgtgtctgaccgaggacggttcgtcgatcaagatttccaaccagttctactcctacaaccaccccaacaagggcagctacaactaccgtcctgcgggcgaggtgatgacgatgtacgccgacaatgacctgcgcaaggagatatcgatcaccacgctcgacaacctgaatttcatcaacaagtaccccagcgggcagaccggatcggaccccgtggtcatttcgcgtttggccgagatgtacctgataagcgccgaggcgcaggggttgaacggcggtctcgaccggctcaacgagctgcgtgagaagcgcggcctcggaaaggtgagcccggccaacgaagccgaattcctgacggcggtgctcgacgagcgtcgtttggagttcctggccgaaggtttccgctggtacgacctggtgcgcaccggaagggctacacagacgctcggcacgaaggactatcaatgcctgatgccgcttccgagccgggagctgctttacaatccgaatctcaaaccgaataacccgggttattag

SEQ ID NO: 1783 - DNA, 573 bp, Unknown
  Artificiall/Consensus sequence
atgcagcattgtttacgggattcggaactcgtcgtgatgatgcagaacggcgacaaggcggcgttcggggtgcttttcgaccgctactacgacttgctgcatacgttcgccaagcatatcgtcaaagactcctgcgtggcggaggatatcatccagaacgtcttcgtcaaaatgtggatgcgcaaggagcggatcaactcgaaactctcggtgcgcaactacctgctggtggctgtgcgcaacgagctgttcgattacatgcgtctgcgctacaatctgctgcgcagcgacatcaacgatgcgctgctcaatgtcgccgacagcgatacggacatctacgactacgtcgatgtccgcgaaagggtcggattcatcgactcggcgatgcgctcgatgccggacaaacggcgcgaaatattcgccatgcgttacgaccgcaacatgaccaacgccgagatcgcccatgccctgaatctgtcggtccggacggtcgaaaagcatatagacctggcgattaaacaaatccggaagacgatttccgtagtgttgctcttttttgtgatgttctcctga

SEQ ID NO: 1784 - DNA, 1419 bp, Unknown
  Artificiall/Consensus sequence
atgaaaaaactgcttcttctgctactggctatgcccgccgcggccgccgtcagcgcttccggtcccgattacggaagatccgcccgtccggaagtctcggagcggctccttacctcacaggccgtcgaacggcagatcgagcgcatccggcagacagtcacggtttccaagctggtccgaatgttcgaaaactgcttccccaatacgctcgacaccaccgtccactatcgcaaggatgaggacggagaggacgacacctttatatatacgggcgatattcacgccatgtggctgcgtgattcgggggcgcaggtgtggccctacctcccgctggcgcgcgaagacgaagccctgcgccgcctgatccggggcgtcgtccgccgccaattgaaatgcctgctgacagacccttacgccaatgccttcaacgacggccccaccggaaccggctggcaggacgactggacggagatgaagcccgaactgcatgaacgcaagtgggaactggactccccgtgctacgtcatccggctggcttatggttattggaagaccacggacgacgcctcggtgttcgacgaacggtggaccgaggccatgcgcctcgtgctgaaaaccctgcgcgaccagcagcgccgcgaaggacccggaccgtatacattccaacgcgtgaccgaagatgccctggacacccaactcaaaaacggatacggccatccggcaaaacccgtcggactcatcgcctcttcgttccggccttcggacgacgccacgacctttccgttcctgatcccgtcgaattttttcgccgtctcatcgctgcgcaaggctgcggagattctgcgcacggtaaaccgcgacgaaacgctggccgacgcatacgaaacgctcgccgccgaggtcgccgaggcgctgaaagaacacgccgtctacgatcatccgcagttcggaaagatctacgctttcgaggtcgacggcttcggcaaccgcctgctgatggacgacgccaacgttcccagcctgctggccatggcctatctgggggacgttccgcaggatgatcccgtctaccagaatacgcggcgtttcgtatggagcgaatcgaatccctattttttccggggtacagcggccgaaggaatcggcgggccgcatatcggcgccgacatgatctggcccatgagcctgattatgcgtgccctgaccagcgacgacgacgcggagatcagacgatgcgtcgagatgctcgtcaacaccgacgggggaaccggattcatgcacgaatcgtttcacaaggacgatccgtcgaaattcacccgtccctggttcgcctgggccaacacgcttttcggcgaactgatcctccggctggccgacgaaggcaaaaccgacctgctgaacagcatcgaagtccgttga

SEQ ID NO: 1785 - DNA, 1350 bp, Unknown
  Artificiall/Consensus sequence
cggttgcgcgaggacccctcgcggcgtcaggagttttcgcaggagatattgcagctggagagccggattttcgagatccgcaatgccaaggggcgtctgatcgaccgcatcaacaccatcgagcaggagtgggttctggccaacctggacggtgcggcacagcggccggtagggcctgttgggagcgatcccgcagcggcggtgcccgattcgctgaaggttcgcaacctggtggacaatctctatttccgcgaacacctctcgcccgaggactatgcggccctgcgcaatgcccagaaattggagatgcgggccgtggattatatcaaccgctatttcgccaactacggaacgctctccgagctggccgaatcctacgccgcggtgcaggccgaagccgaggcggtggagatttacgaacgttaccgggcattggaggggatgaatcgcgtgctggccgactcgctggccgcgacgtggaattatatcttcgacaataagaattacgcctacggctacctgctcgacaagatgggcaaggaggatattctcgcccgtgaggaggaggcgctttcggaggccgcgcggcagttgtcggcactgcatggcgagacggcttcggacgccgtggcggactacctgctgcgcaagcgggtaatcgtcgactatgaggcttcggtggccggggtgctggcgctggacgccgcgcgcgactcgctgagaggcgtggcggcgcagttggaggcgatcgattaccgcctgccgcgggtcgatgtcgccgaacgctatttcctcgactatgacagcgtggcgttctcgtcgacgccgaaatattcctatcagcatccgattcccgaatgcaaggtctacgccaacggcacgatttaccgcatcctgctggggacctacaacaccaagcgcgccgcggcgacgttccggggggcctatccgctcttctatctggtgaacgacgccggcaagtggtgctactatacgggcggcttcgccacgctggacgaggccgaagcggcgcaggcattgctgaaaaagcgcggcttcgtgcggcccgagattgtggtgtggaccgacggtgcgtaccgtaacctgtcgctcgaacccgattcgcagaagctcctctaccgggttgaaatcaccgggaccgacgccctgtcggacgaagtgaagcagttgatcgccgccacggccgagggctatgagctgtcgcgcgtgggccagcagctctttatcatcgggtcgttcgacgacaaggccgttgccgaccgtttggccgacgccatacggcaaacggacgccgcattggaaataaaagtcgcggagatagcggaataa

SEQ ID NO: 1786 - DNA, 639 bp, Unknown
  Artificiall/Consensus sequence
atgggcgaacggcgcgagatcgtgctgcccgacagcacgcatgtgtggctcaatgccggtacgaaactgatctatcccaaagaattcaaccgggcgatccgtcaggtctatctttcgggcgagatgttcgccgacgtgaagcatgatgaggaccgtccgttcatcgtttcggccgaccggttggaggtgaaagttctcggcacgcagttcaacctcaaatcttaccaggaggatgtcaagtcggaggtgagtctcgttcgcggaaaggtgtcggtggacatcaaggcgtcgaagatgaacgggaaactcatcctcacggccggagatattctccgtttcaacaagaccgacaatcacatcgactttctgaatttcgatcccgattcctatgcgaactggatcgacaacgacaatttctttttcgtggagcagaccctcggcgacatcgtggccgatctgcgccgccatttcgccgtcgacatcatcatcaccgacaaggctctgcgcggggaaacctattacgcctcgttcgtgaataacgaatcgctggacgaaatcttcgaagcgcttaacaaggaccgtctgttctcggtgcgccgcgaagccgaggtctattatctgtcgccacccctaaaataa

SEQ ID NO: 1787 - DNA, 1179 bp, Unknown
  Artificiall/Consensus sequence
gagatggaacgctccgacggcgggacctggcgcgtcgcggttgaccgcgatctgaaaggcgttttctacaccttccagatcgagacgaacggcggatggttggccgagacgccgggcatctgggcccgggcggtaggcgtcaacggcaaccgggcggccgttatcgacctccgcgacaccgatcccgaaggctgggaggcggaccgtgcgcccgaacagaagatgtattctgacatcattctctacgaactgcaccaccgcgacttcagcatcgccccggactcgggaatcaaaaacaagggcaggttcctggccctgaccgaatccggcacccggacgccggaaggggaggcatccggactggaccacctcaaagagctgggcgtgacgcatattcatatcctgccgtccttcgactttgcaacggtggacgagtcgcggctggctgacaagagctacaactggggatacgatccgaagaactacaacgttccggagggcagctatgcgaccgatccggccgatcccgcggcgcgcatccgcgaattcaaggagatggtcatgagcctccaccgcaacggcatgcgggttgtcctcgatgtggtttacaaccacacggcttcggtcgaacgctcgaatttcaacctcacggtccccggctatttctaccgccacaacgccgacggctcctattcggacgcctcgggctgcggcaatgagacggcttcggaacgcgaaatggtgaggcactacatcgtggagtcggtcaaatactgggcgacggaatatcacatcgacggattccggttcgacctgatgggtattcacgacatcgaaacgatgaaccgcgtccgcgaggagctctcgaagatcgaccccactatcttcatttacggcgaagggtggcttgcggccgactctccgctgccgccggagcggcgggccgtgcgggaccacgtcggacagatggaggggatcgccgtcttctgcgacgatttccgcgacgctgtgcgcggcagtacgttcgacgaacacgccgccggatatgcctccgggaatatcgagggacattacgaacccgtcaagttcgggatcgtcggcgccacggagcatccccaggtgaattacgacggactgctgtacagctccctgccgtatgcggcggccccgtcgcaggcg

SEQ ID NO: 1788 - DNA, 1764 bp, Unknown
  Artificiall/Consensus sequence
atgaaaacgatattccaatacctgctcctgacgcttgtgtgcgcgggtttcggcgcttgtcaggataccagcgacgatacggccttcactccgcagactcccgtgctgacgttcgaagaatcggggatcacggccgagaagggcacgaaagattacgaacttacgatcaattccaacctgccgtggcgcatcgaatgcgataaggactgggtttcgttcgatccttcctacggaccgggcgacgccaagattacggtgacggtgtcggccaaccgcacgctcgaagagcgttcggcgacgatttcggcctatgtcatcaagggcgagaacaccacgctgcccgtaaagcaggccgctgcaagcgcttcggaccttgcgacgaactattacgtcaaggccgacggcgcggctgacaaggacggtcttacgtgggagactgccacgacgctggccaatgcgatcgacctggcgatgaacggcgacgtgatccacgtggccgcaggttcctacgtgccttcggttccgttgacgggtatgaagaccgcgctggacaacacgttcgaaatccacagcaactttgcgatgatcggcggctacccggccgatgcgaccacgggtgcggtggccgatcccgaagcgaacgagacgattctggacggtaacaaggccgtatgccatgtcgtagccgtcacggcggttaagacaaccggtatgaaggccacgctcgacggtttcacgatcaagaacggttcgtcgcagttcgaaacggtggcgagcacggcgatcaacggcgtgaaattctaccagagctacggcgcgggcattttcatcggcaattcgcgggtggatgtgctgaactgcaagatcgtcgacaatacggacatccgaatgggcgcgatccgcgtcgatgcgggagccgaggcgctgttcgacaactgtctggtggcggacaacgcgaccaagtcgacggtcacgtacaactgcggcggtttgtgggccgacggaaccgcgctgctgcggatcaacaactgtacgttcaacaacaacaaggcatcgggcgtggctccctgtatctacatcttcggcgatacgggcggcaagaccaatgtgctgataagcaactcgacgatctcgggcaacagcgtcaaccccgagcatgcgacccggaacggcggcggcatctacgtccgcgagaacggcaacctggtgatcgtcaactcgacggtctacggcaacaacgccggcaagggcgcgggtatcgcggtctacggcacggcggccaaaccgagcaaggcggtgatcgtcagctgtacgattgccgggaatgccacggtgacggccggaagcggagccggattgcagcaggcagctgtcggaggcgccgtcgaggtctacaatacgctgatttccggaaacacgacggacggtgcggccgacgatgtcgcctggttcaagggcgcaagctacaaggttgccaactcgatcatcggcaatacggtttacaatgccgagggaggcgttgttgccggcgctgcgttcgatgcggccacgatgctcagtccgctgggcgaaaacggcggtgcgacgaagagctgcgtgctgctgggcgatgcaaacccggcccgtcagtacggaatgtcgcagtcggagcttcggattctgggcgaaagcctcgatccggcattcggcgaggcgatctcctcggtggatcagaccggcgtctcgcgcgagggcaggacggtcgtcggagccgttgtgaaatag

SEQ ID NO: 1789 - DNA, 978 bp, Unknown
  Artificiall/Consensus sequence
atgaaaaagcaaaaatttatgaagagagaaatagacgaatccatgctcatcgattttctggcaggacggttaagccgttcggagcaagccttggtggaagaatggtacgatgagtcggagcagcataaaaaaatcctcgaagatatttattacatatccgtcctctgcaactgtgccgaggtagtgaaaaatatcgatgtggaatattctttacggcagttgcggaaacgtgtcgccgaaaacgagcggcgtgcgaagagccgttttcccgttctgctgcgccggattgcgacatacggcgctgcggccatggtgatcgtggccttgtctttcgtcgtattgaagcaggcatcggacagagtgcgtttcgaggaggtttatgccgagaatagcgtcgtaagcgtttcgctgccggatggatcgacggcctgcctgcaacccgattcgcggataacatatccggtcaatgccggcggaggcaaaaaatacgaggtggacatagagggcgaggcgcggttcgatgtggtgaaacagacgaatggccggcgtttcgttgtgaaggctctggaaacgaaggtcgtcgtgcggggaacttcgttcgatgttcatgcccgtcaggaggacgacaagatcacggcgatacttcacagcggaataatcgatttcgtggcgggagatcaggtggtgggaatgaccccgaatcagcaggtggcctactcccgcgcggatggcaatattcaggtttccgaagtgaccgccgagcgcagtttcgtacatgaagatctccatgaggtcattcaggtgatatccgacatgtatggttgcgaaatccggctggatgacgcttctctcggacagattaaattcacgggtaccgtaagcagtaataacgatctggagcacaccatgaacgtaatcacgctcacgaccggcacccggttcacgctgaaaggcgataccgttgtaattcacaaatga

SEQ ID NO: 1790 - DNA, 930 bp, Unknown
  Artificiall/Consensus sequence
ggcgactgcacggtgaattaccgggtgaagttccgttacgattacaacatgaagtttgccgacgcctttgcccgcgaggtgaacaccgtgacgctttacctgctcgatgccgaggggcgggtggtctggcagcgcaccgagcagggagaggccctgtcggccgacggctacgccatgaccgtaaacgtagagccgggcgaatacgacctgctcgcttggtgcggcactgccgacaaaggttctttctcgatacccgcaacaaccgtcggcaacgaactgacctgcacgctcggcagacggcacgacgccgggaacgaggcgttcgtcgccgaagacctcgaccgcctgttccacgggtggctgccgggacagacgttcggcgaaaccgagggcacgtacacttataccgttccgctggtgaaaaacaccaacaacgtgcgggtggtgttgcagcacctttcgggggaagccatggacaaagacaggtttgtattcaccatcaccgacaccaacggcagcatggattgggacaactcgctgcggcccgacgagccggtgactttctacgcatggcataccgacgccggggaagcgggcctggcttcccggcccgacgggaacgcctccggcccgaacgccgtgttcagcgcggtcatcgccgagctgaccgtgccgcgcctcgtgaaagggcaggaaccgcggctcaccgtgaccgacagggagaaggagaggacggttttctccattcccctgatcgactacgccctgcttgtgaagggattttataaccggaatatgggcgatcaggaatatctcgacaggcaggacgtgtacgacatggtcttcttcctcgatgaaggcgaccgttggctcgatacctacatttatatcaactcctggaaagtggtgctgcaaaacagcgatttgtaa

SEQ ID NO: 1791 - DNA, 1380 bp, Unknown
  Artificiall/Consensus sequence
atgaaaaaaatcatatacaccgcattcctgctcctcgttaccgtgtcatgcgacaagtggttcgaggctgaaccccagggaggaggacagtccggggccaaggtcttcgacaacgaaggctctttccgcgactacatgaacggcatctataccgggcttcgttccgtggaactctacggctcgaacctcacgctgggaggcgtggaatttctcgcccagagtttcaacccctatgccggggccggggcatgggccaagatggacttcaacgacgacatggctctgacaatcgcccgggaagcatacaccaggctctatgcagccatctaccagtgcaacgacatcctcaggctcttcgctgaaaagaaggatgtggacttcatcgccggatcgcgcgaaatgatggtcgccgaggcccggggcctgcgggcgttcctgcacttcgagctcctgcggctttacagccccgcctgcacggtggacagcggcgcgtcgaacatcctctggatggagggcacgcagcccaaaggcgtgcagatgaccacggcgcagctgaccgacaagatcatctcggaactggaagccgcagccgcggaactcgccaaatacgaccccatcgtcaccggcgtaggatacgacgacttgtcgctgctcgggacctcacccatcgaccgcgtctggaagctcaactactacggctgcctggccgccgaggcccgtgcgctgatgagccgcggcacggccgaggatttcggcaaggcatacggcctgctgacgaagatcatcggcgaaggcggatacgctttcgtgcggaccgtctcgggaaccgactacgagttttcggcggagttcatcttcgcgcttccctcccccgaaacgggattctgcgccctctcggaagagctcttcaaccccgcccccgacggcaaaggcgtaaccctttcggcacggctcgacatcgatgacctgcacgctgacgaccgtcgccgcaactggttcgactccgacaacacgatgcgcacgaagttcgccccgacgagcaagatcgacaagtggaagaccgcaccggccatcccggtaatcaaaatcggcgaggtatacctcatggccgcggaggccgccgccaagtcgaaccagctcccggcaggcatcggacaattcaacgacttcatggtccagcgcaacagcgaatcgctgaagctgcccgacacggccacgcaggcacaactgatggaggccctcggcaagcagtatcaatacgaattcctgggagaaggcgtgcgctaccacttctgcaagcgccttaacctgaccgttacggcctacgacggctcgcagataaccgatgtcggcaaaaaggcattccccattgtaaaataa

SEQ ID NO: 1792 - DNA, 1437 bp, Unknown
  Artificiall/Consensus sequence
atgaaaaagagattatatatcctttcagcccttttgggcatgattacggcggccggagcgcagaccgtaaccgacatgcggaaacgggacatcgtggacggcgtttccgtcgggagattcagtatggagcgtaacggcgggtacatcgctgtaaacatgcttctggatttgtcggggctcgacgtggacaataatcgcgcggtgcttcttacgccatggctggtcaatggccgcgactcgctcgacctgcaatcggtaggggtttacggcaggcggcgctactatttctatgtacgcaacggcgtgagcatgctgtcgggcagggatgaaaagagctacagggccgcggaaaaacccggcgacatcgaatatcacgccatggtgccgtacgccgaatggatgaacggctccgcgctgtcgcttcaccgcagcgactacggatgttgcaacacgctgctggcagagcaggacggtatgctcggacgacacagcgaggcgttttttcccgaactggtatatgtgcgtccgcaaggacgggccgaaaaacgggattcactcgaaggttcggcgttcatcgactttccggtggaccggacggcgatttatccggactaccggcgcaacgccgccgaactcgggaaaatacagtcgtcgatcgattccgtgcgaagcgacgcggatataaccatcacctcggtatggctgaaaggctatgcttcgcccgaaagtccctatgcgcataaccgggagctggctatcggacgtgccgacgcactgaagagacacatacagcggctctgccggttcgaaggcgacatcatcacgaccggctacgaaccggaggactgggagggattgcgccgctatgtggaacggtcgaaccttgcgcatcgcacgaggatcatcgcgctgatagacggcgatctggagccggatgccaaggagtggaaactgaaaagcacctatcccgaagagtaccactttctgttgcagcactgttatccggcgctgcgccgcaccgactaccgcatcgcctacaccatccgcagttatagcgatgtggaggagataaaacgaatcatgcgtgagcggccgcaaaagctggacctgaacgagttctacctcgtcgcacaggagtatgaacccggcacggacgaattcaccgaggtgttcgaaacagcggtgcgcatgttcccgaacgaccccgtcgccaacctgaacgccgccaacgccgcaatgcgccgcggtgacctcgcaggggcggaacgttaccttgccaaggcgggcgattcgcctgaggcggtttatgcccggggcgcgctggccgtccggcaaaaggattacgacagcgccagacgctacctgaacgaagcgcaatcgctcggatcggaacaggcgggcgtcacgctcgaacaactggaaaaagagagatactga

SEQ ID NO: 1793 - DNA, 888 bp, Unknown
  Artificiall/Consensus sequence
atgattatgaatagattcgttggatttctggcgctgttcacgctgctgtgcggcggtatggcgtcagggcgtgacgatgcggcttcgaagaaagccgcccggagggagttgaagctgatgtcgttcaatatccgttattacaagcccggggtcgacggggacaactgttgggaaaaccggcgtgagggtgtgctgaaaatgctgagggccgaggaccccgacatcatcgggtttcaggagccgcaccgtccgcaggtcgattttctccgggtcaacatgaacgactacgcttcgctcgatatgggccgcgacgcagacaccgacattgaaaagcggcccgacggcggcgaacacctgatgatcctctaccgcaaatcgcggttcgttctgctcgacagcggattcttctggctgagcgacacgccgcaacgggcctcgcgcggctgggacgccgtgtgccgccgcgtcacggtgtggggtaaattccgcgaccgcaggacggggagggaattttactacttcgacacccacttcgaccacaagggggtgaatgcgcgtaagcaggagtcccggattatgattgcgaaaatgaaagagattgccggagagaaggccgcggtcatcatgtccggtgatctgaatgccgtattcggcaacgaggccctcgctccgctgcgcgaatggatgtcgggagcgcgcgagacggctcccgtgaccgactcgctgcctacattcaacgattggggtgcgtgcgacctctggatcgaccacatcttttatcgtcggttgaagatcgtggggtatgaaagtttgatgaacgatgccgggcggtacggcgttccctatttgtcggatcataatccgattgtcgcccggtttaaactctaa

SEQ ID NO: 1794 - DNA, 1191 bp, Unknown
  Artificiall/Consensus sequence
atgaaaaaaccgctgcttctcatcatcgccctcacggcaacatgctccgtgagcgcacagggctactataccgacgcccacaatcccgacatcacgcgccacaccgggcgcatcgccccgcagcgtatggaattcgtgctgcccgaggtgaacggctacaccgcctacaaagccgacctgcacacccacacgatctattcggacggcgactgcacgcccgagttccgcgtgcgcgaggcgtggtacgacggcctggacgtgctggcgatcaccgaccacgtcgaataccgccgccacgaaggcaagatgctgcacttcctgaaaggctacgttcccgaaggcaccgaggccttcaacaacaacgtcatccggaaagcggccgacgaacggggcatccagaccgacctgaacctcccggtaaggctggcgcaggagacagccgtgaaatacggcataaccatcatcccgggcgctgaaatcacccgcgaaccgctcgcttacggccactacaacgctcttttcaccgccaacaacaacgccctttacgacgtcgacgccctgcaatcgctccgcaacgccaaagcgcagggagcgctggtgatgcacaaccacccgggctggcggcgcaagagcctcgagcaccccgaattcgaggtcaaagcctacggcgaagggctgatcgacggcatcgagatcatgaacggcgcggagttctaccccaaggccatcgcacgcgcacacacccggaagctgttcgtctcggcgaacaccgacatccacgactctgcggccgaaacctaccgcatacagggccaccgccgcaacatgacgctgattttcgcccgtgacaactcgcccgaggcattgcgagaggcgatcgaggctcaccgcacgctggcctattcgttcgacacgattgccggcgacgaacagctgatgaaagatcttttcgcggcatcggtcaaaacgaaggtactctacaccgatccgaaaaacggccaacgcacagtgagcctcacgaacaacacttcggtgcagtacgtcctccgcttcccgggacagaatccggtcgtgctcaaacctttctcagccatcacgacgacagtaggccgggacaaaccgctccgcttcaccgtcgagaacatgtggcactccgaaaaagaccatccccgaatcgaggtgaatctgtaa

SEQ ID NO: 1795 - DNA, 1470 bp, Unknown
  Artificiall/Consensus sequence
ctgcctgccgattcgtttatgacgatgtcggtcaaccccgcgtcgctcatggagaagagcggcgcgtgcgacgctgcctgcaacccccttctcgaccgtctgaaagcggagctgggcaaggcggagaacctctccgccgaggagtccgagtacctgctttcgctgctggagaatccggccgaatcgggcctcgacctgaaaaaagacctgtttatgttcatgtcgatgagcggttccgacatcaataaccccgaggttcgcggcggcctgctgttcccggtcggcgacaagtcgaagctggacgcactgatcgcgcggatcaacgagaagagcggtaccgaagcggtgaccgagaacggagtttcggtcgtgaagatcggcgaggatacggctgcgaccggcgtttgcgcctataatgacattgcctgcatgctctatttccaaacctgcggcggggatatcgaggcaaaggtgcggggactgttcgcccagaagcagggcgagagcctgatgggcgacaaggtcgttgccgcgcggctgtccgcacgcaacgatgtgaatatggtcatgccgtatgacaatttgccggtcatggcgaattattcgatgctgggtgcgatgcccatgatgaatgcactgaaaggggccgtgatgataggctcctccaatttcgagaagggacgcatcgtcagcgacgccgtgatgaattacaaggataaggagagcgagaagaaggcgatggagttttacgcctatgtgaagccccagaccggtgccctgctgcgctacgtgcccgccaacagcatcggcgcggcttcctatgggctcgacggcgaaaagctctatgcgatgctggccgccatgcccggttacggcatgatgctgggcaatccgatgatcaaacaggtgctcgacgccttcgacggcgactgcgtgatctcgttctcgggaatgaccccggacggacgctatccggtcgcatcgctgctggtcgaggtcaatgatcccgccgtgttgcagacgatcgtcacgaacctggcgggtatgcctatccagcagaccgccgagggggaatatatgttcagcatgggcggtatttcggtgctgttcggcgtgaagaacaaggtgctctactgcacgaccgacgtggccgtgaaatcggcgctcgacgggacgaaaatcgagtcgctgacgtcgctggaccgcatcgtgaagggtaagtccggcacgttctggctcgatttcaaaggcctgaacgctctggtggcccagctgaccggaggatacgggatgccgcaggtggaaatagcgctttcggttctcggtatgttcgacgacctggaggcttacggcacgatggagggcggagagttcatcgtcaacatggccgacaaggagcagaatgccttcaaaaccatttgcgacacgaccggcgcgctgatccgtcagtatatgccggaagcgagtgaa

SEQ ID NO: 1796 - DNA, 963 bp, Unknown
  Artificiall/Consensus sequence
atgaaaatacaacggagaatcacgctgggcatcggcatcctcttcgccatgatcctgctgctgggcatccagtccgtcagctatgtgcggcagctgtcgcaggcgacaggcaccatcctcgccgacaactacaactccctgcaatacgcgggcggcatgttgcagtcgttgaacgacatcggcgaagattccgtctcacggcacatcctgcgcgaaaacctcgccctgcaacggcagaacatcaccgaaatcaacgagcgggagagcacctcgacgctcgaacgccacatcgcctcgctgagcgatcccgtgaccgaggccgagatacggaccgtacggcaagacctgttccgtatcatggagctcaacatggcggccatccgcgccaagagcctggccgtcgaagagcgcgccgactacgtcatgtggtggctgatcgtcgtagcggcactatgcgccgtgatcgcgggagccattctcgtctggttccctcggtcggtactgcggccgatcgacgtcctgaaacggggtatcaccgagatcgccaaccacaactacgagcagcggctcgaatttccgggcaaccgcgagttcgaatccgtcgccgagtcgttcaacgacatggccgccaaattagacgaataccgccgcagttcgctcgacgacctgatggcggccaaaaaacggatcgaggcgatcgtcgacacgctccacgagccgatcgtagggttggaccccgaccgccgcatcctcttcatgaaccgcgaagcactctcggtactgaatctcccgcaggaggtcgtgggacgcaacgccaccgaggtagccctctcgaacgacctgctgcggcggctgatccgcggactctgcgaaaagaaagaccccgaaccgctgaaaatctatgccgacaacaaagagagctatttccaggtggagaacacgcccctctacatcacgcccgtc

SEQ ID NO: 1797 - DNA, 1251 bp, Unknown
  Artificiall/Consensus sequence
atgggaaccagaaacacgtttaaagtacttttttacatcaaaaaaaatgcgccgttgcgcaacggcaatacccctatcatggggcgcatcacgatcaatggacagcgcacgcagttgtcgacgcggctctccgtggaccccaatctttggaatgtgaatctgggccgcgtgacgggacgccgggcagatgccgttcgcatcaacgaacaactttcacagatcaggtatcacatcgaacggtgttacaacacattattttatgaccacacgctggttacgccgcaaatggtcaaagagatgtatttcggcaacgaccgccgcagcgagatgctgctggcatttttccgggagcacaacgaggagtttcgccggatggtcggcatcagtcgcagcaaaacgacttattataaataccgaaccgtttacaaccacctcggaaattacatcagcggcaaatacgaacgccgggacctgttgttcagggagctcgaccgggagttcctgacgggtttccaccagtatatcgcccaggagtgcgggcacaagaaaaacacgacgtggatctatatgatcgcgctcaaacacattctcatgctggcccgcggccgggggtacctcacgacggacctttttgccaattacaagctgcacagcgagttcgtgatgcgaaactatctttccatcaccgaaatacggaggcttatccggctcaacctcgacgacgcgacgctgctgctggtgcgcgacgcctttctgttcagctgtttcacgggactctcctatatcgacctttgcaccctgacaccggagcacatccggcaggaaggcaaacaactgtggataagtacgacccgctgcaagaccggttcggaggtgaacgtgcgggtttttgccattccgtatgctatcctgttgagatacaatcccatgatccgtacaaaacgtatttttaacctgccgagcaacggctggtgcaacatatgtctcgaccggatcatgtcactggcgggcatcccccgacacatcactttccactcggcgcgtcataccttcgccacgacgatcacactttcgcagggaatcgcaatcgagaccatcagcaagttgctcggtcacagaaatatacggaccacgcaaatttacgctacaatcacgcactcgaaactcgacggggacatggaacgtctttcgaaacggctcgacacgctttaccgggagtccgatttggaacggattccggaaacggtatga

SEQ ID NO: 1798 - DNA, 876 bp, Unknown
  Artificiall/Consensus sequence
atgtttatgaacgatagcaattttatgaaaagaacgtttgtgctgttgacggctgcggtgctgttggcggcctgctcgaaaaacgaacccgacccgatccgttatccggaaggaacgggcgccttggcgctgaacgtcggatgtacgcccgaagtcgccgcagtgacacgcgccggggaggttccgctgcccgacgggatcacggtccccgatgggatggatttgcggatgcgtatcgtgagcacgaccaccggcactcctttcgaccgggtgtgggcccgtgtccgcgaatacaatccgcgtcaggatttgatgcccgaagccgactaccgcattacggtcttctcgacctcgcagtgggtcggggcggagaatgtcgataatattcccgaaggcgagaacaaaccttatttcgagggtgtgaccaatacgcgggtggtggcccggcagcagactccggtgacgatcgccgcgaggctggccaataccatcgtccgcatcgattttacggaacgcttccggaactatttccccaacggcgcgcgtttcacgctgacgaccgcggccgggaacaagttcgaggtgggctactcggccgaagatcatacggtcgcggagacctactggtacgtgcgccccaagcgcttcaccattgcgggtctggcggtgaagcagcttccctcttcgacggccgatgccgaggtcgtgcgtttcgccgaggtcgtcaacgagactcctgcggcccggacgctctacacttataagttcgacgtttcgggcgtgggcgataccggcgaggtgattatcacgctcaacgagaaccccgtagcgaccgagacggtcgatacggaactcaacgacgatgccattctttaa

SEQ ID NO: 1799 - DNA, 1041 bp, Unknown
  Artificiall/Consensus sequence
ttggcaacggccctgattgcggcatacccgctttcaggctatggcaaaaacaatcattccgatacgaccatgaaagaaaacccgaatctgatccgtgagtgggacaaagtgttcccgcaaagcgaccgagtgaaccactcgaaagtgactttccgcaaccgctacggcattctgctcgctgccgacctctacacgcccaaagacgccgtcggaaaactgcctgctgtcgccgtcagcggcccgttcggcgccgtgaaggagcaggcgtcgggcctctacgcccaaacgctggccgagcggggcttcctcgccatcgcgttcgacccgtcctacaccggtgagagcggcggcgaaccccgttacgtcgcttcgccggacatcaacaccgaggatttcagcgcagccgtcgatttcctctcgacacgcgacgacgtggactccgaacgcatcggcatcctcggcatctgcggctggggaggactggcgatcaacgccgcagccatcgacacccgcatcaaagcgacggtaacggcgacgatgtacgacatgcaccgcgtcaatgccgacggctacttcgattcgatggatgccgacgcgcgttatgagcttcgccggcaactcaacgcccagcgcacggaagatgccaagaacggctcgcatgcacttgccggcggggtagtggacccgctgcccgaggatgctccgtggtttgtgaaggattatcacgcttactacaagaccccgcgcggctatcatccccgttcgctcaactcgaacaacggctggaacaagacctcggccctgtcgtacatcaacacgcccatcctggcatacagcgacgagattcgcagtgcggtgctggtgatccacggcgaaaaggcccactcgcgctatttcagtgaggatgccttcaaaaaactgaaaggagacaacaaggagctgctgattatccccggcgccagccacgtggacctgtacgacaacctggcggtgatcccgttcgacaagatcgaaggcttcttccgggaatatctgaaataa

SEQ ID NO: 1800 - DNA, 987 bp, Unknown
  Artificiall/Consensus sequence
gtggatttttcgaagcgtaccggtgcgaaccggtacgctttttcttatctttatgtgatgaaacattacggaatcggactgctgttcgcagtcttttgtgcgatttcggcatttgccggagagcctgtgccgcggctgagggtcggttcctcgtcggggattttcggtccggtcgggaactggacctacgaaacgttcgccgaggcgaagaaggcaggaatcgacgctgtggaaatcagcgcgtcgaagctgttcctggacaaggagatgaccgacgagagccggatcgaggcccgttgccggcagttgaagcgtgatctgaaacgggccggtatcgaaatctggtcggtgcacatgcctttcggaaaggagatcgacctttcgcagaccgacgaggcgatccggcgtaaaagcgtcgaactgcaccggcgtctgttgcgtttctgtcgtatactctcaccgcggatcgtgctgttccatccgagctggtatctcgggcacggagaacgcgacgagcggatcgcctgcctggtgcgttcggccggggagctgcttccggacgtgaagaggatcggcgccgaaatggttgtcgagaacatgctgggacatgaactggtcagggacgagaactacgaacgtccgctgggccggaccgtcgaagaggtgctgcacatcatgtcgctgctgccccgggaagtgaatgccgccgtggataccaatcatatcgacaatcccgaactgctgatccgtgcgctggggacccgggtgaagacgattcacgtcagcgacggcgacggacgcaacgagtgccacgacctgccgtggcagggccggggcgacaacgactgggccgcggtgctgaaagcgttgtacgaagatgcccgttaccggggcgtcttcatgtacgaggtgaagaaggcggagttttcggaactgaaagactgctacgacaagatgtacgaacagtacgtgcggtcggtgcggtag

SEQ ID NO: 1801 - DNA, 2211 bp, Unknown
  Artificiall/Consensus sequence
gggacaagggcgtccataccgagcgccacccccgagcaggaaactgcggaggaaaaggagatacacgacatctgggtattccagtacgatgcggcaacgcaagaactgctgataaagccgcgctactataccgtcaccgaccaggctgcgttgcaagacctgcccgtatacctgaaagccggagttccgtccgtcgtctatgccgtgaccaacacgggctatgacaactgggccaacgacggcacggatgcttcatggcaaaaattcaggcaggcggaacaactgaaaaaacaaaccctgcctaccgctttcccgttacggtcgatagacaaggtgtcgataccgatggccggggcaagcgacgaggtggaggtaacgacaggtatcacggtcacagtcccggttacacgcatgtatgccaaactcaaagtaaaggtcgagatgcggaaggccgggatggaactgaacaacgtcaacgtaaggcaaatcccgaatgtctgccgggtagagacgctggccggcgacggcaatgacgaaccgatggatgcggttccgtttcccgacggaacgacattcggttccatcgcctttgccgcttcggatctggaaaagaatgaagatccggaatgggcggttttctacgtccctgaaaacctgcagggggaaaccgaaatccagggcggcaacaagtccgacgcagctccctccgatgcgcttgtggtggatgtgaccgccgagatcggcggcgaaagatatctctatgcggtttatcccggcggaaattcgctcaacaatttcaacatacagcgcaatcaggtttaccgcataacggtgaccattacgggggagaaaggccagagcaatccgtcggccaactgttttgtcgtaaaacccgacggctttctctctttcgaaccctattaccgtacagagaccggcggcggatataattttgcggattatttaagtccccatgacgagctgctgaaaatagcccgtgtcggcattatctggcaaaccaaagactgcatcggcgataacacgaacggaacgttggtgcagctcggtgaaaacacgggcgacattcatcagaaaatctatgtcagaacgcaaaagaaaggcaatgccctgatcggcgcctacaacagcgagggcgacatcctatggtcctggcacatctgggttacggacgatgagccggataatctcggcagggccgttacttattacacatacgactgggaccggaacggcatatatcccgaaaagcctcgcattcagggctatgctgtcatgtcatgcaacctcggagcgctggcggagaatcagaaaggcatgggaaacggtctccaccggtatccggatccgatgacgcaggctttcggcatgttgtaccaatggggacgaaaggacccgttcccgcctttacgccatatcgcaagcgagtatcaggattataacgacgagcatacggacctgcattatgacaactccaaccaggtcgaagtgcataagacatccgctgccgatgaaaccaagttgtttcattcggtggtcggaagcaccctgaccggagccgtcagacacgccatcgccaatcccaccgtttttatcagcggaacgaacgcagtcaaacaaaatgaagcttacgtacaggcaaagaacaactatttcaataatggcgactggtgtccggccggagaaagcgacaacaaactttggggcggtctggaaccggccgccgatggaatgaaagcttacacgattaactcgaataataatgtccatatatacgacaattacgggacggagaaatccattttcgatccctgtcccacgggttggagggttgcttcgggtgaattgtggctcgaatttacaaatacgggaatcaatccggcatctatgggcgacatcaattacgacgacaagtttccgatcgggtacggcatgaatatgtatatgcagaaatggaaagacggtccgacatcctatttcccgacgcagggaacacgcgtgggtgacggagggggaatccgcacaagcagttgcgggaactaccacaatgcaaccacggacaccggcaaccgggtgaacattttgcatatccatcaggattacggcctgttccacatattcgaataccaattctatttttactatgtaaagtcggtggcaggaccggtccgatgcgtgcgcgattcgaaataa

SEQ ID NO: 1802 - DNA, 2508 bp, Unknown
  Artificiall/Consensus sequence
atgatcttaaatttccaaaaattgttgagttgtatcttagggtcggtcctgttattgaccggtcccagttgtagcggcggtgaaaagggcgtcgacgatcccggcggtcccgagaatccgggcggcggttacgaggatattcaggtggtggacggcaaagtccggttctatctgaccgagtcggaaaatgcggctcgcaggtcgatgggcgtcggggatcgggtctggaaaaagtcggccgttcaggtcaacgggaaatcctatccggtcgtgaccgacgatagcggacgctgttacatagaggtcgctgcgtcgggttcgggtgcgtataacgccgttttgaccgcctcgggttctcaggactggtacggctcgtcggcctatacggaggtgaaactgccttattcgcagttctgggaggctaccgccgcatcgttgcagtcgtaccccatgtacggctcctacaccaaggagaacggcaacaagatggtattcgaggatgccttcgccgtgctggacctggcgctgaccggttcggccaaaatatcctccgtgaaggtcagcggttccgcaacggacgttctggccggatttgcgaattttctgccgtcgcagggaggctttaaaatgaccgggggcgtcggttttgccgtgctcaactgtaccgacggcggcgactgcgtcgcgctgagcagcagtacgcccaaacacttttacattatgctggctccgggcgattatgcgtcggggctgaaaatcaccgtgtccgattcggagcaccgctccatggaacataccctgtcgccggcccggctcgaagcgggcagagctaccgccgtggcgttgcaatacgctcccgacgccgatctcttgttttccgagagcttcgataatttcgtatggggcggcaatatcatggccggtcaggaatcgacgggatatgcgccgacggccgaaaccatcacggccgctacggggacggaccgggacggctatgcggattcttttgaaaaggtgtcctgcaacaatccgggttccgctttcatccagtcgaatacctgggacgaaatcagcggcaagacggtcggcacgtcgcacctgatgtccgattcgtatgtcgccagccgcaatatcggcgattatacctatatgtttcgctgtcaggagtatcagggcttcctcgcctgcggtgcgggcaacacgggacgcggcatttttcagaccgcagccctgaaggccatcgacggcatccgttccgtcaaggtttcgttcgatttctgctaccagtacggatctacggacctgctgctgtttcaggtcgtcaacggaggcatgatcgcatcggcttcggtcgacggcaaggagatccctctgacggcagagaactcgggttatctgagcgctgcggggaaatatatcgtcgagaagaagcacgtcacgcttccgtcgggcgagtcggcggccaagaagtggcaccgggtggaggtcgtcgtgaacaatgccaccgacggcacgatgctctactggggcggcaacgacaccggcagcggcgttcacgggttctatctcgacaatatcgaggtccgctcgctgggtgaaatggcgcggggcgccgacaacctgcgcgttctctattggaatatccagaacggcatgtggtccgatcaggggaacaattacagcaatttcgtcgcctgggtgaaaaaatacgatcccgacgtctgcatctggtgcgagtcggcatccatctacaagaataatacgaactcgggagcgccggagtccgaaaggttcctgccggccggatggcccgcactggccgcacgctacggccattcgtacacggccgtcggcggccaccgcgacaactatccgcagaccgttacctcgaaatatccgatcgaaacgctgttgaagataaccgattcggaccaggcgggcaaaccgatctcacacggcgccggcattcagcagatcaccgtgaaggggcgtaaaatcaacctcgtgacgctccatacgtggccgcaggcctatgcctacggggttaccggcacggcggaccgcgaagcgagtgccgccaggaaggagggtgacaagtaccgcgaattcgaaatcgaatacatctgcgcgaagacggtgaacgatccggcatacgccgctcagcaggactggctgatgatgggcgatttcaactcccgttcgcgcctcgacaactggtactacggctatcccgccgacgatacccgtttgctggtccacaaccacattctggaccataccgatctggtggatatcatcgccgagcgcaatccgggctgtttcgtatcgtcgacttacggtaacgcccgcatcgattacatctatgcgtcgccttcgatgtacgcccgtatcgtgaatgcgctgatcgtcgtggacaagtggacatcggcgaccaagagtccctatgtatcgaacttctacgacccttcggaccaccgtccgatactggtcgatttcgaactgaaataa

SEQ ID NO: 1803 - DNA, 1068 bp, Unknown
  Artificiall/Consensus sequence
atgaagatccagaaaaaacaagccatcggcgaaaacctgctttatgtgatggtctgggcggccatcatcctggtacccgtgctcaactcccagatgatgtcggagatgcacgtcaacctggagaacgtgctgatcgcctggcggcagatcgccccctatctgatcatcttcctcatccacaacgctgtcatcgcaccccgctacatgctccgacgcaagtatgggaaatacctgctgagcaacctcgcgctgattatcagcgtcttctggctggtgcagatctacgaggaccatctctccgaccaccttctcaaacaggccgatcccgaggcgctcgacgcctaccgcaaggcgtcattctccaacctggagatgtactggagcgttgtgctggggttcttcatgaccggcgccaacacgggcatcaaactcatctaccagtcgatgcgcgacgagcagcaaatggaggtgctcaaacgccaaaacctgcaggcagaaatggactacctcaaataccagatcaacccgcacttcttcatgaacacgctcaacaacatccacgcgctgatcgacatcgacaccgagtcggccaagaacgccgtgatcgagctctcgaagatgatgcgttacgtgctctacgactcaggccgcgagatcatctcgctgaaccgcgacatccaattcctgaaaaattacatcgaactgatgcgcatccgttacaccgacgatgtggacatccgcgtggagtatccccgcgacctgcccgagcaggtgtcgatccccccgctgctgctgatcgtgttcgtcgagaacgctttcaaacacggcatcagctacaaccatccgtcgttcatccacctgcgcatcgaatatgccgacaagacggtcacggggacgctctcgaacagccgccacccggcggccgccacaaaacaggccggcatcggactggacaacgtccgcaaacgcctggccctgatctacggcgaaaagaactacacgctcgacatccgcgaggaagaaagaacctataccgtaaaactcgtaatcccgacgctcaatgcttaa

SEQ ID NO: 1804 - DNA, 1203 bp, Unknown
  Artificiall/Consensus sequence
atgaaaaaaatgacgaaacttatcgctctttttctgagcggactcctgctggcacctgccctcgtgtcggcgaatccggaaggagaccaggttccggaatccgggacagtcgcggcgaaacctcccgtcacggcggaagctcccgccgcggcacagccccagacgacctgggagaaaatcctggccaacctgccgaaagtatccggctatttgcagacgggatggaattacacttcgaacgacaaaagttcgagttcatcattccaggcaaaacggctccgtctgcttctggacggcaaggtcgccgagaaggtggatttccggttgcagatagaggccttcaacggaatttccggctcgacgaacggaaacggacagaagaacatacaggtaatggacgcttttgcaacctggaagatcatgcccgaattcaaagtccgtgtcggacagttcttcacgccgctggggtacgagaattacgacatttcgcccgcaacgctggagacggtcgacttttcgaacattgtctaccgcatagcctgccgcaatccttacgagtacaatctggtagactacggacgggatctgggtatcatgttcatgggagatgtcttcgactcggggaagggattcagctatctgcactacgacgtggccatcaccaacggctccattcccagcaaggacgacagcaacaagtcgaaagacatctatgtcagtctgacggtccgcccggtcaaatacttcaatgtcaaaggtacattcaactggggcgaatatacgtccaaaaaactcgaaggcggcgagggtgtcggcagcggcgattacaacccgatgacccgctatgtggtcggcgcctggtacgacaatccccgcggtctgaatctgcgtgccgaatacgggcacatgaagagccgggtcaacaaagccgatgtcgtcaaagagaacggcgcctatgtactggccggctggcactggggcaagttcctcccgatcgttcgctgggacatgtacgaagatcaggtgaataagggaactgcgaataactataaccggatactgatcggttgtacgtattcggtgttcaaaaacctgaaattccaggtcaactacggacatttcatgtacagcggcgacgcaaagaaggctttgggatacgacagctccgagcagcttcagatcatgggactgttcaaattctaa

SEQ ID NO: 1805 - DNA, 2514 bp, Unknown
  Artificiall/Consensus sequence
atgaaaatcaaatatacagctatattgctcgccgtcctcgtcgcctttccgtgcggcttcctgaaggcgcaggacgttgcggctccggatgccgggtctttgaaggttgtcaaaggcatcgttacggatactgccggcgagccgctctatcaggccgtaattaccgatgccgccggaaaaatgctcggcacgacggacctgcacgggcgtttcgaactgaggacggatgttacgaacctctgtttccgcacggtgggttacagcaatgtttcggtggccgcgtcgcccgatatgaaggtgacgatgcgcacggacgaatcgcacaaggatgacctgctggattacggctacggcgtgatccgccgccgcggaacgctcagcgaggcaatttcgaccattcagggccggcagctcgaggacgtgcccaacgcgagcctcagccagatgctcgaaggtcagatattgggattggggacactcgaagactcttcggacccgggtaatgcgagcgtttataaatatgtccggggcatctcctcgaaccaggggacgcagccgctattcgtcgtggacggtatcgtcatgcaggactacaactatgaattcctgacggccgccgagatcgagaatatcgtggtgctgaaagacgctgccgccacggccatttacggactgaagggcgccaacggcgtggttgtcatcaacaccaagtcggggcttcccggagcgttcgacgtgagggtcacggccgatttctccctgcagcagatcgcccgcaagcccgagacgacctcctcttacgaatatgcgacgctgcgcaaccaggcgtgggcgaacgacgggtcggtggggacggctcccttctctgacgatcagatgtcccgcatccgctcgggcaatgatccgctctatcccaacaacaattattacaacgaattcgttcggaacttcggcacgatggagcggatcggtgtcagcctcagcggaggcagtcagcgcacgcgcgtctggtcgaatatcaatttcatgaaccagacctcgctcctgaagcaggagaccgacgaatacgtggcggcgccccgccgtttctgggtgaatttccgggcgaagatcgacgtggacatctccaaacacgtccgcgcttttgccggcgtggccggtaacgtgcgcaatgaccgcctggcggggagcgattataccaacagcggaatctacgaaacgattttccaactgcctccgacgatgatcggtcccacgaccgaggacggacgcgtgacgacgatggagtctgtttccctgccttcctacggaatcctgaaccgctcgggttacaccaagtatacgggtatgtacgcttcgacgtatgccggcgttacggtcgatctggatttcgtgacacgcggcctgagcgtgacgggcaagctggctttccagtcgagcaacgaccgtcacaactacatgacgcaggatttcagccgctattattatgattatacgcagggtgatttcgtgcagctgggctccaacctggacaccaacctggcaggcggtgcgaacggggtgttccaatacgccatcagctatatcgcctcgttggactacaaacgctctttcggcaaacacaatgcggaggctcatctctacacgtactataccaacgagcagctggacgatgtgaacgcggattttcctgccgtgggtcttccgcacgacgaccacaatacgggcctgaacctgtcgtacaattacgacgaccgctatgtggtcggcgcgacgttcggcctgacggcttccgacgtatttgcccgcagcaaccgctatacttttgtcccggccttttcggctgcgtgggtcgcttcgaacgaggcgtttctgcgcgatgcgaagtggctgagtctgctgaaggtccgtgcttcttacggagaggtcgccctcgatgacttcgaggtaggctactaccgctatatgtacatggattacatcaaaaagaacggcgatgtccgcctgctggggaatcccgacctcaaaccggagatccataagacgcagaactacggcatcgacctggggctctggaataagctgaacctgacgttcgactatttcagtcgccgtaccgacaacatgctgatcgaggagggcagccggattcccgcctatcaggggatctatgtgggcaactaccggaaaatcaacgagggcaggatgaagaacagcggtgtcgagctgggcatctcctatgcgacggacctcggccggggatggggcatccacgccggggtgaattactcgcatgcgaggaacgaggtcatctacaccggggagatgccttatcccggcgacggcgacggatataagggctatgcctattcccaccgggtggagggctatccgctggggcagcagttcggctatctggtcgaccgcagcaacggcagcggctatatctcgaccgacgaggagctggcgaaatatacgaagatgtattccgggatcggaataccgcgcaagggc

SEQ ID NO: 1806 - DNA, 1662 bp, Unknown
  Artificiall/Consensus sequence
atgaagaaatttctctttcgtatcctgattctcgctgtatttgcggcggtggcgggctgctcgtccgatgagggcggcgaaaatcctgacgtccgattttacgcagctccctcctcgctcaatttcgatgcggggaagtccgtattgcagctctccgtcacgaccggaacgcattggaaaatcacgtgtgatgcggagtggctgagcgctgttccgtcggagggaacggggtcggcgaaggtcgggatcaccgcgcaggcgaattcgcaggctgggccgcgcacgtcgtcgctgacgatcgcttacggcggtgcggagccggccgtgattcccgtttcgcagaaggtgagcgaggaagaccggaccgatctgtttgattcgaccgaggagatgaaaagttacctgaaagcgcgtgtcgccgcttgtaattacgcggagtcggtgacgacgaccgacgggggcatgctgaaattcgggttcaaagacgctgcgacgcgcggtgtggtgaagggctcgattccggtctttgccgtcggcaggggcggctactggacggcggacggcgctgcgacgccggtcaaggccgacgaggatgccctgcgcggcggatcgtcgccggcggttacggatgccggcgggaagatcgccctggacggagccgatacgggcgtcgctgtccccgcgggaggcgcggttgcgctgcgctgcgtgcttcacacgggaaaatacctctgtttctatttcgccgacggcgaagtcatccgcatcggcagcgagcttgacggcacgttcaatccgccgcttcccgccgggaagaattccctgaaaatactctttatcggaaacagctttacggtcgatgccacggagcacctgccgggaatgctcgccagcgcagggattacccatgtacgcatggtgcgggcctaccacggcggttacaagctgcccgaatttttcgagaattacggggctccggacatctgcacctattattattgcgagccgggcgcgacgaaatggtcgaacgacggcacgctgaaccgttcgctcaaaagtatcgtcgagtcggatacgtgggacatcgtaacgttgcaggagcatacgggtacgtactgtgcgtgggaatgggacgagaccgagcggggcgcgatcagcggactctgcgattacatccagcaggcgcagcctctcaaccgtcctacgatcggttatatcatggcccaggcgtacgggagtgcccacacccattatccgaagtatttccccgatcagcaggcgatgttcggggcgatcgttgggcaggtgcagaaaatcaccgcgcagacgtgcattgatgtcgtgattccctcgggaacctcgttgcagaacttgcggacttcgtcgctgaacaaggacaacggcatggacctcacgcgcgacctctaccatatggattacggaatcagccgctatgccgccgctgcgaccgtgttccggacgctcctgacgccttgcacaggaatcagcgtcgaagggaacggttaccgttactcgaattccagcacttcgacgaccggttattcgacgccggttaccgacgccaacgcgccggtggcgatccgggcggcgttggaagcctgccgggagccgtatgcggttaccgacatgagcaaattctga

SEQ ID NO: 1807 - DNA, 720 bp, Unknown
  Artificiall/Consensus sequence
atggatccgaaaataccggccgttttcaactggagcggcggaaaagattccgcactggccctttaccgcatcctgcaggagggtgtctatgaggtggtctcgctgctgactacggtcagccgggacacccgtcgttccccgatgcacggcattccgatctggctgctgcgccgtcaggccgggagcatagggctgccgctggaggtggtcgaacttccggccaacggctcgatggaggagtatgaagccgccatgtccgaagccgtcgaccgttttaaggagctcggagtccggcactttatcttcggcgacatctgtctcgaggatgtgcgtgcctaccgtgaacgccggttggctccctgcggcattacggtcgtcgagccgctgtggggacgcgatacgaaagccgttgccgaggaatttttcgcctcggggctgcggaccgtcgtcgtgacgaccaacgccgcactgctcgacgaacgctttgtcggccgcgagtacgaccgggcctttgtggcggagcttccggagggagtcgatccctgcggcgagaacggggagttccacacggtttgctatgcgggcgggatgttccgtatccctgtcgaattttcgctggggaaacccatgcgccgcacctattcggccaaactggaggacggcaccgtgcagaaacacgcctattgttccgccaacctcattctgccggagaattcctga

SEQ ID NO: 1808 - DNA, 1107 bp, Unknown
  Artificiall/Consensus sequence
atgaatcgcatgaaaagacttttactgttactcatcctctgcggaagtttttccgcgggacatgcccaggaaatcctgttgggcgccgatttcaaaatgtacttcgacaacaaggagttcggcagcaacaagttcgcggttcccggactggacatcgaatcgggcacggatttcgccgcccgcctgctgccccgcatcggcatccggtgggatgagaagaatacgcttttcattgcggcggatatggtaaagaatttcggttcggcggaatcggcctatctctcggaggtgaaacccgtcttctactaccagttccagacgccccgcgtcacagccgtggcgggtatcttcacgcgcgacatgatgcacgacgacgattactcgacggcctttttctccgaatcataccgtttcttccacaaccgtatgaacggcgtgctggcgcagtataacggtcagggggggggctcttacgtggagttcgtctgcgactgggaaggcatgtattcggaactctcgcgcgaaaaattccgcatcctgctcgcgggacgccactatctcaaccgcttttactacggcttcaactactcgatgttccactttgccggacagaaaggtgcggaactggagaacgtcgtcgacctgcaactgctgaacccctgcgtaggcgtgaaattcaatgcgttcttcgatttcgacatcaaattaggggcgctgctcacggcccagcgcgaccgcagtttcggacattcgtgggaaatgccctgcatgggtgagttcgccttcaaaatcagccgttggggcctttcgctcgacgaaagactttatgtcggcgacaacatccatccgttcttctacggacacccggaggaaaatatcggttacggacgcgagctctacccgggtgagagcttcttccgcaccgaccagaaggtatacagccgtacggcgctctcctaccgccgctcgttcttcaacgacacggtatcggtccgcgccgagttcgccgcccatcacgacggaacggccctgggaacccagcagatgctcgtcgtgggcgtgaagctgctcaaaacggtttacaacagcaagaatcacaaaaaatag

SEQ ID NO: 1809 - DNA, 642 bp, Unknown
  Artificiall/Consensus sequence
atgcaaaagaatttttacagcctgattacggccatcgcggccttgtgcgccgtctcctgcgatgcaatcaccggctgccccgccgacgaagcgaacagttacgccaaagccatcgaactgacccgaaagagcgtggacggcgaacggttcaaaatctactcggtctcctttatggagatgagcgaactgtcgaacgacctcggcctcgtcaccgtgaagatggtcaacaaggacgaccaggccttctcgcagagctactacctctcgggactggagcccacggacctgcgcgaagtgcagagcgtgttcgaatcgccggaatatgagaccaccgtaggcatcgacctcggcaaactctcgcccgagaccatcgccgcgcagatcgcccaggccaagacgatgctgcccgaaggacacacgttcaaatcggtgggctgttacgagatcgaggaagaggtcccggccggcatggagcattacaaccggaacaaagtgatgggccggcagaccgcgtcgttcacgatccgcttcaccgaggacggcaaggagaccgaaagcagcgccggcaagacatcgatcatttattacgagggaaaggcgaccgtcaaccccgacggaagcctctccatcaaggacaactaa

SEQ ID NO: 1810 - DNA, 1593 bp, Unknown
  Artificiall/Consensus sequence
atgaaaacaaaaaccctgttatatacactgtcagcatccgtgctgatgaccctgacctcctgcaacaactggctcgacaccggttccagcacacagatccggggcgacgaattgctgaaaaccgaagccggttttctggatgcgcttacgggcatctatataaacatgtcctcgtcatccatgtatggcaagaacatgaccagctatgtggtcgacatgctggcacagccctacaccgatttccggtccgcctcgaatgagcggtcagctctcatgagcgggcaatacaacgatgcgcaggccgtgccctttatcgaaagcatgtggaacaacacctacaaaaccatcgccagcatcaacaacgaactgaaatatgtcgaggccaacgaggacgaggtgctcagcccgttcgtccagaacatgatcaaaggcgagctgctggccctgcgggcttttctccacctggacctgatgcgtctgtacggatacggcgatcttcagaatatggaagatcgggagacgcatccgaccattccctatgtcaccgtatacgccaaggagacgactccgcagctgacctatcccaaaacgatcgaactgatgatcgccgatctggaaaatgccatcaaatgcctggagatcgaccccattcggggaaagaacgaggcgccggaagcggccaacaaggacggatactggaataaccgcgtataccacatgaattactttgcggcccaggctacgctggcacgggtttacatgtgggaaggaagcgcggaaagcctgaaaaaagcgttcgacatcgcggaagaactgaccggactcgaaggcacggcctataagtgggtgactgcatccgatctgtacggagccggcacgcccgaccgcgtcttctccaaggaacacctcttcacgctgaatgtctacaacctcaaaaaaatcgtaaacgacgaaatgatcgatttcgtctaccagcccaacgccctgaccaacgtaatcaaatggtcgagggtggcctacgatatcttcaacgcctattcctacgattacgacacgggcgagtatgtccccggatatatcggattcgacgattaccgcttcgacatgcatttcaaagagacgtcgaagcagagcacagcgggcggcagcacccaggacaaatactacatggggtacaaactctaccagacggacaacggatcgacggcggccgtcgatttccgcgatatgctgccgctgattaagatcagcgagatgtactacatcatggcggaatattatctttcgcagtcgaacgaggacaaagcgctggagatcataaacctcattcgttccaaacgcggcctgagccaacccctgaccaaagaccagatcgaaaacgaattctggatggaggttttcgacgagctgaccaaagagtatatgcgtgaattcatcggcgagggacagttgttctacttcttcaaacgctacaaccttgaaaatccgattaacatatacggaaacgacaacgaaaacaacacattcacatccactcgttatctgctgccctatccgaaagacgaactggagatcggcggccgggttcagtag

SEQ ID NO: 1811 - DNA, 1533 bp, Unknown
  Artificiall/Consensus sequence
atgaaaacgatgaaaatcaaacatatgatctttgcggccgccggctttgtgctccttttgtttcagtcgtgttcgctgaacgaggatacgtccggaatttccagccccgatgactttttccgtaaattctcggaatgtcagtcggttgtgaacggctgctatattccgatcaagacgatctacaactatacctacatgatcgccacggagtgtgtcaccgacattgcatattgtccttcgggcacgctcgatgccagtctggacatctctccctccgtgccgcgtctcggttcgaccgtctggacacagggttatctcggcgttcagcgatgcaatttcgccgtcaacgggatcgaacgggcttttcagaacgaagttctcagcgagcagcagtactatcagctgctttgcgaggccaaaaccctgcgcgcattcttttactggacgctgaccagttttttcggtgatgtcccgttctatttcgacgacgttacggacaacgaagtgctgaaccggattcaggtgttgccccgcatggacgccggcgaaacccgcgacaaggttatcgaggacctgctctcgatagctcccctcgccgcccaaacccgtacttacgataacgaggccaaccgtctgggggctgcctgtgcctatatgctcgtcgccaagatggccatgtggaacaaggagtgggataccgctctggacgctttggagaagatagagacgatctacggctcgctgtcgcagtacgactatgcggagaacattctgttccggaacaagaatacgccggaatccattatggagattcagcatgtttatacccagggcggactaacctatacttccaatgtggcctgcatctgccagccttatccgcgttcggccaattcggccatttacgacggcgtcgagattcccgaactcggcgatcaggcgaccgtatgggccgccatgcgtccgaacgtctatttctgtcaggggctccagtccaaaatgggcaaggacattcgcgccaaatacaacatggcctggggctacggggacaagacgttcaacagcacgaacacccgtccgtggtgcgggccgaagttctggagtccgaacatgcaggcttcggccgacggcaacaactacaaggtgttccgttatgccgatgccctgctcatgatggccgaatgctatttctacaaggataattacgagaaggcggtcgaatacctcgatatgacccgtacgcgcgccggtctggccaattacacttaccgcactcccgcgcgtctcgaagaggagatccgcaacgagcgggcccgggagctcttcggcgagttccagcgcaagtacgatctggttcgctggggcatctggtacgaagcggtgacggataacagcgattacggctatttgcagctcaacacggcgaccagccgcatcaaaccgtgccaccgttactatccgattcccgatacggaggttacctattcgaagaacaatctcgataataatgaatacaaggcttacggcttgtaa

SEQ ID NO: 1812 - DNA, 840 bp, Unknown
  Artificiall/Consensus sequence
atgaagaaattgttttttctgctggcgctgacggctgcggtctcctgcaacgccccgcaggagttgaccgtcatgacgctgaatatgcgctatgacaatcccgaggacggggcgaataactggcgcttccgccgcgaacggatcgctgggctgattcgctcggaggctgtcgatctgctgggaacacaggaggtgctcgccaatcagttcgacgatctgcaagccctgctgcccggctaccgggcggttggcgtcggccgggaagacggcgcgcgtgcgggcgaattcaacgccgtatttttccgcagcgaccgtttcgaactgctcgattccggcgtgttctggctgagcgagaatcccgaaacgcccggttcgaagggttgggacggagcctgcgagcggctggcgacatggaccgtgctgcgagataaaagcggcggcgagttgcttttcatcaatacccacctcgatcatatcggcgagcaggctcgccgggagggcgttgcgttgctgctgcggcgcatcgaaacgctgcgtgccggtcgtccggtgattcttacgggcgatttcaatgctgaaccctcgtcgccggttgttgcgcgcgtcgtggccgacagtgccttgcgtagcgcctgggacacggcgccgatccgatccgggtcggcgtggagtttctccgatttcggacagcttccggaggaagagcgaccgctgatcgactatgtgttctacggcggggggctggaggtcgtgtcgtgttcgatattgcccgacacgctcggcggaggatacctttccgaccacgcgcccgtcgaagcccgtttgaaatatgtacgataa

SEQ ID NO: 1813 - DNA, 1707 bp, Unknown
  Artificiall/Consensus sequence
atgaaaaaactatacggatatttgacggccgcattcgtcgccgcggcgatgctcatttcgtgcgtgagcgagaaaacctcattcgcaccggagggcggcgcccacgagggagagacggggtatctcaccttcggaggttcgctgacggtcgaggagcgcaacgaacagatcggcagtacgccggtggcgggaaaggcgactcgtgccgccaacctcgatctcgatacgtatacggtggagattatcaacgcaaagggcgaaccggcggttccggccttcgcctacggcgaccgttccgcggaacccatcgaactgcctacgggcacctacacgctccgcgtttattcgggtgagacgcccgatgccgcatgggagggtaccgaaggaacgccgacttacggcaccgaacaggcgtttgtcatcaacaaaggtcaggtgaccgacctgggggagatcacctgccgattgctcacggtgaaggtttcggtcgcctacaaacagtcgctctacgacctgctggggcccgatacggaggctgatctggtgctgtcgggcaacgcgagtctgactttcctcaaagatgagaaacgtgccggatatctccgtccgttgccgggacaggccaattcgctggttctctacctgacgacggtctacgaaggcaaacagatcacccgccagccgctcaaagtcaccgataacgcccgtcccggcgagtggcgcaagatcacggtcgagctgctcaacggcgagaacggctccatcatcatcactgctaccatcgagaactgggtcaacggcgagacggtcgacgttgacgtacagcgtttggcggttctgtcggaggcttcgatccccgatctcaacgatccgaacgcaccccgcatcgagtggtcgaagagccatgccgtgctggaaggcgaggtgctgctgaacgacgacaagttcgaccagaacggctatccggtcgacgactacaacctcacgcttacgaccgtggctcccgcaagccacttcacggtggctcttgccagcgaaaacgcggcgttcctggaatacgcgcgcagtaacggcgtgtcgggaaccctcgatctgttcgaagtggagggacaggcgcgcacgacgctccgcctgtggggattcccggtcatgaatctgaccgtttcgccccgcacgttcgacatgaaagacctgatgaaggtgctcttcgactacgaaggccttcacacctttacgctcgccgtcaccgacgaggcgaaccgccggagcaccttcgaactgaaagtccgggtcgacaagtcgggcggagccgatccccgcatcgtttggagcggccacgacttctcgcaggaatacaaggtgacggacgacctcgaggtggagattcgtttcacggcgacgaagggcatcgaatcgctgatcgtggagatcgatggtgagttgggggccggattgccggatgtcggtttagtgccccgcttcgacctggtcgatcccgaaacttatcaggatgggctttccgcgagtctggaaggtctcggcttcccggtcggggacggagtgcgcggcaagacggaaatcctcttcccgattacgcgtttcctgccgctgatggggactttcaagggtaagacgactttcaggatgatcgtgacggacagcgagggacagtcggacgataaaacacttatgctcgtcgtcgaataa

SEQ ID NO: 1814 - DNA, 2382 bp, Unknown
  Artificiall/Consensus sequence
atgaaaacgatttaccaggcaatttcgatcgttctcgtcgccttgttcgcaagctgcaacagcgacgaaaccaacgccccggcaacgcccggcggcatgacccctgtccgattccaggccgcagtcgacaccgacgacaagacccgcgccaacatcgacgtggacggagaccggttcaccggaacgtgggaagagggggatgccatgggcgtgctctattccgtccccggaagctccgcattctcggaacccgggcggttcgtctacaacgacaacgcattcgctttcgagggcgagctccccaccgcgaccggcgagtggcagtacatggccttctacccccatgcagcggtcagcggaaacacggccagcattcccttcggaaacctgcggagccagaaaggcagtgagttcaactgtgcatcggacgccctcgtggccgaaatgctcggattcagcaatgccaagcaaggtgaaaccgacgaaggcgaaccggtgaaattccgcctcaaccgcctcacctcgatcctcaacctgtcggtacagggaggagcaggcgccggcgacgcggtccgccacatcctgctgacatcggagaacgacgggcagccgctctcggcccaaagcatcgacttcgacatttcgacgctgggagcggacgtcgccctcaacgccggggcacggtcgaacgtcatcgctctgggcttcgaccccggaacggctcccgcagccgacgcgttcgaagcttatttcaacatcctgcccggcaactacgaccgcctcacgttcgacgtcatcaccgaagcgaaacaaatcggcacggtgaccgtcacccgcgacgaccccgagcggaaattcgcagccggaatgctctaccggaaagaggccgccgacatcacgttccgaccggccgaagcgccttcgctcaactggccggaccgcgaactgaacgacgtgcacgagatcacggtggacgggaacgaaatcctgacctactctgcggcgatcacgatcgacgccccggcaggcatcgcagggcttcgtatcgaggtcacttcggaatttctcaacgacatgatgggtataaccggcatggatatcttcaatgacgaggccattcagtccaacatcggagagcttccgttctccgagctcgaactggcctgcacgacgcaggtgcagtacaagaaatccacggtgttcgacatcacccggctcctgccgatgatcctcatgggcggtgcggaaaacagcctgcacgtcttcgaagtccatgtgaccgaccttgccgggcaggagaccgtgcaaccgctgacctttaaggtcccggagtcggctccggcccccgccgaagtggtttacaacaacgacgccgatctctggaccaatacggccacgctgaccgtcagcaatgcggccctggcggcatccgtcttggaataccgggccgtcggcgacgaggggtggcaaacggcctccctgaccgccaacgaagacggcacgctcacggcgacgatcgcccccacatggaccccggtacagaacggagcgggacagaccgtgcaggcagtcgattcgaaaacgggcgttttcgcccaaaaggagtatcaataccaattgctggtcaacgaaaccaaagcagccgaagggacctttacgccggccaacaactcgggcgacgcaatccccgttttagccaccgacctgagctgttttacaacagacaacacggccgcagctttctggggcagcggaaacaactcgatggcatcgaaactctgcactttcagcagcccctatgcttatatgcaggccaacgagattatcggcatattggcccccggcaatcttttcacgggaacattcacgttcgtcaaacaaggttttctcggcgcgacctcttacggaacggtcggattcgggcaaaaatatacctatacggcgcgtccgacagcccttcaactgaattacaaagcttcattcgggtctaagatatgcactaaatacacccatgaaaatgaacttaaggagggtgaccacgaccaggcaagcgttatggtgtgcatcatcaactgggatgcgcgtcacggcgtaacctcgggcaacaacggagctccgacaggaagctgggacccggaatccctgaccggattgtccgacgccgaaaaagcgggtctgatcgcttacggagccgcttatccggatcaggatgcagccaacgacacactgctgaccatcccgctcaattattatgacaaggatgcgggaatcccgaccggcaactacacaatcatcatctcctgttcgagcagccgttacggggattatctgaacggaagcaaaaattcattctacgtgaaggatttccaatgggtctattga

SEQ ID NO: 1815 - DNA, 2067 bp, Unknown
  Artificiall/Consensus sequence
atggaggaactctatcgcgtcagcattcggggaggccgctatgaacgtgtactgggcacaccggcccaatggatatgtttgggcaatgacggaaaatcattcctctaccaggatcgcaaaggcggggaaaacgaatggcgcaagcaccacacctcttccgtcgcacgcgacatctggaattacgacaccgtttcgggtaaacatacccgcctgacgacctgggagggcgaggaccgcaatccccggtactcgccggacaaccgttccgtctatttcctgagcgaacgcagcgggagtttcaacgtctggaacatgcctgccgacaatccgtcggaagcccggcaggtgactttcttcaagacccacccggtgaggttcctgacgatctcccgcgacggaacgctctgtttcggctacaacggcgaaatatatacgttggacagcggctccccgtcgccccggaaactcgacgtaaaaatcgtccccggagaaccggcggacaagtatgcaagactgccggtcaaggaggggcatgacgtaaccgtttcccccgacggcaggcagatcgccttcgtttcacgcggcgagattttcgtgacatcggccgcatacaacacgacacgacgcataacgaccactgcggaggcggaagaaaatcccgatttcgccgccgacaaccgcacgctggcctacgcttctgaacgcgacggtcattggaacatctacacggcggcgatcgtccgggacgaagatcccgattttccgaatgcgacggtgctcgaagagaaaccgctgttcaaagcggggaaaaccgaccggacatgcccgaaatactctcccgacggaaaggaactggcctttgtggaagaccgctgccgtctgatggttctgaacctcgccagcggcaggacccgcaggatcaccgacggcgaacgggcgtattccaccgacggaaacatggattacgcatggtcgcccgacggcaaatggttcgccctcagctatacgggcaaccgtcatcacccctattccgacatcggcctcgtcagcgctcagggcggtccgatccgcaacatcaccaacacgggttatttcgaccggcagccggtatggtcgccggacgggaacgcgattctcttttcgtcggaccgctacggcatgcgcagccacgcctcgtgggggtcgctgcacgatgtcatgatcgtctacctcaaccgcagggcctatgagaccgcgcggatgagcgaggaggagtacgcattccacaaggaggccgaaaagcgttccgggaaggactgcgaaacaaaagactccgaaaaagagagtgattccccgaaagatatcatcgtggaactggacggtatcgaggaacgcatcgtacgtcttacgcccttttccggcaacctgcgcggatacacgctcgacaaaaagggcgaacatctctattactcgatgtcgtacggagccgcctacgacatctggcagctgaatctgcgcagccgggaaaacaaggcgctgcacaaaggactgggcggaacgcttgtctgggacggccggatggagacgcttttcagtttcgggcgcggaatgaagaagttcaaaaacggaaccggcgcggcggaaaccgtacagccgaacggcgtcctgcaactcgaccggcgcgccgagcgggcctatatgttcgaccgcatccgccgtcaggagcgggagcgattctatgaggagtcgatgcacggcgtcgactgggaggcgatgtgccgcaattacgaacgtttcctgccgcatatcgccaacgactacgattttgccgagatggccagcgaactgctcggagaactgaacgtctcccataccggatgccgttacagccgcccggcgagccccgatgacgacgccacggccgatctggggctgattttcgatttcagctaccgcggcgacggacttctcgtggccgaggtggtcgcaggagcgccgttcgacagggcgtcgtcagatgtcgaggccggagacatcgtggagcggatcaacggacgggagattccggccggagccgatttccatccc

SEQ ID NO: 1816 - DNA, 1530 bp, Unknown
  Artificiall/Consensus sequence
atgaaaaagagctgtttgtttgcggcgtccgccctccttctgctgctgggcggctgctacggcgacaaggggaattacgattaccgcgatatcaacgagatcgtcatcggggcccgggggttcgagggcgtggaatataaattgcgttcgggcatcgacgaactgaaaatcagcccccacatcacggcgtcgcaggacccggaactcacggggacttacgaatacgagtgggtggtcgtcggtcgggtccgcaatccgggtgagcgcaccacgatcgcccggacgcgcgacctggactatgccgtgaatctgcccagcgacgactattcgctgttgctgcgcatcacggaccccggcacggggctgatgttcagccgcagtaccgagatttcggtcagcacggcctatacgcgcggctggctggtcgctgcggaggacgaggcgggcggcaccgtcgtagacatggtgtcgatcagccgcgatacgctgctccagcgtgatgtggttaaggacgatacccgccacaagaatcccctgcgcatctggtgcgacaacgatgagtacacctcgctggcgcatggccgtatctacctctcgaccggggaggggagttttctctatgaccgcgaatcgttcggcacggacgactataccgtgatgcggaactatttcgccaatccccaatacctgacggaaaccgccgcttcggacatgatccagatcgacgacaagttccgtgtcttcctggtcgatggctatgcttatgtgtacagcatttcgtcggtcaatacgggctatttcggcaatccggtcaaccgctatgccgagagttacgactacgtgcgcatcggcgacaggatggcctacaacctgagcggcggcgccggcgccggatctatcactaccgtcatgctctataacgacgacgataagcgtttctgctacctgatgcgcaacaacgaaaccctgcgcaacgccaccgacaccgaatcggaccttgcgctgtttccctggcgaaccgggttggattatgtgacgaccgtcaattcgcgattcctttcggggcagtcggcgacgatcctccacgactcccggatcgggaaatactggatctacacctacgcctgtctgcgttccggtcccagcaaaggggcgcgttacgagatcgacgcttcggtccccgtggcagatgccgcgaactggtgcatgacttcgcagcacggctatatgctctactcggtgggcggggtgctctgcggctatgatttccgcaacgcccggaaacccgtgcagcttttggatttttcgcccgcggagattacgcaggtccacggcgacatccacaccgtttccgaaggcaataaggactatgtctatatctgcacctatgaggcgggcgttcccgacagcggccgcatccgcaagtatgcggtggcggataccgccgaccggatcgaactccaggcagacaaaaacaccgattggacgggattccagcgcatccgctcgctgtggttcaaggaactgtaa

SEQ ID NO: 1817 - DNA, 1734 bp, Unknown
  Artificiall/Consensus sequence
atgaagatgaaaaaattattttttggtttgttcgcatgcgcctcactgtgtgcatgctcgaacgatgaatcgggagtcattccggacgataccccgaaggttttcacgggagacgaggcgtatatcaatgtccggctcgccgatgcaggctcccttacgagggcgcaggaaggcgaattcgaatacggaacgaacgaacagtccgttaaaaacgtctttttctacttttacgacgccgacggcgtattcgtggcacaaggcgatgtctggacgggtggcaacgcctcgacgacaaaccctgccggcaacatcgaatttacgggcaacaacgtcgtcgtgctgaaagaactgggccggaagaattatcccaaatatatggtggcggtacttaacaaaccgacgggcttcctgtatggaaacacgctcggggagatgcaaacggtgcttgcggacgggaatgcggaaggcatttattatccctcgacggctaataatgtcacgaccgattacttcaccatgagcacgacgagctataccgaagccggtcggagcgcctatttcgtcacggaagtcaaagaggagaatttcttgcccgaaccgatgacggacatcaacgccattgccaatacggtgaccgtatatgtggagcgtctggcagccaaagtaaccctgaatgtgtccgggcagctcgtgaaggatgccaatgggcgttatccgataaaggccaccgtggcgggtgaagacaactcggccggaaacgacgacgttgcttcggaagagctttatgtcgaactgctcggatggaagctgaatgccacggcgaagagatcgtacatggttaagaacatagacgcaacctgggcgaacggcgatttgggctttacatggaaccggccgaccgactaccgcagtcattggggaaagtcgttcaactacggtctttcgggctatcccgacaatgcagcgggagtccccgccaactccgaatacctgaactatgtcgatttggaaaacggcctgaccgcattgggagcccccgcctattgccccgaaaacaccaacaccagcgcagtcgtaacggccgatttcccgtccgccgtcacgagcatcctgctgaaagccaaggtctgcgatgcgagcggcaatgcgctcgaccttgtgcgttacaacggcgtgctgttccggcatgactccttcctcgaatacgtgctcagcgtgctgaaagcgagaaaccaacacaccgtgtggtatgagaacggcaaggacgcacaaggcaatacagcatacacccagatcggcaaagagtatgtgaaattggagaatacgggcgacggagaagtgaaagcggtatttacgaacgagcttgaaatcccgttgtatgcggaggacggttccagttgctcggaggagatcatcgacgctcttaacgacgacctggccgccgcgtccgcaggcgccgtcgcttacaacggcggactgatgtactacaacattccgatcgaacacctcaacaacgacgctgcagaaaacggaactgttccggaggccaaatacggcgtggtgcgcaatcatcactacgtagtctccattgacaagttggaaaaaataggcaagggaatctttgacgggaacgaaaagatcgttcccggcgatccgaacgatgacacctattatgtcggtgcgaaaatcaatatcctctcctggaagatcgtcagccaaaacgtagaactttaa

SEQ ID NO: 1818 - DNA, 2178 bp, Unknown
  Artificiall/Consensus sequence
atgcatgcaaccatgaaaaaaacgctattatacgcactgatgcttctctctacgctcctctttccgggggcgtgcacgaaggaggccgacccggccgccgaaggcaagggggccgtcagtttctcgctcggcatgccccggtcgacgcgtgccggcgcttatgacgcctatccctggaccgaatgcgccattcgcgtctacaagtacacaggcacgggcgaggaccgtacccgggaacttatccgccgctattcgtcggtcggcgagatgccgggttcgatctggctgctggccggcgactactccatctccgtggagctgggcagccgggtcgatgcgactttcgacgaaatcttctaccgcggcgaaacggacttcacggtcgtttcgggccggcgttctgacgtgcaggtggagtgccgtatcgccaatacgatcgtcgaggtggagtacgacgagacggtgctctcgctcttcaaggaggagctgtggaccaacgtggtgctcgccgagcgttacaaccagcaggaggtggtgaacggcgaggtgatctatctccactacgaggagagcaaacccggctatttcatcctgcccgagggcgtggaggcgttcagctggcgtttccgcggcgtcggcaccaagcccggcgacgatacggaaaccgtggtgatgaaggacggcacgaaacacatttcgaccgctccgggcatgcgttacctgctgcgctacaaatattcgcccgatctgggcggttcgctcacgttcgagatttcggtcgacaccagcgtcgatgagaagaacgaccccgtgatgttcgctcccgatccgcaaatcagcggtttcggcttcgatatcgaaaagatgcaggagttcggctcggtgccggccatcagctataagataatctccatcggcaacctcgcatcggtgacgctgtcgtccggaggccggagctggcccgtcgggctcgatacgaccacggaatccgcagacggtatcgcggtaacgatgaacagccgttcggacatgatgcttacgctgggcgagaagttcttcgcgcagttccctgccggggatcgtacgctgacgttcctcgtcggggacgaggacggccgcagcaccgaaaagacctcggtggtgcgtacgcagggagtcgtgtcgtatacggcgaccgactgctggaacgacaaggccgagttgaaagcctatgtcttcgatacgtcggcttccgacgtgaaggtccgctaccgccggaaaggcgttgcggagtggagcgagacgccggcctcgcagagtccggagcgcggggtctacaaagctacggcgacgggcatcggcgccgcatccgaatacgaatgccagctctgcttcggagagaaggcgataaaccaaccctatggtttctcgacggcggcggggcctcaggttcccaatgccggattcgaggagtggtcgggttccagcccgctgctgccctatgtcaccgagcagtactgggattcgggcaatcacggatcgtcgacgatgagcaagaacgtgacgcaaaacgttgcagacccgcgccccggctctgcgggttccacggctgccgagttgaattcccagttcgtcggtcttgggacgttaggcaagttcgctgccggcaacctcttcgtcggcaaatacctcgggacggtcggtacgaacggtgtcatcggattcggcaagcctttcggtttcacctaccgtccccgtcagttgaagttctggtacaaaggcacggtcggtacggtggattattcgggcggcggtgtgaacaagggcgattccgacgcggcgcaggtttatatctgtctctgcgagatggacggaccgcatgtcgtcgatacccgcaaatccgacaccttcttcaatcctgcgtccaagaccgtcacctattgcagcggcgccctgaacaaggacagcaccaacgaccggaccgacggcaagatcatcgcctacgccgaatggatcaatacgaccccggagacgagcgaatggacggaggtgaccgtcgagttgcactacaacgaggagtacgagggaacggtgccgaattacctgatgctgaccgcttccgccagcaagtacggcgattacttcaccggttctaccgccagcatcatgtatctcgacgatgtggaactcgtttattag

SEQ ID NO: 1819 - DNA, 723 bp, Unknown
  Artificiall/Consensus sequence
gccgggcgtccggtagaaacaccggacggactgccgctgatcgatacccttacgaccgaaccctacctgctggccgacccgatgccttcgttcaacgggggcgggacgctcgacttttgccgctgggtgcaggagcatttgcgctatcccagcgaggcggtcatctacggcatcgaagggcatgtggtggtgagtttcgtcgtcggggcggacggcaaagtttcgaatgccgaggcgctgacgtcgcccgacccgttgctctccgaggcggcgctgttcgtcgtgcgccggtcgcctcgctgggagccgggaaagttgaacggccggcccgtgcgggtgcggctctccattccgattgatttcaaccttcagcggccgggcgtaaaacccacggtcgttacgcagctgccgaaattccagggcggcgggttgatcgacttcaaacactgggtgctccggaatgtggagttctccgacaagactttctaccgcggggacgagggttgggtcgaggtgtcgttctcggtgaacgggaaaggtaaggtgcgcggggtggaaacgacgcgcttcagcgatcccgatttcgcctaccagattcagcggacgattgcttcgtcgcccctgtggacacccctgagcactgacggcaagcagcacaatgtcgatttccggctgcgtttcgacctgcttttgcagcgtggtccggacgggctttattccgag

SEQ ID NO: 1820 - DNA, 1944 bp, Unknown
  Artificiall/Consensus sequence
atgttttaccgcctgctgtcacggcttggtgctgagaagtacctgtcgtcacgctacttttcgtcgtggctgatcctcgttatcgacacgtgtgtttcggtttttgccacctttatcgcgtacctgctgatacgcggtctttttccgaatccggttttcacattctggtacggattgtggctgcttgccggttcgtgtgtgctgagcgtcgttccgttcgtccttttgcggacgttccggagcatcatccgccattcgacactgcgtgagatatggaaactcggcgctgcggttctttctaaggacgttctgatgttcttctacgtccttctcctcacctcgaagacatctccggcttatgcggcgatttcgctgggttttctgctggacgctctggtcacgctgttcctgctgctggggcttcgcctctgtatgatcgtggtttacgacctgattaaactgaagcagacgcgccgcgacaactgccgccgggtgttggtttacggtacgggcgacaagtcggtgtcgttggttccgcggctgcagaactcgcctcactaccgtgtcgctggtttcctgacgtatggcaagcgtctgcggaatcatacggttgccgaatgtccggtctactatttcgagaatgccgaaagcatggagtatctgcgggaccgcttcgacatcgatgccgtgctgttcgccacgaacgacgatgcgcaggatgagcaggaacgtctgataaattattgtgcggagaaggggatcaaagtgttgatagtgccgccgatcgacgaggtgatcgacggtaagatcatgaagcagtcgatccgcgagatcaaaatcgaggacctgctgggacgtcccgagatcgagatttcgatgtcggagatcgaggcgaatttcgcggggaagacggtgctcgtgacgggcgccgcagggagtatcggctcggaattgtgccgccagctggcgacgttcggggtgaaagaactgattttgttcgacaatggggagacgccgatgcacaacctgcgtctggagttggaggaacgttatccgaaactgcatttcgagccggttatcggggatattcgcatcgagcggcgcctggacttcgcgttccggacctaccgtccgcaggtggtattccacgctgcggcctacaagcatgttccgctgatggaagagaatccatgcgaggcggtgttggtgaacgtggcgggaacgcgcaacgtggcggacaaatgcatcgggtacgacgtggagaagatggtgatgatctcgacggacaaggccgtgaacccgacgaacgtgatgggctgcacgaagcgtctggcggagatttatgtgcagtcgttgggactggccgtcggacagaacaagattccgggaaagacgaaattcgtgacgacgcgcttcgggaatgtgctgggctcgaacggaagcgttattccccgcttccgggagcagatcgccaaaggcggtccggtgacggttacgcatccggagatcacgcgtttcttcatgacgattccggaggcatgccggctggtgatggaggcggccacgatgtccgggggcaatgagattttcgtgttcgacatgggcgtttcggtgaagatcgcgcacctggcacgccggatgatcgaattggcgggcttcgaaccggaccgggatatcaaaatcgaatacacggggttgaggcccggggaaaaactctatgaggaggtattgtcgaacaaggagaatacgcttccgacgacgcacgaccgtatccggatcgctaaggtccgggagtacgactacgaagaggcccgggaggttaccgaggagctggaggcgctttcgcgtgccgtgagcatcccggacatgatccgcctgatgaagagggccgttccggagttcaggtcgaagaactcgaagttcgaggagtatgattgtcgatag

SEQ ID NO: 1821 - DNA, 1266 bp, Unknown
  Artificiall/Consensus sequence
atgaaatctgcatttaaatttttcgccctgtccctgttggccgggacgatgtttgccgcctgcggaggcgatgagaacgaaacggaagtaccaccaccacccagcccgattgaaattaccaacgaggtgaacggggttataaaggccggcattgccgacgcgatcgtcattacggggtcgggcttcgatgaaagtcaggactacatttatatcgcctatgacaaggaggacggcacaaccgtctatgatcggattccgaaagatgtgctgacgataaaagccacccgtatttcattcggcgtgaacgtcggtgccgcttacctcgacaagacggtgaaggtctatctcgaccgtccgggctatgacaagatcgcgatttcgggtgaaatcaccttctcgcttccgagcgttgaggagggttatattcccgatgtcgccctgcgcgccgtactgggcaatgccgataagaatccgaacgtggtattttcgccgctcgggctgctcgatgtcaataatgccgctacgattacgaataacggcaacggatacgctctcgacatcagcgattgcgcttgtacgtcgctggagggtatcgagcttttcaagagcgtcaccggtttggttccggcctggggtatgcccaatatcaaggagatcgacctttcgaaatgggaggccaaagggattgagttcttctgcgaacgggcggccagtctcgagaagtttgtcggtcctccctatgcctaccgcatccggacctatgacagccccaagctgacccatgtggacgtgcataactgcgactggctccggtggctggagatcagcaacttcgagaccggtggcggaattaatgcgcctaattcggccgtgacgtatctcgacatccgtcgcaaccagtccggaacctatgcggacacgccgacgaaggtcggggagatggcgatggtctggaacaatgccaaccagggtttcaatgtggccgataacgctacgatcctgatcgattcgcatttcctgatcgagcatacgctggagggcgcatggacgccgatctacaacgcgtggaaagaccgtggtgcgacgatcaaggtctattcgacgatcgatccccaccgcgacgaactgctgggtaccgttccttccgccaaggagatgcccgatgcacttgtcaatgcaaacaagaacggggatggctcgcccgcgaacaaatggcaggtggacgatccctacacggacaagaacgaagctccgggcaataaataa

SEQ ID NO: 1822 - DNA, 921 bp, Unknown
  Artificiall/Consensus sequence
atgagaaatcgctattttgcgcttgttgccatgtttgcgctccttgcaggctgctcctccgagaagggcgactcgcctgaagacggggttgaagggacttttagactgcacagttttctgcaggacggcatggtgatccagcagaaccagccgttccgcctgtggggcaaggcctccgctgcgcatgtgaagatcaccgccaagccgagctggacccggcaggaatacacctgcaaggccgatgcgagcggtacgtgggtgctggaaatcccggtgcctgcggcgccttcggatggcgccccgcagtcgatccggctctctacgccgctccagacgacctccctgcgcgacctgctgatcggcgaggtgtgggtcctgggcggacagtcgaacatggcgttcgccttggggcaggcgctcgacgcccccgccgagatcagcgcggcgaactatccgggcatccgctttttcaccgtgcagccttcgaatgaggcccggccgatcttcgactggcgcgaggagatgcccgaaccctacggcaaatggtactcgacgagtcctgcgacggccggggcccagagcgccgtgggctactatttcggactgatgctccaccgggaactgggcgtgcccgtcgggctggtcaacacctcctacggcggcgccacggcgcaggcctatacgccgctcgaggccctcaaagccgacagccggctgaagacgactttcgtcgacccgtatgcggccaatcccaatatggacgtgctggtgcgtcctgccgagctctacaacagcatggtccatccgttgttgccgctgtcggcccgcggcgtggtgtggtatcagggcgagggcaactggggcaactacgatatctatcccctgctgatgaagacgcttgtcggcgagtggcggcgcaac

SEQ ID NO: 1823 - DNA, 1194 bp, Unknown
  Artificiall/Consensus sequence
accctgctgggcaagtacggcgacgagggcgacaagctcctgttcaaaatcctcaattcaggcgactacgccgccggattgtcggacgaggagattcgctccgcgtcgaagatttgcgaaaagggcctgcgctacgacctcacggtgcctttcgcccgctacgtcgtccagcatcagggcgaactgacgttccccttcaaacgttaccagattcagcccgtgtggcgtgccgaccgtccccaaaagggccgttaccgcgaattctaccagtgcgacgtcgatgtgatcggcacacgctcgctgctgtgcgaggtcgagctggtggagatcgtcgaacgggtcttcaaagcgctgggcatccgcgtcgcattgaagatgaacaaccgcaagattcttttcggcatcgccgaggccatcggccatgccgacaagatgatggatattaccatcgccatcgacaaactcgaaaagatcggactggacaacgtaaaagccgaactgatggagcgcggattggaacaggaggcggtcgaaaaacttcagccgatactcgaattgagcggcgacaatgcgcagaagctcaatcagctgaaagaggtgctttccgtgtcggaaacgggcatgaagggcattgcggaaatggagaccgtcttcggctacgtggagcggctgggcatcgacctgacggtcgaactggacctttcgctggcacgcggtttgaactactacaccggcgcgatcttcgaggtcaaggccctcgatttcgccatcggctcgatctgcggcggaggtcgttacgacgacctgacaggcattttcggcatgcccaacacctcgggcgtgggcatctcgttcggcgcggaccgtatctacgacgtgatgacgggactgaacctctttcccgaggaggtcaactgctcgacccgcgtgttgttcgtgaacctcggagccgaggaggaagccgccgtgctgcccattctgcgcatgctgcgcagagaggagatcgcgtcggagatctaccccgaggcgggcaagatgaaaaagcagatggagtatgccaaccgccgcggcattccctatgtggtgatcgtgggctcgcaggagctcgaagcccgggccgcaaccgtcaaagacatgcgtacgggcgaacagcagcaggtgcctttcgatcaggtagccgattttgtaaaataa

SEQ ID NO: 1824 - DNA, 807 bp, Unknown
  Artificiall/Consensus sequence
atgggaattttgcgatgcaccatcctgttgctgtcgttgtcggccgtatgcttaccggcgtacggccggcacgatgagcccgctgcgtcggcaggcacggattcgccggccggcccggcggtcgaggagatgcggcggcagcgcggactggtggatatttcgcacgttttcgttcccgagggtcagtggatcttcggcggtacggcgtcgtattccgcacatgcgaacgacgactataccttttttatcgtcgagaagataaattccgacggctacacgttcaaggtaagcccgctcatcggctacgccctgcgcaacaacatggcgctcggcatgcgtttcgtctacggacgttcgctgctgaaggtcgattcgggcgaactcaacctgggcgacgaggagtcgggcacccacctcacggccgaatactactattcgctcaaacactcctactcggcagccgccatctggcgccagtacattcccctcgggcggaaccggcgtatcgcgctcttcaacgagatgtcgctgacgctgggtggccatcagaagaagttcgccgccgactcgcccgtgcgcggcacttacgagacgggctattcggtttcattgggcgtgtcgcccggcctgatcgcgttcgcgaccaacaccatggctgtggaggtcaacgtgggtgtgatgggtctcagttacacgcatgcgcaccaggaccacaaccgggtccgggagggcgatgtcaagtcgagtcttatgaatttcaagatcaacctcctgtcgataggactgggtgtgtcattctatctgtaa

SEQ ID NO: 1825 - DNA, 612 bp, Unknown
  Artificiall/Consensus sequence
ttggtggaaaataccgatcgggaggtgcattttttatgccagcggcaggcgttttcatccgcaacgggggatttttcgcccggcagctttggatttcggatttcaaaccctatatttgtgaaccgccgccgcggcaaaccagatgcggggcgggcacaacgtatgaaacgggaattgaaaatgggtgtcgtcgcggtgttggcctttctgatggccggctgcggcggaagcgataaaaaggaggatgcgatcaattacgacggctggatgctctccacctggaacggcggcacggagctctccggcaaggtcttcctgcaactcaacggggatatgaccttcgtgctttaccagtgcatcgacacgcccggataccagaaattgacgggcacctactcgatcgacgggcaggtgatttcgggcgtttattcctccggcataccgtgggaaagcagttacgtgatcgaaaagcagacgaagaccgaactgcagctgcgctcggagaaagagatcgtttcgctctatattgcggtggaggttccggcctatgcaaaggacggcgtcgttgcctccggcgttcgttcgtcgggagcggaaaagccgttcctctga

SEQ ID NO: 1826 - DNA, 1311 bp, Unknown
  Artificiall/Consensus sequence
atgtcggtctattttgctcccggtttttcgtccgtcacttccgaatccgaactgtgcaggctcgacagccttgcggatcggctgcaatccttgtgtgccgcagccggcggccgaatctccggcattttggtaaaagggtggacctcacccgaaggtgcagaccggctgaacgaacgtctttccgagagccgtgcccgcggggtggtgcgctatctggccgatcgtgcggctcttcccgactcgttgctcgaggccgggggcggcggggtggattggcagcatcttgcagaggaggcttccgcatgcccggatcttccggaccgcggggaggtgctccgcattctcgaaaatacgcccgtttgggtggtccgcaacggtcgggtagtggatggccgcaaacgccgcctggggatgctccatggcggaatcccgtataaccatctgtataaggaggcttttcccgctctgcggcgcgccgacatccgtgcggtcgtaagcggcggcccgcaatttccccccccctctcacgagcgttcctctgaaacctattccgacaatgtgcgtcagcctgctgccgctcctgcggattcgtgccgtcggtcggagcggtctgcggcagcggaggatgccgtaacggaggacgtggatgccgatgcgtcggcatcgcttccggcggaagatgcgccggaagggaattctgtgctggcgtccgaatccggaaacgcccctgaatccgcgtttgtcgccgaatctgctgccgaaccggccgtacgtgcaatgcgggagccgtgggtgggcctcaaaaccaatctgctgtatgatgcgcttctcgttccgaatgtcggaatcgaattccgttttgccgaccgttggtcggtgggagcggactatatgcacgcatggtggagcaacgaccggaaacaccgctactggcgttgctacggcggtgaggtgacgctgcgccgctatttcggcgcgacgcctttcaccgggcaccatgtcggcatctacggaacgatgctcacctacgatttcgagttttcgggaaaaggctggcagagcgacggattcagctatggcggcggcctggaatacggctattcgcttccggtggcgcgtcgtctcaatctcgacttttcgatcggcgtcggttatttcggcggccgttacaaggaatatgtcccgatggacggctgctatgtatggcagtctacccggcgccggcattggttcggacctacccgggcgcagatctctctggtgtggattctgggcggcgaacgccgcagcgggaaaggaggcgcgcgatga

SEQ ID NO: 1827 - DNA, 2298 bp, Unknown
  Artificiall/Consensus sequence
tgccacaagaacatggcggtggtattcatcaaccgtattgaaaacggccagtcccaccaggagggactgtgtctcaagtgcgcccgtgagctgcacatcaagcccatcgacgatatcatttccaaaatgggcatcaacgacgaagatctcgacgggctttcctccgaaatgatggaggccatgcagaatctctccggcagcggggacgatcttatgaacattgaaaacgacgacgacagctcggacgacgacgggaagaccgcaacgttcccgttcctcaaccggcttttcggcgcgcagaacgccgccaacgccgaaaatcgcgacagcgctgccgagaccgagcgtccccgcgtcggcaaggacggcggcgagcgcaagcccaagcgcaagtttctcgataactactgcatctcgctcaccgaccgcgcccgcgcgggcaagctcgaccgtatgatcggccgcagcgaggagctcgagcgcgtcatccagatcctcaaccgccgccagaagaacaacccctgtctcatcggcgagccgggcgtcggcaagacggcgatcgccgagggtcttgcgcagcgcatcgcctccggcgacgtgccggcgaagctgcgcgacaagcaggtatttctgctcgatctcacctctctcgtcgcgggaacgcagttccgcggccagtttgagtcgcgcatgaagggtctcatcgaagagatccgccgcgagggaaacatcatccttgtcatcgacgaggtgcacaatctcgtcggcgcaggcgacgccgagggcagcatgaacgccgcaaacattctcaagcccgcgctctcccgcggcgagattcaggtcatcggcgcgacgacgttcaacgaataccgcaagcacattgaaaaggacgccgcgcttgagcgccgcttccagcccgtgaccgtcgccgagccctcgctcagcgacagcgtggagattctcaagggcatccgcaagtattacgaggacttccacggcgtgaagatctccgacgagatgtgccgcatggccgtgacgctctccgagcgctacatcaccgaccgtttcctccccgacaaggccatcgacctcatcgacgaggcgtgctcggacgtgaatctccacaacaaggacatcgagcgcagcgctgagatcaaaaaggaatgcgccgatctcgacaaggagcgtgagcttttgctcagcagcacggcgggcgacggcgactttgaaaagctcgccgagctgcgcagccgcgatcttcagctcaaggatgagctttctcagatcgaagccaagggcatgccggagctcaccgcggacaatcttgcgcacatcatcgagctctggacgaagatccccgcttcaaacattcgcgccgacgagtttgagcgtctctccggtcttgccggacggctcaaggcacatatcatcggccaggacgaagccgtgaacgccgtttgcgccgccatcaagcgcagccgcgcgggattacagtccaagcgcaagcccgtgagcttcatttttgtcggctccaccggcgtcggcaaaacggagctcgtcaagcggctcgccgccgatctcttcaactcccccgaatcgctcatccggctcgatatgtccgagtttatggaaaagttcagcgtttcgcgcatcatcggttcccctccgggctacgtcgggtatgacgaggccggacagctcaccgagaagatccgccgcaagccctacagcgtcgtgcttttcgacgagatcgaaaaagcgcacccggatgtgatgaacatcctgctccagatcctcgacgacggacgcatcaccgacgcgcagggccgcacggtcaattttgaaaacaccgtgatcgttatgaccacgaacgcgggcagcgacaagcgcaccggcagcgtcggcttcaatatgagcgccgacgagcagggcaaggaaaaggctgtcaaggctctcaacgacttcctccgccccgagtttatcaaccgcgtggacgagatcatttacttccaccgtctgacggaggaaaacatccgcgcgatcgcctcgcttatgcttgaggatctccgcaccgcgatggccgagcgcggcaccgccctcacctgggacgagagcgtcatcacctatcttgccgaaaagggctacagcgctgcctacggcgcgcgcaatctccagcgtctcatccagaaggacgtggaggacgccattgctaccgagatcatcgatcatctcaagggcgcggcaaaaaccgtcgggctcaccgtacaggatggaaagatcgtcgttctcgcgatgtaa

SEQ ID NO: 1828 - DNA, 1410 bp, Unknown
  Artificiall/Consensus sequence
atgaagaaatttatcggaaacaaagacttttacaagctggtcgctgcgctcgcgctgccgctgctgctgcagaacgccgtatcgacgtttgtgaatctgctcgataaccttatggtcgggcggatcggcacggaatcgatgtcgggcgtgtccatcgtcaaccagcttctgttcgtatataacctatgtctcttcggcggcacgggcggcgcgggcattttcggcgcgcagtttttcggccgcggcgactataacggcgtccggcatacgctgcgcttcaatatcctgctctgcgccgggtttacagtgatcgccacggtgctgctcgcgctcatcccggatacgctcatcggtgcgttcctgcacgaggcgggcaccggcggcgatctcacgctcacgctttcggaaggcgaggactaccttcgcatcatgctcttcggtctgccggcgttctgccttacgacggcgtatgtgagcatactgcgcgtcaccggcgacaaccgcctgccgatgaaggcgagcatcgcggcgatcttcgtcaatctcgttttcaactatctgctcatctacggaaagctcggcttcccgatgctcggcgtccgcggcgcagccattgccacggtgctctcgcgctatgtggagttcggtctgatcctgctcggcacccacggaaagaaaacgccgccgcggtttatccgcgggctgtaccgcggctttgcgatccccggccatctcgccgggcagatcgtccgcaagggcatgccgcttctcgtgaacgagatgttctggtcgctcggcatgacgatgctcacgcagtgctactcctaccgcgggctggacgccattgctgcgctgaacatcaactccacggtgctcaatctcttcaataccgttatcttcacgatgggcaacaccgtcggcatcatcatcggcaacctgctcggtgcggaggagtatgaccgcgcgcggaattactgcccgaagctcgctgcgctcagctgcgcggccagcgcggcggtcggcgttgtgatgttcctcgtcgcgccgtatgccccgcggctttacaacacctcccacgagatcatgacgctcgccgcgtcgctcatgcgcatctgcgctctcatgctgccggtccacgccgtggtaaacgccgcgtactggaccatccgtgccggaggccggacgtacatcaccatgctttcggacagcgtgttcacctgggtcgtgtcggtatcgatcgcgtgggtgctcatccataaaacgggtctgccgctcgtggaggcgtacctctttgtgaatctcgccgaccttatcaaaatggtcatcggcatcgtgcttctccgccgcggcatctgggtgcgcaacatcgtcaccggcgaggagatcgcggccgggaatgctgcgggctga

SEQ ID NO: 1829 - DNA, 1416 bp, Unknown
  Artificiall/Consensus sequence
atggcagatctgaaaagcgtagttgcggaaaagcttccgctgacgatgggcgagacgatcgccctcgcaaaagaatacggcgtgcgcgtggtggacgttgtcctcacggagagcgagctgcgcaccggtcttgaccgcgaaggcgtgctcaaggccgtcatggaagagtatgcgcacaacctcaaggctgtggagatcggcgtttccggcggaaacagcttcctgctcggcaccgttcccacccagctcaaggaaatgggccccggcaccatctttgcggatgtgctgcttgacaaggcactcatgtacaccgtggccgccgaagtcggcaaccactgcatcggcgtgcgtccgtgcgccggcacgggcgacccctgcccctacaccggcttcctgcgcgcgctgatggatgtcggcaccgacgagaccactctcgccgaggtcgcctgcctcatgctcaaggtcggcagcctgttccgcgtggcgaaggtcaccaccggctgcaatctggaaggctacggcgcgggctctgccgccatcgccgccgcgaccgttcatctgaagaacggcacgcccgagcagatggaaaaggccatggtcctcgccatgtccccgacgatcggcgttccctgcacgccgcgcgtgctcgttccggcgctctgcaccgcccatgtcggcggcgcgatcctcggcggcatgtacgccggccgtctctgcacgaccgtggagatgaccgtcaacgtcccgttcgacgttatgttcgctatggcgtccctcgttcacaaggagagcgcgcaccacatcgtgcccaccgtcgtggagtacatggagcccttcttccagcgcaccgctgaggtcgaatccctcgtttccgaggaagtccacaaggccgacaagaagcgtattgaagagacgctcgaaaaggccaaggagatcgccaagaagatggcggacggctccgcccccatcatcaagacgctcggcgacgccgttgtcggcggttcctctcaggctgtcggcagcccgacgaactgcggccgcatcgcccacgagcttctcaatgagggcgagaaggtcaccgagatcaccatcgaactgtatccggagctcttcgcccgccgcacgatcaacgtgcccggcgtgctcatgggcgcggtgtacggctgctccacctccgactataagacctatgaggtcgccgtggagcgcgtcaaggccgacggcgtcaaggtgaacatcgtccgcggtgaagagtaccagatccagaaggtcactctcgtcaccgataagggcaacagcgttatggtcgatacgctcaaccgcggcggcggccgtctcgtgctgcgcaacgccacgccctctctcgagaaggcgcaggaagccgcgaagaagctcggcatcgttgttgtcgagtaa

SEQ ID NO: 1830 - DNA, 1026 bp, Unknown
  Artificiall/Consensus sequence
atgaacgttctcgttaccggcggcgccggatacatcggcagccacgcctgcgtggagcttctgaacgccggacattcggtcgttgtggtggacaatctcgtcaacgccaacgcggagtgcctgcggcgcgtcgagcgcatcaccggaaagacactcgaataccacgaaatggatcttttgaaccgcgcagctctcaatgagcttttcgatacgcaccggtttgactgcgtgctccactttgccggtctcaaggcggtaggggagtcggtgcagcagccgctgcggtattataacaacaatctcggcacgaccatccacctctgccagacgatggcggcgcacggcgtgaagaagatcctcttctcctcgtccgcgacggtgtattcgccggacaatacgatgcccgtggacgagagcgcccgcaccggcggctgcacgaatccctacggctggacgaagtacatgagcgagcagatcctctccgatacggcaaaggccgacggcgaatggaccgttatgctgctgcggtacttcaaccccgtcggcgcgcatccgagcggactcatcggcgaggacccgcgcggcatcccgaacaatctgatgccgtatatcgcccagaccgccgccggacggcgcgagtatctgagcgtattcggcaacgactatcccacaccggacggcacgggcgtgcgcgactatctgcacgtcgtcgatctcgcgcgcggccatgtcgcggcgatggactatatggcggagcggaagggtgttttcgtgttcaatctcggcaccggccacggctacagcgtgctcgacatggtgcatgcctttgaaaaggcgacggggaagaaggtcccctacaagatcgccccgcgccgcgccggagacgtcgccgaggtgtactgcgacccgggcaaggccgagcgggagcttggctggaaggcggaacactctctcgaggatatgtgccgcgacagctggaactggcagagcaaaaatccgaacgggtttgcggcagacggagagtaa

SEQ ID NO: 1831 - DNA, 2334 bp, Unknown
  Artificiall/Consensus sequence
atgaaaagaaccgcaaagatgctcaccgcggcgctgctcgcgctggcgctcgcgctgcccggcaccgccgccgcggcggacgatacgccggcggtgcgcatctccgaaatgatgtataaaaaccacgcgacactccaggacgccgacggcgatttttccgactggttcgagctggagaatacgtcgaaccgcgtcgtgcgcctcaaggggtggagcgtgtcggacggaaagaccgtctgggattttcccgcggacgcgacgataccgcgcggtggggtgcgcgtcgttttcgcctcacgcaaggataagaccgcggcgggcgaaagccacacgtcgttcgcgctcggcgagggggagacgctgtatctcatcgcgccgggcgggacgatcgccgaccgcgccgcgtgcgatcccgagctgcccgccgaccatgtgctgcggcgcgaaaacggcggcgagctcaccgaaagcgtctgggcgacgccgggatacccgaacaccgccgcggggtacgcggcgttctgcgagagccgcaaaacggaaagcccgctcgtgatctatgaggcggcggtctataacgacacgttcgctctcaagggcgagtattacgactgggtcgagataaagaacgtatcgaaagagagcgtgaagctctccgactactgcctttcggacgaccggcgggagctggaaaaatggtcgcttcccaaccggacactcgcgaaaggacagtcgatcctcatctactgcaccggcgaggagaacccgacgaccggcaacggcctgcgggcgaatttcgcgctcaacgcttcgagtgaaacgctctatctcacgaagaagggcgagagcgcggcggcggacttcgtctggctgcacgatatcccctacgggtacagcatgggccgcacggacgccgaaaacggctttttctatctccgcaggcagacgccgaacaagccgaacgagaccgacgcttaccggtatatctccgaagcccccacggcgaaccgcgaatcgggggtcttcgaagcggggcagaccgtgcgcgtgaagctcgccgcggcaggcgatatttactatacgaccgacggctccgcccccacggaggagagcacgccgtacaccggcgcgatcaccgtggacaaaacgaccgtccttcgcgccgctgccgtggaggagggcggcgcgccgtcgcgcgcgctcacgctcagcttcttcatcggcgaggagcacacgctgccggtgctcagtcttgtgaccgactcaccccgacggttttccgaaacatataacggcgccgtaaagtaccgcgaatgcgcggcgaatctctcgcttctcgccccggaaggcggtttttccatcgactgcggcgtggagctcaaggggcgcaccagtcttttcaacccgaaaaagagcctcggcgtttcgttccgcggctgctacggcgcggagacgctccgatacgacatcttcggtaaaggcccggcggagttcaccgagctttccatccgcgccgggcaggactatatctccacggtgttccgcaacgagctcatgcaggagctgtgtgccgagctcgatacgaccgtgacgcagcgcagccgctactgcgtgctgtacatcaacggcgaatactggggcatctactgtctcaaggacgatatcacgcggcagttttatgccaatctcaccggcacggcgaaggaagatgtgacgatgctgccctcgccggtgtcgcagagcacggcggtatataccgaggcgctcggactctggcaggacacctcgctcacacgccgggaagcctatgagcgcttctgcgaggccatggatatggacggcttcatcgactgggtgctgctcgagggctactgtgcaaacgtagacatcaagagcaatctccgttatttccgcaccggcgacgagccgtggcagatcgccttctacgatctcgactgggcgttccagacgaggagcaactgctttttcaatctcatcggctcggagcagaccgcgcagatcgccccgacgatccgctggctcttcggcatcgacgactttaaggagcggcttctcacgcggtacgccgagctgacggaaacgacgctctcggacgagcacgtcacggagaagatcgacggattccgcgcgctgctcgcgccggagatcgcgcgggagcgtgcgcactggggcggcagcgaggaaggctggaacgaacaggtggacgcgctgcgcgcgaacattgccgacgactacgccgcccacaccgtccggaacctctgcgacgctctcggcgtgggcgaggaggaacgcatggagtatttcggcttctga

SEQ ID NO: 1832 - DNA, 2271 bp, Unknown
  Artificiall/Consensus sequence
ttggatttgaaaaccgatgcgttggtcgaaagactcgtcaacagctatggcagctgggtgcagaaggactgcgaaaataccgaaggcggtaccggacgctataccagggagctctggccgtatgacacgatgttctcccccatccaggtcaaccgtctgacgatcaagaatcgtcttgtgatggcgccgatgggcaactgccagatggcggaagagaccggccgcccgaacgacaaaatgcgcgagtacttttttgcccgcgccgaaggcggcgtcggccttctcaccacgggcctcatccccatcagccaccacatcgactcatccgtgacggaaaagggcaacttctcctacttcccccgcatcgacaacacccgcaccaacttcatgggctggcgcgatctggcgcagggcgtccacgcgcgcaacagccgcattttcatccagctcaccgccggtctcggccgtgtcggcaacccgcagtgcctcatgacgaagtacgcgctgcccgtgtccgcctcctggaatccgaacttctatattccgagcattccctgccgtccccttaccgaccttgagctggaccagatcgtccgcaactttggtcagggcgcagcagacgccaagacgatgggcatcgacggcgtgtatctgcacggccacgagggctatctcatcgatcagctcaccaacaccgcgttcaaccaccgcaagctcggcaaatataccgactggcagctcttcggtatcaacatcgtcaaggagatgcgcaagcgtaccggtccgtggttcccgatcatgtaccgcatcgatctgagctgcgctctcgaagagacctacggcgagcgcatggacaccgtttcctccctcaagggcttcaagaacggccgttccatttatgaaacgctcgactatatggaaaatctcgtcaaggcgggcgtcgatatgttcgacgtggacctcggctgctacgacaactggtggctcccgcatccgcccgcgtacatgcccgccggctgcttccttgacgtggcgaaggtcgccaaggaatacttcaaggagcgcggcgtgaagtccaacgccggatttgaggttcccatcgtcgctgtcggcaagctcaactatcccgatatggacgagaaagccctgcgtgacggcaagtgcgacatgatcatgctcggccgcccggtgctcgccgatcccgactggtgcaggaaagcctatgcgggcgacgtggaccagatccgtccgtgcatcggctgtcaggaagcctgcgtcaacgagttcgtcgagggaggtcacccgcagtgcgccgtcaacccgcgcaccggccatgaggacgtgctgcccaagcagtccgcgcccgctgtaacggcgaagaagatcggcgtcgtcggcggcggccccgccggcatgaactttgccatctacgccgcgcagcgcggccacaccgtcgagatccttgagaaaacgagcgagctcggcggcattgcgaacgccgccgccgttcccaaaaataagtacgacatgcacaactatgtcgaatggctcaagcgccagacgctcgggcagaagggcgttgcggtgaagttcggcgtagaggccacgccggaatatctcaaggcgcagaactacgacgccgtgatctatgccgtcggcgccaagcgcatcagcccgcgcattcccggcatcgacaccgtgaacatggtcgaagcgaccgagcttctgcgcaatcccgaaaagctcggcggcgcgaagaaggtcgttgtcctcggcggcggcgcggtcggcatggagaccgcctactggctgagctacgagcacggctgcaggatcaccgtgatcgacatgctcggcaacttcatggacggcgcctgcaccgccaaccgcggccacatcatccactatcttgaggataacggcgcgaagctcgtcaactgcgcgacgatcaagtcgtttgagccgggcagggtgctcgtcagccgcaacatctccaagggcgcgccggacgtttactgcacctggacgccggttctgccgaagaacgtcgtcaacccgcttgcgccgaagatgggtcccgaaacggtcgtcgaagagcaccacgcggagctgttcgtcaacgcgctcggccgccgcgccgacgagagccagtatctcgagggcgtgaagcagcatgtcgccaaggagatctacaacatcggcgattccttccaggctggcctcgtctggggcgctaccaaagctgcctacaacctcgcgcagtacatctga

SEQ ID NO: 1833 - DNA, 2091 bp, Unknown
  Artificiall/Consensus sequence
atgcagaaaatggtaaaacccatccggctcgttgtgctcgccgtcgtctttgtgctgctgctcggcgtttacttcgtcgcgctttataagctgcagatcatcggcgggcgcgaatactacgccgtaggggaaacggagacgaaagaagacatcaccatcgccgcggcgcgagggaacattctcgaccgctacgggcgtctgctcgtgtccaactcgctctgcaacaacctgtctatcaacgtaacggagctcttcagccaggacgacccgaacgcggtcattctcgagctgtgcagcgccgtggagcgcttcggcgacacctataccgacacgctgcccatcacgaaggccccgccctttgagttcaccgagatggacacgctgcagaagagcatgctcgacgcctggctcaaggcgaacgacatgccgctcgactccagcgccgtggagatcctcgcggcgatgcgcacgcgctacagcgtcggcagcgagtataacgccgaggacgcccggcgcatcgtcggcgtccggtacgagatcaacgaccgcttcaacatcaacaccacgccctacgttttcgccgaggacgtttcgatgccgctgctcacctatctcatggagcaggacatccccggctttgagctctcctcctcctatgtgcgcgaatacaaaacgcagtacgccgcccacctgctcggctacaccggcaagctgacggcggaggaatgggcgacctacgccggcaaggactactcgctcgacgcctatgtcggcaaggacggcgtggaatacgcctttgaggattatctccacggcgtggatggcgaggcggaggtctactccaatctcgacggcgtcacgctccgcaccaagtacaccaaggagccgcagcccggcgggcatgtctatctgacgctggacatcggcctgcaggaggtgtgcgaggaggcgctcgccgcgcacatcgagtcgatcaacgaagatcgcgcccgcatcattgcggaagccgaaatgtacggcaccgagagcaccgaaatgatctccggcggcgcgctgtgcgtcgtcaaggtcgataccggcgagccgctcgcgctcgtgagctatccgacctacgacgccgccacgatgctggataattacgaaacgctcgtcgcggacgagaacgccccgctctataaccgcgcgctcatgggcgtttacgcccccggctccacgttcaagccctgcaccgctacggcgctgctcgccgagggcatcatttccccgacgcgcacgctgaagaccgaaggtcagttcaccaagtacatcgacgacggctacgcccccgagtgctggatctactcgacctacaaatacacccacggcgagatcaacgtcgtgcaggcgatcacctactcctgcaactacttcttctactatttcggcgacgagctcggcatcgacaagatggcgtactacgccaagctctacggtctcggcgagcacaccggcatcgagctgcccgaggtcaccggccagatgtccacccagagcttcaaggaacagtacaccggtatctcctggttccagggcgatacgctgcagagcgccatcggccagtcgttcaccgaattcacgccgctgcagatggcggagtattgcgcagccatcgccaacggcggcacgcgccacagcgcctccattctcaaggaagtgcgcagctacgattactccaaaacgctcttccagcgtgaaacggaagtgctcagcaagctcgatatcgatcccgagatcttcggctacatccagtacggcatgtacggcgtgctctatgacgccgcgagcacgctcaaggagcattggctcgacagcagcatcgtcgccgccgccaagaccggtacggcgcagcgcggcgaaggtctcgtcaacaacgccatgttcattctctatgccccctatggcgataaccccgagatcgccatcgcgatcgctgtggaaaaaggcggcgcgggcgccacgctctcgccggtcgcgcgaaagatcgtggattattacttcacgttccagtccagcgccaacactgtggaaaatgcgtattctctgctgaaataa

SEQ ID NO: 1834 - DNA, 1731 bp, Unknown
  Artificiall/Consensus sequence
atgggagctttttctgttgcacagcggcagatcggcggttataatgaaagtcgcaaaaagcataacatgcaacagtatatatatacggaggttgacgcgatcatgtacgataacggcaaaatctatctcggtctctccggcgaggagcgggtggagcttcccctctccatgtgcaaccggcacggcctgatcgccggtgcgaccggcaccggcaagaccgttacgatgaaggtgctggcggaatccctctccgatgcgggcgtgcccgtcttcctgtgcgacgtgaagggcgacgtcgccggtatctgcgcccccggcgcggacagcgaggatatgcagaagcgtatcgagcgctttgccctcaccggcaaatttgcctaccgcggctaccccaccacgttctgggacatttaccagaccggcggccatgccgtgcgcgccaccgtgagcgaaatggggcccgagctgctctcccgcattctctgcctgagcgaggcgcagacgggcgttctgcagatcgttttccgcgttgcggacgaccgcggactgctgctcgacgatctcaaggacctgcgtgcactgctgaactatgtgaacgaccataaagaagattaccgcatgaagtacggcaacatcaccacgcagtccgttgcggcggtcctccgcgcgctgctgccgctggagaaagagggcggcgagctgttcttcggcgagccggcgctcgacgtgaaagactggatccgcaccgacgccgagggacgcggcatggtcaacgtgctcgactgcgtcaagctcgtgcagaacccgacgctgtacgcgagcttccttctctggctgctctcggagctgttcgagaccatgccggaggtcggcgatcttgaaaagccgaagctcgtgttcttcttcgatgaggcgcatatgctcttccgcgacgccccggcggtgctcgtgcagaagatcgagcagaccgtgaagctgatccgctcgcgcggtatcggcgtgttcttcgtgacgcagagcccggcggacgtgccgaacaccgtgctcgcgcagctttccaaccgcgtgcagcacgcgctgcgcgcctatacgcccaccgagctgaaagcggtgcgcgtggcggcgcaggcgttccgcgaaaacccggcgttcaacgccgaggacgcgatcatggagctcggcgtcggcgaggcgctcacgtcgttcctcggcgaggacggcatccccgccatggtgcagcgcacgaagatcatctgcccgcagagcctgatgggtgcgccggaggcgatgacgcgcgccaaggcgatcctccgcgacggcatggaaaagtacgacgaggcggaggacaatgtctctgcttatgaggtgctcgccgacgaatcgcaggccgcggaggaggcgctcgcgcaggagcgggagcggctggaagaggaaaagcgcgccgccgaagaggaaaagcagcgccggaagcaggcggaggcagacgaaaagcgcgcgcagaagctcgaagacgaagcgcgccgccgcgcgcagaagctcgaggatgaggagcgccgccgcgcccagaagctcgaggacgaggcccgccgcaaggccgagcgcgaaaaggagaaaaaggaagcggaggaaaagcgcaaagccgaacgcatccgctccaagatcgaaacgcagctcatctccgccggcggccagatgctcaagcgcggtctgctcggtatcctgaaaaagtaa

SEQ ID NO: 1835 - DNA, 1197 bp, Unknown
  Artificiall/Consensus sequence
atgccccggacgccttttgctttatccgggctgcagcgggcggaaaggagaatttttatgtacatcaagccgtttgccgtagaggaatggatgaacgaatgggaggtcggcgcgcgatacaacatcgcggagacgtgcgtcgattccgtgtcgctcaacgagctgttcgcgctgaccggcgaggacaaggccgcctttctggagaatctcgccgcgcgccggctgacctacggcgacattgaaggcgcgcccgcgttccggcagggcatctgctcgctttataaaacggtcaagcccgaaaacatcgtcacaacgcacggcgcggcgggcgcgaaccaccatgtgttctgctcgctcgtatcgccgggtgaccgcgtcatcagcgttctgccgacgtaccagcagctctactccatccccgaatcgctcggcgcaaaggtaaagattctccccctgagccgcgaaaacgggtatctccccgatcttgacgcgctgcgcgcgctcgccgtgccggggacaaaaatgatctgcatcaacaaccccaacaatccgaccggcgcgctcatgagccgcgatatgctcgaagagatcgtgcagatcgcgcgcgaggcgggcgcgtacattctctgcgacgaggtataccgccatctctcccagaccgacgagtggagcgagtccattgcggatctttacgaaaagggcatctccgtgagcagcatgtcgaaggtcttctctcttgccgggctgcggctcggctggatcgccacgcgcgacaaggacgcgctccgcgcgctcgtctctcaccgtgattacgatctcatcagcggcggcatgatcgacgaggccattgccgcgctcgcgctcaagcacagcgataaaatgctcgcgcgcagccgcgccatcgtgcgggaaaatctcgccattctggacaattgggtcgccggagaaaagcacgcgagctacgtcaagcccctcggcggcacgacggcgctcgtctactacgatttcgacattccctcctatgagctgtgcgaggagatgtaccataagaccggtgcgttcgtcacgccgggcgactgctttgagcagccgaagagcatgcgcatcggctacgcctacggcaaggaagcgctcgtgaaagggctgaaggccgtgagcgagtactttgcgtggaaggaaaaggagctggaaaaatga

SEQ ID NO: 1836 - DNA, 1830 bp, Unknown
  Artificiall/Consensus sequence
atgtgtggaattgtaggatttaccggctcgcaggcggcggctccgctgcttctggacgggctgcgcaagctggaataccgcgggtatgacagcgccggcatcgccgtgcagaaggacggcgcgctgcatatgatcaaggcgtccggccatatcgacgcgcttgcggagaaaacacaaaacggcacgctgctgcccggcacttccggcatcggccacacccgctgggcgacgcacggcgcgcccaccgacacgaacgcgcacccgcatatgtccgccgacggcaaatttgccatcgtccacaacggcattatcgaaaactacgcagcgctgcgcgacgagcttaaaagcaagggcttcgtattccggagcgagaccgacacggaagtcatcgtgcatctgctcgacatgtactataccggcgatctcaaggccgccgtgctgcacaccgccgcgcggctcgagggctcctatgcgctcggcgttctctgcgccgaccagccggggacgatctgcgccgtgaaaatggcctcgccgctcattctcggcgtgggcgtcggcgaaaatttctttgcctccgacgtgaccgcgctcgtgagccacaccaaaaacgtgatctatctggaggacggcgagtttgctgagataacgcccaactccatttccatttatgacagcaccggcgcgacggtgcaccgcagcatttcccgcatcgtctgggatatcgaagccgcggaaaagggcggctacgagcactttatgctcaaggagatcatggagcagccccgcgcgctcaaggcgaccatcgccccgcgcatcaagaacgggaagatcgtcctcgacgattttgacgaggcgttccgcgccgacttccggtacatcaaccgcatcgtcatcaccgcgtgcggcagcgcatatcacgccgggtgcgtcgggcggtacatgatcgaatcgctctgccgcgtgccggtggaggtcgatgtggcgagcgagctgcgttaccgccacccgatcgtggatgagcacacgctgctcattgccgtttcccagtccggcgagactgccgacaccatcgccgccatccgcgaatgcaaggcgcacggcgcgcgcgtgctcacaatcgtcaacgtcgtcggcagcaccgtggcaaagctcggcgattatgtcatgtacacctgggccggcccggagatcgccgttgccaccacgaagggctacaccacgcagatcgccgtgctcgatctgctcgccgtatggatggccaacgagcgccggacgctcaccgcgccgcggtacgccgagctcgtcgccggcattgcggacctgcccgagcgcacgcagcgcagcattgacctgaacccgcaggtcagctatcttgccgagcgctactgcggcaacagctcgctcttcttcatcgggcgcaacatcgactacgccgtcgcgcttgaagcctcgctcaagctcaaggagatctcctacatccactccgaggcgtacgccgccggagagctcaagcacggcaccatcgcgctcatcgatccgggccgtctcgtcgtttcgctcgcgtgctacgaggaactgtttgacaagacgatgtccaatatcaaggaggtcaaggcgcgcggggccaaggtcctcgccgtggtgaacgagggcaaccgccgtgtgttcgccgaggcggacgacgtgctctttgtccccgtgaccgacccgctcttctccgccattccggagatccttcccctgcagcttttcgcctaccatgtcgcccggtgcaacgggtgcgacattgataagccccgcaatctcgccaaatccgtcaccgtggagtga

SEQ ID NO: 1837 - DNA, 1986 bp, Unknown
  Artificiall/Consensus sequence
atgagattcgctcttgccggaaaccagaactgcggcaaaacgacgcttttcaatcagctcaccggaagcaatcagcacgtcggcaatttccccggcgtcacggtggacagcaaaagcggcagcatccgcaacacgaagggcgacgaggtcgtcgacctgccgggcatctattcgctgcggccctattccgccgaagagatcgtaacgcgcgatttcattcttgacggccggcccgacggcatcatcaacatcgtggacgccacgaacattgagcgaaacctttatcttacgctgcagatgatcgagatgcaggtgccgatggtgctcgcgctgaatatgatggacgaggtgcgcgccaacggcggaacggtcgatactgtgaagctctcggagctgctgggcatcccggtcgtgccgatcagcgcggcaaagggcgaaggcatcgccgatctgacggagctcgcctgccgcacggcagccacggggcgcaagccggaggtatacgacttctgcccgcccggaccggtccaccgctgcatccacgccgtgacgcacgtggtggaggatcacgccgagcgcgcccggatgagcgcccgctgggcggccatgaacgtgatcgaggggaatagcgatatcgtcgcgcgtctcgcgctcgacgagaacgagttggagctgtgtgagcacagcatcgtggaaatggagcgcgaaacggggctcgcccgcaatgccgccattgccgacatgcggtattccttcatcgaatcggtctgcgccgaaacggtgaaaaaacccgaggagagccgcgagcggaaacgttcgcgcgccatcgataacgtccttacccaccgcatattcgccctgccgatctttgtcggcattatgctgctggtcttttatctcacgtttgaagtgatcggcgcgtttttgtccgacctgcttgccatggggatcaacgcattggcaggagtgacagacgcggcgctcacggcttacggcatcaatccggtcgtacactcgctcgttatcgacgggctgtttggcggcgtcggcaatgtggtgagcttcctgcccatcattgtagtgctgttctttttcctctccatgctggaggacaccgggtatatggcgcgcgtcgcgttcgtgatggacaagctcctgcgccgcatcggtctttccggaaaaagcgttgtgccgatgctcatcggctttggctgcaccgttccggcggtcatggcaacgcggacgctcacgagcgagcgtgaccgccgcatgaccgtgcttctcacgccgtttatgagctgcagcgccaagatccccatctattccgtgttcgtcgcggcgtttttcccgaagtataaggcgctcgccatgggcggactgtacgttttcggcatccttatcggcgttctggcggcgctcgtgttcggaaaaacgctctttcgcggcaaccccatcccgtttgtgatggagctgccgaactaccgcatgccctcggtgcgcacaacgctccagctcatgtgggacaaggcgaaggactttctccatcgcgcctttaccgtcattttcgtggcaagccttgtgatctggtttttgcagacgttcgacacgcgcatcaaccccgtttcggacaattcgcagagccttctcgccgcgctcggcggacttctcgcgccgctcttcgcgccgctcggttttgcggactggcgcgtatgcacctcgctcatcgcgggctttatggcaaaggaagccgttgtcagcacgctcggcgtgctcaccggcggcgcggcgctctccacgcttttctccgtgcgcagcgcggcggcgtttcttgtgttcacgctgctctatacgccctgcgtggcggcggtcgcggcgatccggcgggagcttgactcggtgtggaaaacgttcggcgtcgtggtgtttcagtgcctgctcgcctggggactcggcgcggcggtctaccagatcgcactgcttatttga

SEQ ID NO: 1838 - DNA, 3246 bp, Unknown
  Artificiall/Consensus sequence
atgagcggagggaataccatgacaaacgcaaaagaaaaaaagaagatcgtcctctggctgatcgtactggcaatactcgccgcggcggcattcacggtcacggccattgtgcgccataaccagcgcccggcatgggacggcggctacagcgtccacatcagcgaggtcatgaccgataataagacctgcccgaacggcgagggtgtcctctgcgactggatcgagatcgaaaacacgtcctcgaaggacttctccatcggcggatactatctctccgacgagacgggcaaaggcaaatactgcttcccggcggggacggtcgtcccggcgcggggatatctcgtcgtgtggtgctcgccggacgaggagggcgactatgcgccctttgccctgcgcaaggcgggcggggagacggtgtgccttatgaacgaaaaccgcacggtgctcgacagcgccgtgaccgctgcgtgccggagcgggcagtcgcttgtccgcggcagcgacggcgcgctcattcccgctgatacgccgacgcccggctacccgaacagcgaggcgggcgcaaaggcgtggcaggaggcgctcgcgcagcgcagcggcggcacgcttgagctcagcgagatacagtcctcaaacacgctctatgccgcgcccgacgggaatttctacgactggatcgaggtacataacccctcggattcgccggtatctctctccggctacaagctctcggaccgcacgaacaaaacgaagtacgccttcccggacgaaatgctcggcgcgggcgaatataagatcatatggtgcgcccccggtgtggagggcgcggaatatgcgtcctttgcgctggcgagcgcgggcggggaaacggtcgtgctcacagcgccctccggcgcggagagcgagagcgtggaactgccgatgctggagaagaacacggcctatgccaaggaaaacggtgaatggacggtgtctcaccgcccgacgccgggatattccaacgacgacgcggggtatgaggcgtggctgcgttccggcggctacgaaaacgacgaagtttacatcaccgaggtcatggcgcaaaaccgcggtacgctcgccgacagcgacggcgacctctccgactggatcgagatcgcaaacctcggcgagacgagcgttgatcttgcgggctggtatctctcggacgatccggacgtgccggacgaatggaagatcccgtcgctgacgcttgcgccgggcgagtatgcggtgatcttcgcctccggcaagaaccgcaccgagggtgagcttcacacgagcttctcgctcaccgacagcgacacggtcattctctccgccggaaacggcgcggagatccgcagcgtgaagatcgaggccgtgccggagggctcttcgctcgcgatgcagccggacggcagcttcgccgtgaccgacttcccgacgccggggcttgaaaataccgccgatggctacgccgacttctgcgatgccgacacgcgcacatcgccgcttctgctgtgggagatcgtcgtgtacgaggcgggttcgcccgactgggtggagctcaaaaacgtgtcgggcgagtcgatcgatctttccggatacacgatctcggataaattcaaggaaccggcactcgacgccctgcccgccgtgacgcttgcgcccggcgaaagctatgtgttcgagtgcgaaaacgtggggctgagcgcgcagtgcgacgagctctatctcttcgatgcttccggcacgctctgcgactgggcgttcctgcgcgatatcccggccggcggcagctacggccgtctaaacggggagaacgggtatttctattttgcgcagagcagccgcggcgcggacaacggcacggggtgccgcatggtggcggcaaagcccacggtcgatatcgccgcgggcgtgtacgacgacgccgagagccttacgctgacgatcaccggcgagaacgtgcactatacgctcgacggcagcgacccgacggcggacgatccggcttataccgcgcccatcacgatcacggaaacgacgatcgtccgcgccgcgagcttcccggcggacgcgctgccgggcaaagcggcgacatggtcgtatttcctgcgcgagaacagcacactgcccgtcgtcagtctcgtgaccgacccggacaatctcaccggcgcgcagggcatttactccaaccacgaacgcgcgtggagcgagaagtgggagcgcgaggcgaccgttgccatgtacgaggacggcggcgagttctccattgactgcggcatccgcatgcacggccgcacgagccgccgtgtgagcgaaaagaaatcgttcacgctcaagttccgcggccggtacggcggggatctcaattacgacgtgttcggcgacggcgtcgtaacggacttttcctcgctgctgctgcgcgcgagcgtggaggatacctacacctcctacatgcgcgacgagttcttcgcccgcatcgctatggactatacggatgtgcccgtgcagaattaccggtatgtttcgctcttcctcaacggcgagtactggggcatttacgccatccgcgagcaccacagcgcggaatatttcgcctcgcacaagggcgtggacgccgacaccgtcgatatgcagacgggcgagtttgagggtcagaccgcgtggagcgagatcctgaactacgcgcgctacaactcgctgagcacgccggagggctgggcgtacatccaggagcatgtggacatcccggagatgattgactggctgattctcgagtgctggtcgggcgatatcgacgtatacgaaaacgtccgtttctacgcgagccccgagtacgaaaacgggaagtacatttacggtctcgcggacatggatctcacgatgatgggcatggactcgatgagcgtcggcttcaacaacttccagctccacggcatcattccctcggcgctgcgttacaatgaagagttccgcgacatgttcctgacgcgtctcggcgaaatgctgcgcgggccgctctcggacgagaacgcgcagaaaacgctcgatgagctgcgcgcgatcgtcgagccggagagtgcgcgcgatctcgcccgctggggcaagtcgtccacgttgtttgccacgcagatggcgaatctccgcggcttcgtctccggccgcgccgcgcggatgcagaacgaggccatcgccttcttcggcgtctccgccgaggatgccgccaaatacttcggataa

SEQ ID NO: 1839 - DNA, 1383 bp, Unknown
  Artificiall/Consensus sequence
atggaggaaacaaacagcctggcccggtcccgacgcatgggcgaaatgccggagggaaagctgctgctgtcaatggcagtgcccatgatgctctcgatgctggtgcaggctctctataatattgtggacagcgtatatgtggcgaaggtgtcggaggactgcctttcggcgctctcactcgcgttcccggcgcagaacattctcatcggtcttgccaccggcacgggcgtcggcgtttcgacgatgctctcccgcgctctcggcagccgggacaataagctcgccaaccgcgtggcgggaaacagcctgttcctctgcgtgtgctgctggattattatggcgatcttcggtattttctttgccgacgccttcatccactcgcagacggatatcgagtccatccgcagctacggagattcgtatctgcgcatcgttacgatcggctccgtattcgtgtattttgagatcaactttgagcgccttctgcagtccacgggccagacgaagctctccatgtgggcgcagataatcggcgcggtggcaaacatcattcttgacccgttctttatctacggctggtgcggcctgcccgcgatgggcaccaccggcgccgccatcgccacggtcatcggccaggcgttcggcgcgctggcgggctttctgtttcacctcaaacataataaagaagtcaatatccgtctttccgactgccgcccggacgggcacatcatcctcgacatctatcgcatcggctttccgtccatcctcatggtcggtatcggttcccttacgaactatctcatgaaccgcatcctcatggcgttcacgtccacggcggtcgcgttgtacggcgcatacttcaagctgcagagcttcttcttcatgccggtgttcggactgaataacggcattgttcccatcgtcggctataactacggcgcgcggaaaaaagaacgcatttaccggacgatccgctacggcgtgctgtatgccgtgtgcatccttgctgtcggcctgctgctctttgaagcgattcccggcgtgctgctgcaggcgttctcgccgtcggagcacatgcttgccatcggcattcccgcgctgcgcaaaatcgccatccatttcccgatcgcggcgttctgcattgtgggcgggtcggtctgtcaggcgctcggcaagagtctctattcgttcttcacgtcggtgctgcgtcaggtcgtggcgctcatcccggcggcatatcttctgtcgctgacagggaacgtcggcaacgtatggtggtgcttcccgatcgcggaggtcgtatcggcgtgcgcaacggcgtttttcctgcgccgcgcgctgcgaaatatggaccgggagctgacgttcgcggaggggcaatga

SEQ ID NO: 1840 - DNA, 1503 bp, Unknown
  Artificiall/Consensus sequence
caaaagacctttgggaggtttatccgtatggacaatacatggtttgagaaaatggaagagcgcatcccgcgcggcgaggtacgcacccgcttcgcgccgagccccacggggtatatgcacgtgggcaatctgcgcacggcgctctacacctggtgcatcgcccgccacgcgcacggcaagttcctgctccgcattgaggacaccgaccagtcccgccaggtagagggcgcggtcgaggtcatttataaaacgctgcgcgactgcggtcttgaccacgacgaaggccccgacgtcggcggtccggtcggcccgtatgtgcagaccgagcggcgcgacacctatcttccctacgccaagcgcctcgtggagcgcggccacgcctattactgcttctgcgacaagaccgaatccgaagaggactccggcgacttcactcgcaaggacgacccctgccgcgatctttccgcggaagaggtgcagcgccgtcttgacgccggtatgccgtgggtcatccgccagaagatcccccacgagggcgaaacgacgttccacgacgagatcttcggcgacatcaccgcgccgaacgccgatctcgacgatcaggtgctcatcaagcgcgacgggctcccgacctacaacttcgcaaacgtcattgacgatcatctcatgggcatcacccacgtcgtgcgcggcagcgagtatctctccagcgcgccgaagtacaaccttctgtacgaggggctcggctgggacgtgccgagctacgtccactgctcgcccgtcatgcgcgacgcgcacaacaaaatgtccaagcgccacggcgacccctcgtacgaggatcttgtcgcgcagggcttcctcaccgaggcgatcgtgaactacgtcgcgctcctcggctgggcgcccggcggcgagcgggagatcttttcgatcaacgagctcgcggaggcgttcgatatgtcccgcatctcgaagtccccggccattttcgatatcgaaaagctcacgtacttcaacagcgagtacatcaaggccatgtcccccgaggcgtttgcccgcgccgccgagccgtggatccgcaaggccgtcaagaccgaaagctgcgatcccgccctcatcgccgccattttgcagcagcgcaccgaaaagctctcggacattcccgaaaagctcggcttcttcgatacgctgcccgagtacgacaccgcgctttacgtccacaagaagtccaagtgcgacgagactgtcgcgctcgatatgctcaaaaagatgcgcccgcgtctcgcggccatcaccgactggacggaggaggccgtgcacgactgtctgatcggcgcggcggcggaattcggctgcaagaacgctctcgtcatgtggccggtgcgcatcgccgtttccggcgaggccgtgacgcccggcggcgccgtggagatctgccatatcctcggccggaccgaaacgctcgcgcgcatcgacaagggcatcgagaaactggaaaaatga

SEQ ID NO: 1841 - DNA, 1251 bp, Unknown
  Artificiall/Consensus sequence
aattttatggaagaaagacgggaaacgaatccccgcgtaaacttccttatcaacattgcgtactgggcggtgatcgttgcgatcatcttcctggtgttcaagtacctcatcaacataatgatgccgatcttcctcgcgttcattttcgcggcggtcgtgcgtccgatctcccgcgcgctgagccgggaaacgcgctatgtccgcggcaaggacgggaacaaggtcctcgtgaagcggaaattccatatgaaccgcaatgtggccggcatcatcagcgtgcttgttctgttcatcgtcgtcggcggccttctgacgctcatcgtcgtccgcctgaccgatacgatcgtggatttcgtgtcgttcgcgccgacgttttatgaacagagcgtcctccccggcatcacaaagctctataactgggtgctggaggtaggcgaacggttcgatgtgtccatcatggacgctattgagcaggccctgcccggcatgatctccaatcttggcagcgcggtcaccaacctctccggcaagatcgtcagcggcgtcaccggcattgcgagccgcctgccgagcatattgctcaacagcatcatctgcctgatcgccacggtctttatttccgtggactttgaccgcatcaggctcttcattcggaaaaacctgcccgaaaaaccgctgcgcgttgctgtgaatgtcaagaactcgttccttgagatgatctggcagttcatcaagtcctatgctatcatcttctgcatcaccgtggcggagatcaccgtcggccttctgatcgtcggcgtggggaacccgctgcttttcggtatcctcatcggcatttttgatgcgctgcccatcgtcggcagcggcatgatccttcttccgtggtcgatcatcacgcttctcaccggcaacacgatgcgcggtctcggcatcctcatcatctatgccgtcgttgtaatcgcgcgccagatcattgagccgaagatcgtcggcaagcacgtcggtctgcgcccgatcgtaacgctcacgtgcatgtacgccggttccaagctcttcggcggtcttatcggtctttttggtctgccgatcaccgccgccattatcatggatctcaactcgagcggtattttccatatcttcaactccgtgggggatgacctgaacgacggggacgaaacgggagccggcgaagcggaaacaggcgaagccgggacgaacgaatccggaacggacggagagaaaaacgcatga

SEQ ID NO: 1842 - DNA, 2781 bp, Unknown
  Artificiall/Consensus sequence
atggataagcagaccaagtccggaatgcctgtggacgaaagcaagtattcctttacgatcccccgcacggacgagccgagagagaagatcctcaagctcggcgcgatgatcaccgaccgcatcggcaaggtcacgggcaacgatcccgagtattggggactcgcgggcgttgttacggacgaaatggcagatgtcgcgctcaagatgaaggtgcgcaagccgaaaacgaccgcgcagatcgccgcgctcaccggcaaaagcgaggaagagctcgaaaagctgctcaccgagatggcgtacatcggccttgtcgagtacaactgggaaaatctggacgggaaaaacccgaaccacgagaagcgctggacgctgccgcagttcgttccgggcagcgcggagttcgtcaacatgcgccagtcgcagatcgacgagcacccggaggtcgcggcgttctttgagcgcatgacgttcctcccgctggagaaggtcacgccgatggtgcctcccggaggcgccggcatcggcatgcacgttatccccgtggaaaaggcgatcgagaccgagaacaagtccgtctccatcgagcacatctcccactggctgaaaaagtacgacggtgtttacgccgcttcgccctgctcctgccgtatgtcccgcgccaagctcggcgagggctgcggcgacgatccgcaggactggtgcatcgccgtgggcgatatggcgcgctacgtcgtcgagaccgaccgcggccattacatcacctatgacgaggtgctcgagatcctgcacaaggccgaggagaacggctttgtccatgagatcacgaacatcgacggcgaagagaagatcatcgccatctgcaactgcaacgtgaacgtctgcaacgcgctgcgcacgagccagcttttcaacacgccgaacctctcccgcagcgcctacgttgcgaaggtcgagagcgaaaactgcgttgcgtgcggccgctgtgttgagacgtgtcccgcgggcgcggtgaagctcggccagaagctctgcacgaaggacggccccatcgagtacccgcgccacgagctgccggacgagacagcctggggcccggataagtgggacgtcaactaccgcgacaacaaccgcatcaactgctacgataccggtacatccccgtgcaagacggcgtgcccggcgcacatcgccgtgcagggctatctgaagctcgccgcgcagggcaagtaccgcgaggcgctccagctcatcaagcgcgaaaacccgttccccgccgtatgcgggcgcatctgcaaccgccgctgcgaggacgcctgcacccgcggcaccgtcgaccaggccgtcgccatcgacgaggtcaagcgcttcattgcccagcaggatctcgaagccgccacgcgcttcatccccgaaaaggtcatcccgaaggtcgagggcggattcgatgagaagatcgccatcatcggcgcggggccggcgggcatgtcctgcgcgtacttcctcgccgagaagggctaccgcccgaccgtgttcgacaaatctccccgtcccggcggcatgctgatgaacgccattccgaacttccgtctcgaaaaggacgttgtggaggccgagatcgacattctgcgcgagatgggcgtggaattccgctgcggcgtggatgtcggcagggacgttaccatccccgagctgcgcgcgcagggctacaaggggttctatgttgccgtcggtctgcaggacggcggacgtctccgcgttcccggcgacggcgccgagggcgttatgtccggcgtggactttacaaagaaggtcaatcttgcacccgaaacgaagctcaccggcaaggtcgttgtgatcggcggcggcaacatcgcctccgatgtcgcccgcaccgccgttcgctgcggtgcggagagcgtgacgctctattgcctggaggggtacgacgaaatgcccatgggcgaagaggaccgcaccgagtgcgagcgcgacggcatctccatccatgccggctggggccagaccgcgatcgacaccgagaacggccatgccagggccattcgcttccgcaagtgcctgtccgtcaaaaatgccgagggccgcttcgcccccgcgtttgacgacgcccggaccgagactgccgaggcggacacgatcctttactgcatcggccagcacgccgactggggcgagctgctcgccggaacgaaggtcgaattcaaccccaacggcaccgtcaaggccgacccgctgacctaccagactgccgagcctgacatcttcgtcggcggcgacgcctacaccggccagaagttcgccattgacgccattgccgccggcaaggagggcgccgtgtccctgcaccgcttcgtgcagccgaacacgagccttaccatcggccgcaaccgccggcagttcatcgagctcgataagaaaaacgttcttctcgatatcaacagctttgacaacacgccgcgccagcgtcccggctacaacgaggagctgcgccgcacgatgcaggacggccgcgtgtgcttcaccgaggagcaggtcaaggccgagaccgcccgctgcctcggctgcggcgcgagcatcgtcgatccgaacaagtgcatcggctgcggcatctgcacgacgcgctgcggctttgacgccatccgtctccaccgcgagcgtcccgagtgcagcaccatggtgcgcagcgaggacaagatgaaggccatcctgccgtatatgctcaagcgcgccgtgaagatcaagctcaagggcaaaaagggctga

SEQ ID NO: 1843 - DNA, 1506 bp, Unknown
  Artificiall/Consensus sequence
atgaagaagctgctcgctgaccttttcaaaaaaaaagaaaaaagccgccacgccgcagccgccaagaaaccggtgcgcctgccgcgcctgcgcgatatccatttccgctccatccgcgcccgcggtatgttcgtcggaagcggtcttgtgctgctggcgatcgttatttcgctcgcagcgtatacgctctcgctgcaggcgtattactattccgccacgcgcgcctcgctgcaggcaaaggcggagaccgcttcggcgttcctttcgtcctatgtggaccgcacctacgcggagttttatcagcgcgccttcaactatgccgagaattttgacgacaaggattcgctcgaattgcagttcgtcaacaccgagggacgcgtagagatcgcctccaccggcatttccgccggttcgatccccggctcggatgatatcaaaaacgcgctcgactccggcaggatcagcttctggcagggcaagcgcgcctccacgggggaaaaggttctcgccgtatccgcgccgctcgtttccggcagcgggagcgtcgtcggcgtgatgcggtatatcacgagtctcaagctcatcgaccgcgcggtgaacacctcctcgctcgtcgcgggcggcatcgggctcgtggtgctcgcgatcgttgtattctcgaacctttactttctgcgcacgatcaccgagccgatcgcttcgctcacgggcgttgcccgccgcatcgccgaaggaagctacggcgcgcaggtggaaaaaacgcacgacgacgagatcggagagctgaccgacgcgatcaacgatatgtcgcagaagctctcgcaggcagaacgtgtgcagacggagttcatctcctccgtttcccacgagctgcgcacgccgctcaccgccatcaccggctgggcggaaacgctcgcctacgacgaggccatccggggcgactcgcgccgcggcatcgagatcatcacccgcgaagcgggacgccttaccaaaatggtcgaggagctgctcgaattcacgcgcattcaggacggccggtttacgctgcacgtttccacggtggagctgccggcgctggtcgaggattgcctttatacctataatgaacttttccgccacgaagatctcgccgtgacctatgtttcgccggaggaagaccttccggagattcccggggaccccgagcggctctcgcaggtgttcctcaacattctcgataacgcctgcaaatacggcaaaaacggcaaaaagatcgacgtgaacatcacgcacgacgacgcgaccgtctccgtatgcatccgcgactacggccccggcattccgccggcggagctgccgcaggtgaagaagaaattcttcaagggctcctccaaggaacgcgggagcggcatcggccttgccgtgtgcgacgagatcgtcacgcggcacaacggcacgctcgatattgccaccgccgccggcggcggcgtgcgcgtcacggtgacgctgccgcgcaaggcatcttaa

SEQ ID NO: 1844 - DNA, 1872 bp, Unknown
  Artificiall/Consensus sequence
gtgttgaaccagaacgaaaaagaacttttatatagaataaacagcaatgccgatctccgtgccgtaccggaacgggacattccggagctatgccgggacatccgcgagtttcttgtggaaaacgtgtcgcacaccggtgggcatcttgcctcgaatctcggcagtgtggagctgacggtggcgctgcaccgcgtctatgacccgatgaaggaccgcatcctgttcgatgtcgggcatcagtcctatgtccacaagattttgaccggtcggagagattccttcgatacgctgcgccagctcgacggtatttccggctttcccaagccgtgcgagagcaacgccgatccgtttcttgccggacacgcctccgattccgtgtcgctggccgcggggatggcacgagcccgaacgctcatgcacggaaattacgacgttgtcgccgttgtgggcgacggcgcgatgaccggcggcctgtgctttgagggattgagcgatctcggtgcgagccgcgaggctgccgtggtcgttctcaacgacaacggcatgtccatcaacgaaaatgtcggcggcgtggcgagattgctccgccgcgcacgcacgcgccccggatatctccgcttcaagcggacgtaccgccgtgttatgaaaaagcacccgcacgcttatgaagagctgcaccggctcaaggagcgcatcaaagcgcgccttctgccgtccggtatatttgacgatctcgggttttactatatcgggccggtggacggccacgatgaaaaggcgctcgaaacgacgctgcgctgggcaaaggatcttcatcgcccggtcgttgtgcatgtggtgacggtgaagggaaagggctatgctcccgcggaggcggacccgcagacgtaccacggcgtcaacccgttcgatcggaagaccggcgtcatgaccgttccggccaacgatttttctgcggcattcggcgcatcggcgattgcgcttgcggaaaaggatccgacggtctgcgccgttaccgcggcgatggaacacggcacggggctgtccgaatttgcccgccgttttccgaaccggtattttgaactcggcattgccgaggagcatgccgccgcgatgtgcgccggcatggcaaagcaggggctgacgcccatttttgccgtttactccacctttctccagcgctcttacgatatgctcatcgagaacatcgggctcatggggctgcatgttgtgcttgccgtggaccgcgcggggcttgtcgggcgcgacggcgtcacgcatcagggctcttttgatatcgcgtatctcggctccgtgccgaatatgaccgtatatgctccggcgagcttctgcgaactggactccatgctatccatcgccgtgcgtgaaaaatccggtcccgtagcgctccggtatccccgcgggggagagggcgcatatactgacgaccactcccgcgaggattcgaccgttctgcgcagcggcggcgatgtaacgatcgccacctacggcatcagcgtcaacgcagcgcttgccgcggcggaaacgctttccgccgacggcatccgcgccgaggtcatcaagctcaaccggctgctgccgctcgctccggagaccgtccgtgagtcgctgcggaaaaccggacggtttattatggcggaggaagcctgccgctccggaagtcttggtacgcttcttcttgcagacgccgcggcaaacggcatttcgctgcgcggcgcccggctgctggatctcggcagcggcgttattaagcacgcttcggtccgtgagctgcagcactgcctgcatctggatgcggatggcattgccgccgcagcaaaggagatactgcatgaaaaagatccggcttga

SEQ ID NO: 1845 - DNA, 1500 bp, Unknown
  Artificiall/Consensus sequence
atgaaaaaacgccttctttccctgctgctgaccgtatgtctcgttgcagcgctcttcaccggtctcaccggcacggcgaacgccgccaacgacaaggtcgtgggctatcttacgagctatactctcaaagcgggcgacacgatctacggtgtgtgtgaagcgaaaaagatcgacttcaacgccaacctcgccatgatcggcaagatcaacggcatcacgaactacaactacatgatgcccggcaaggtcctctggctgccgacgaagacggccacgacttcggagtcgtattattctctcctctcgcacacgctcgtcgccggggagacgcctgccgcgctctgccagagctacggcattgactacaacgccaactacaagctgctcgccgcgctcaacaacaatctcaatgtgttcatggcaggccagcagttcattctgcctctgtacgtaacgcctgccggcgccgcgacgccgactccggcgccgacctccggcacctctgccgcgccgaccgccacgcccaaacccggcacgacgcccgccccgacggcgaacgttcccaccggcgacacggtgagctattatctcgcgcagcacacgctgcagtacggcgaaaccgtttccggcgtctgcgccgcgctcggcgtggacttttcctcgaacgatgcgacgatccgcaagatcaacaacatcaccaactacaactatatgatgcccggaaaggtcatcctcatcccgacgaaaacggttccgggttccggttcttactacaagatcatggcgcacaagatcgtctccggcgacacgctctacgcgctctgcgcctcctacggtctggattactacgcctattccaagctgatctccctgctcaaccccaacgcggcctattataacctgctccccggcaacattctctatatgccgcagtatgtcgccgcctctacaacggtgaagcccgccgcaacgcccgcgccggccgcctctgccggtacgacgaccgccccggctgcgacgcctgctccgagcgcgtctgccggcacaacggcttccgctgcgccgagcgccacagccgccgcttccgccaagcccactacgacgcccaacatccccgccgaggatacgctcagctatctcatcatcccgcacaagatccaggccggcgacaccgtcatgagtatctgcgataaatacaaagtggacttcgctgcgaacgacgccgcgatccagcgtctgaacccgagcgtgagctacagctacctgctccccggcaacattatcctcatcccctcgaccacgtacccctcctccggtccgtattacaagatcatggcgcacaagctcgtcgcaggcgacacggtctacggtctctgcctcacctacggcctgagctatgagaacaacatcaccttcctgcagcggctgaacaaccgcgacaatctcgccacgtactacgtcggccagacgatctacatgccgctctacgttgccggctga

SEQ ID NO: 1846 - DNA, 2268 bp, Unknown
  Artificiall/Consensus sequence
atggcaagaaagaaggaaaacccgacgccgcgccacgcgacggccgaggaacagaacgtaatggggctgcgctccgccgttgtggagcagcccgtcaccgaaacgctcgagaacaactacatgccctacgcgatgagcgtcatcgtctcgcgcgccatcccggagatcgacggctttaagccgagccaccgaaagcttttgtactgcatgtacaaaatggggcttctcaccggtgcgcgcacgaagtcggcgaacatcgtcggcgcgacgatgcactataacccgcacggcgactccgccatctatgatacgatggtgcgtctctccaaggggtacggtgcgcttctcacgccgtttgtcgattccaagggcaacttcggcaaagtgtactcgcgcgatatggcgtgggcagcctcgcgctatacggaggcgaagctcgcgcccatctgcgcggagatcttccgcgatatcgacaaggacacggtggattttgtcccgaactacgataactccaccacggagccgacgctccttccgaccacgttcccgaacgttctcgtctcggcaaacatgggtatcgccgtcggcatggcgtcgaacatctgcgggttcaatctcggcgaggtgtgcgaaacgacgatcgcgctgctgcgcgacccggaacataatattctgacaacgctccccgcgccggatttcccgaccggcggcgagatcgtgtgcgatcccggcgagatggaagcgctctataagaccggccgcggcggtgtgaaggtccgcgcccgctggcgcttcgatcccaaggagcgcatcattgagatctacgagatcccgtacagcacgaccgtcgaggcgatcattgacaaggtcgccgagctcgtcaaggccggcaagctccgggagatcagcgacatgcgcgacgagaccgacctcaacggtctcaagctcgccatcgatgtcaagcgcgatgtggagcccgaaaagctcatgcagaagctcttccgcatgacgccgctgcaggacagctttgcctgcaacttcaacattctgctcggcggcacgccgcgcgtgtgcggcgtcggcgagattctggacgaatggatcgcctggcggctggaatgcgtccggcggcgggtatactttgacgtatcgaagaagaaggaaaagctccatcttctcaacggtctcaaaaagatcctgctcgatatcgaccgcgccatctccatcatccgcaacaccgagcgcgagagcgacgttgtgccgaatcttatgatcggcttcggcatcgaccaagtacaggccgaatatgtcgccgagatcaagctgcgcaacatcaaccgcgaatacatcctcaagcgcaccgaggagaccgacgagctcgaacgcgagatcgccgagctggaggatacgctcgcgagccgccgcaagctgcgcgcgatcatcatttccgagctgcagcaggtgatgaagaaatacccctcgccgcgccgcagcgtcatcacctatgccgccgatgcgcccgaagcaccggaggaggacaacgtggaggactacccggtcaacctgttcctttcgcgcgaagggtatttcaaaaagatcaccccgctctcgctccgtatgggcggcgagcagaagtacaaggagaacgacgggccgagccaaagcttcgagacgacgaaccgcgccgaaatgctcgtattcaccgacaaggcgcaggtctacaagtgccgcgcggcggactttgccgatacgaaggcctcgcagctcggcgtatatctgcccggtcatctcggcatggatgacggcgagaacgtattctctcttgtcctgcccggcgattaccgcggcgaggtgctgttcttctttgaaaacggcaaatgcgcccgcgtgccgctcgagagctacgccaccaagacgaaccgcaagcggctcaccggtgcttactgcgacaagagcccgctccgagcgctgctcgtcctcacggaggaacagaacgtggcggtgttttccacggagggacgcgcgcttgtattcaacacggcgctgctcgcacccaagacttcccgtgccacgcagggcgtggcggtcatgacgctcaagccgaagttccggctcgagcgcgccgcgttcctcgccgatacgaccatccagaatcttgcgcgctaccgtatgcgcagcatccccgccgccggcgcgctcctccgcgaggaggaccggggcgaacggcagatgacgctgctcgacggcgcggaggaaaatacgaaataa

SEQ ID NO: 1847 - DNA, 1935 bp, Unknown
  Artificiall/Consensus sequence
atgaacgagagcgagatcaaatatctggagcttctttccaagagctttccgagcatccccgctacggcggcggagatcgtgcgtctgcaggccattctggagctgccgaaaacgaccgagcacttcatgagcgacatccacggcgagtatacatacttctcccatatcctcaaaaacgcctccggcgcgatccacgacaagatcaacgacagcttcggcgatcttctcggcgaggaggagaaaaattcgctcgcccggctgctctattaccccgagcgggagcttgccgccgcagcgcactccgattcctggtaccgcgtgacgatccaccgtcttgtggccgtctgccggcaggcgacggacaaatatacccgcgtcaaggtgcgcgcccgtctgccgaaggaatatgcctatattatcgaagagctcattgactccgacgagcacgatcccaacaagcgcaggtattttgaaagcatcatcaacagcgtgatcgagaccggcattgccgaccggttcatcgtggcgctcgcaaatctcatctcccgcctgacggtaaaccagctgcacatcgtcggcgacgtttttgaccgcggccccgccgcgcagatggtcatggacgatctcatggacatgcacggcgtggacttcgtctggggcaaccacgacattctctggatgggcgctgcgatgggaaaccctgcgtgcattgcgaacgccctgcgaaactcactcaagtacggcaactttgatatgctcgaggacggctacggcctgaacgtccgtccgcttgcgctcttcgccatggagcagtacggcgacgatccctgcacgaacttcctcccgacgcacgtgaccgactgcgtggcggaaaacagcgacgttaccgccaagctcctcaaggccatcacggtcatccagttcaagctggagggccagctcatcctgcgccacccggaatataaaatggacggacggctcctcctcggagagctcgtccgctccgaaggaacggtcacgctcggcggcaagatataccgcacgaacgacatttcgctccccacggtcgatcccgcggatccctatcgcctctccgagcgcgagcagcagctcgtcgatcagctcgttttgtccttcctgcgcagcgagaagctgcagacccatatccggtatctgctggaaaaaggcgcgatgtaccgcgtgtgcaacggcaaccttctctaccacggctgcatccccatggagccggacggcagctttacgcgcgtgacgatgggtgacaaaacatatttcggaaagtcgctcatggatgcctgcgaccggctgtgccgcacggcgatgtacgaccgccgtatggagaacaccgatcttctctggtatctctggtgcgggccgtattccccgctcaacggcaaggacaagatcgcaacgttcgagcgcacgttcctcgacgatccggaggcccgaacggagcagaaaaatccgtactacgatctctggaacagcggggaaacggcgcgcacgatcctcaccgagttcggcgtggacttcgagcgcggccacattatcaacggccacgtccccgtgcgcaaaacgaagggcgacacgcccatcaaggccaacggcaagttcatcaacattgacggcggcctctcgaaggcgtaccagcccgtgacgggcatctgcggctatacgctggtgtattcctcgcacgagctgtatctcgccgagcaccagcccttcgacccggacaccgccgcgcgcgagagcgcagacgtcctctcccgcacaattatgatcgagcagtaccccgaccggcttcgcgtgcgcgataccgacggcggcgcggatgtggagcggcgcatcgccgatctcaaaaagctgctcgcggcctaccgcagcggccttgtgcgcacgccgagccgcatggagtaa

SEQ ID NO: 1848 - DNA, 3933 bp, Unknown
  Artificiall/Consensus sequence
atgacttccttcagcgtaaaaaagccgtttaccgtgttcgtggcggtggtagccattctggtgttcggcgtgatgtcgtacgtcaagatgacccccgacctgatgccgaacatggactacccctacgtcgtcgtggtgacgacgtatccgggcgccgcgccggaggaggtcgaagccgtcgtcaccaagccgatggagcagagcatggcgacgctcaatgatatcaagaccgtgacctccacctcggcggagaactattcgatgcttgtactggagtttgagcagagcacgaatatggacagcgccgtggtggacattctgcagaaaacgcagatgctcaccggccggtgggacgattccatcggcacgccgagcatcatccgcatcaacccgaatatgatccccgtgatggtcgcggcggtcgattcgtccgaaatggaccgctacgagctctctcgctttgccaaggacaccgtcatccccacgctggaaggcacgacgggcgtggcgagcatcacgaccggcggcatgatcgagcggacgatgaccatcgaggtcaacgaggccaagctcgacaaaatgaacgcaaagatcgccgaagccatcgacaaggcgatggaagacgccagaaagcagctcgaggacgcgcagaaggagctggacgagaaccgcgagaaggtcgaggccggcacgaaccagcttctcagcgcatcgagcggcatctccgattccatcaagcagggcgaggacgatctcgccgacacgctcaccgccgccggagagaccgcggcgaagctcgcctccgcgcgcgccgccatcgacgcgctcaacgcccagctcgaacaggcggaggccgcgctcgcggaggccgaggcgcgtctggccgaaaccgacgcgcgcatcgcctcgctggaagcggacagcgcgctttatgccaaagcactcggcgagccctacgactccatggacgcctccacgacgctggaggccgccggactggacgcggacaccgttgccgcgctcaacgccaagggctgtaccgatctcggcagcgtccgcacgatgaacaacttaaacgacgtgaatctctccgcgcagcgcaccgcgcgcgcagcgcaggccgtcgcggtggagaccgcgcgcgtgcaggccgaggagctgcgcacgcagatcgccgcggcggaggagcgctgcgcccagctcgaagaggaatccaaaaagcagatggaatcgctcgaaaacatgcagaagcagctcgaggagctgccgggcgagctcatgggcggcgtaacgaagatctccctcgcgggcggccagctcgccgcggcgcagaccgcgctcaccagcgcgcagacgcagctcgacgcggcggtgaaaacgcttgaggagcagctagcctccgcgctcgacgcggccgacctccacggcgtcatcacgctggaaacgctgagcagcctcattgccgcgcagaatctcgacatgcccgccgggtatgtgtatgacgaaaacggcaacggcatcatcgtcaccgtcggcgacgccatcgcggacggcgaggatctcgaaaaccttgtgctgctcgatctcggcatcgagggccttgaccccatccgcgtgtgcgatgtggcggacgttgtccgcgccgacaacgcgggggagatctatgcctcgctcaacggcaacaacggtctcatcctcatgttctccaagcagtcaaactacgcgacggcgaaggtgtctgacaacatcaacgccgcgtttgaagagctgagcgcgcagtatccggggctgacgttcaccgcgctcatggatcagggcgattacatttatctcctgcgcgactcgatcctctcgagccttctctggggcgcgctcttctcggtcgtcattctcttcctcttcctgcgcgactggcggcccacggtcatcacgctctgctcgatcccgatcagcctgctcttcgcgctcacgctcatgtacttcaccggcgtttccatcaacatcatgtcgctttccggtctttcgatatcggtcggcatgctggtggataactccgtcgttgtgatcgaaaacacctaccgcctgcgcgcgctcggcgaatcaacggtcaagtccgccgtgtccggcgcgcggcaggtcggcggcgcgatcgcggcctccacgctcacgaccatctgcgtctttgtcccgatcgcgttcgtcgagggccttacgcgcgagctcttcaccgatatggtgctcacgctcagctacgcgctcatcgccagtcttatcgtagcgctcacgctcgtcccggcgctcgcgggcaagctgctcgcgcacgccaggccccagagcgaaacggcgttcacgcgcttcatgccgaaatacaaaaagtccgtcctctgggcggtgaaccacaaggccgtcacgctcctcaccgcggtggcgctgctcatcgcaagcggcgcggcggtgatcgccaagggcttcacgttcctccccgatatggagatggagcagatgatggtaacgctcacgatgccggagggcagttcctttgccgacacgaccgccgcggcggacgaggcagcggcgcgaatgctcaccgtgccgggcgtggagaccgtcggcggcgccatcggcgacagcgccggctccagcctttccatgatgaccaccgagggcgacgtttcgttctatgtcctgctcgagagcggatataaggcgagccgcgttgcgaaagagatcaacgagaaatgcgccgatatggaggccgccgtgaacgccgacgcaaactcgctcatgtcctccatgacgcagatgctcacgagcagcggcatcacggtgcgcgtatactccaacgatctcgacgatctgcgcgagaccgccgacgccgtggccgatgtgctgcgcggcgtggacggcacggaaaacgtcgccgccggggaagaggagcccaccgccgagctgcacttcaccgtggacaagaaaaaggcggcaaaggagcagctcaccgtggcgcaggtgtatatgcaggtggcaaaggcgctcaccggctcggccgatctcatcgagctttcggacggcggcgacacctatgccgtcagcgtacagaccgccgggaaggacaagatcacgcccgaatacgtccgctctctcacgtttgacgtgacggcgaaggacggcacggtgcattccgtcgcgctcagggacattgccacggtcgaggagaccgagagcctttcgagcatccgccgtctcaaccagcgccggtacatcgacgtgaccgccgacatcgccgagggctgcaacgtcacgctcgtgacgaacgccgccgaggaagcgctcgcatcgttctctccctcggacggcacgaccatcggcttcaccggcgagcgcgaatccatcgtcgaggcgctcagacagctcgttttgatgctcgcggtcggtatcctgctcgtatatctcgtgatggtcgcgcagttccaggatctcaaatcgccgttcatcgtcatgttcacgatcccgctcgcgttcaccggcggtttcctcgcgctgctcattgcggggctggagatcaacctgctctcgatgctcggcatgatcatgctcgtcggcatcatcgtgaataacggcatcgtgctcgtggactacatcaaccagctgcgcatcggcggcatggaccggcgtgaggccattgcggacgccgccgtcacccgtctgcgtccgattctgatgacgagcatcacgaccatcctcggtctcatcgtcatggcgctcggccagagcgaagcaacgtcgctcatccagccgctcgccgtaacgtgcatcggcggactgctgtacgccacgctcatgacgctttacgtcgtgcccgtcatgtacgacgcgctctccaaaaaggcgctctaccacgtggacgaggccgatctcgaactcagcgaaaaataa

SEQ ID NO: 1849 - DNA, 1275 bp, Unknown
  Artificiall/Consensus sequence
atgaacaagcacgaatatcccaatctcggcgaaacgctgtatgaggaagtccttccgaacgggctttccgttctcgtcgcggtcaagccgggctttcgcaaaaacgcggcctttttcgccacgcgctacggcggggcggaccgccgcttcaaggtgaacggcgagtggatcgatacgcccgcgggcgtagcccatttcctcgagcacaagatgtttgatatgccggacggacgcagcgtcctttcggacttcgccgcgctcggcgcgagccccaacgccttcaccggcaccggccacacggcgtattatttcacgggttcggaaaacttcatggaaaatctccggttgctgctcacctacgtttctacgccgtactataccgaggagagcgtcgccaaggagcagggcatcatcggtcaggagatctgcatgggcgaggacagccccggctatgccggatatttccagcttttgagcgcgctctacgaccaccaccccatccgcgagaacatcgccggttccgtggagagcatcgcgcagatcacgcccgaaacgctctaccactgccacagcgtcttttaccatccctcaaacatggtgctctgctgcgtcggcgatgtagaccccgaggcgatcgcggcggcggcgcgagagatactgccggacacgcccggcgagaagccggagcgcgactacggcgcgcccgaaacgcttctgcccgcccggacgcgcgcggagaaaacgatgagcgtttccgcgccgcagtttctgctcggcgtgaagcttccgtatcccgcgtccggcgcggcgagagcgcggcagaagcttcttgcggagcttgccggcgagtgtctgttcggcaaggcctcggtctttttcaacgatctgtatgccggcggacttctgaacggcgactgctctgtcgaatacgattcctccgccgggacagccatgctggttcgcggcgcgcagggccgcgatccggacgccgtggcagaggcggtgcacgcggccgtgtccggcgttgcgctgggcggactggataaggaagcgctcgaacgctgccgccgcgcgaagtacggccagcttctcggctcgctcgattccttcgctgactatgccgtctcgctcgccgagagcaagctcgacggctgggatgcgcccgacgcgttcgccgtgcttgaatccatcactctcgcggagtgtgaggcgttcctctgcgaaaatctcacgcgtgagcgtctggcgctctccgtgatccgtcccaacgcctga

SEQ ID NO: 1850 - DNA, 1419 bp, Unknown
  Artificiall/Consensus sequence
atgcacagaacgtatttccggaccttcaccacgaccgcggcgatggtccttgtgagctttctgctcatcggcgcagccttcggctttgcgagccgtcaggtgttcgtgtccgaagcgcgcgagagcatgatgacgaactcacgcgaaatatcgcgcatggcggtcgcctatgccgccgagggcgatctgcgctcgctcgagctgcgcatgacgctcagcaccatcggcgcgagcacgaatcagcacattttcatcgtcaatccctccggatatatcatcacctgctcggactccgccgttttctgtgagcacatcggaaagcgtctggatgagagcgtaacggcgatcctgccgcagtccggcacagtcgcgtcgctcggcacgctgggcgggttttacgcgagcgagcattataccgtcatttccgcgctcaccgatgacggcgcgctgctcggccatctgttcgtttccaaggacacggtaaccgcgctctccatctgggagacgatcctgccgctgttcttctttatcagtctcatcgtactctgtctcgcactcattttcagctacgcgagctccaagtacttcgccaagcccctgcgcgacatggcggacgcggcgcggcgcttcggtcgcggcgagctgaacgtccgtgtggagccgaccgacagcaccgacgagatcggcgagctgacggaggcctttaactccatggcggactcgctcgagcagtcggagacgaagcggcgcgagtttatcgcgaacgtatcacacgagctcaaaacgccgatgacgacgatctccggctttgccgacggcattctcgacgggacgatcccgccggagtcggaaaagaaatatcttcagatcatctcctcggagacgaagcggctggcccggctcgtgcgcagcatgctggagctttcgcgcctgcaggcaaaggaccgcgcaacgctcctcaagaacagctttgatatttccgagcagctccggctcacgctcatcacatttgccgataagatcgatcagaagcatctggaggtagtgttcaacgtccccgaggaggcgatcaaagttctcggcgatgtggacgccatcacgcaggtcatctacaatctgctcgataacgccatcaaattctcccgcgaaaattcaccgctcaccatttcgctatggaaggacagcaagaaggcctacgtctccatccggaactgcggcagcaccattccggaggcggagatcccgctcctcttcgatcgcttccacaagtccgaccgcagccgcagccaggaccgcgacggcgtcggtctggggctttatatcgtcaaaaccattttaaataaccacggcgaggacattgccgtgacaagccgccagggtgtgaccgactttgtgttcacgctcgcgctcaaaccgtaa

SEQ ID NO: 1851 - DNA, 1125 bp, Unknown
  Artificiall/Consensus sequence
gtgaaagctatcaatcccggacactttcttctgacctgccggctggacaactgggtgcatctgctggaagagaaccacttccatatcgcccgcgaccggctgccgcaggcgctgtacatttccgcaacggcgctcgcgctcgcgcccgcggcggcggcggaatcgctcatttaccgcaagcgcatccgtgaaacaaagatcgaaaaggacccgatcttcattctcggccactggcgcagcggcacaacgtatctgcagaacgtcctctcgcgcgacgagcagttcggctggttcgatcccgtgaacacgatcggcctgccctactcgctgctgctcggccggctcatccagccgccgatcgaaaagggcatccggaacggccgcccgcaggataacgtgcagtactcgctcgatctcccgatggaggagacattcggcgtgctgacgatctcgccgtattcgatcatccacatgatcgcgttcccggaaaattataaaaagtacatcgaaggcgcgttcgtgagcgaccttcccgtggaggaactgcgcaaatgggagcgcagctacgattacgccgtccgcaagctcaccttcatcaaaaagggcaagcagctcattctcaaaagcccggacaacaccgcgcgcatccgcgagctgtggggcatgtatccggacgcgcggttcatcaacatccaccgcgacccctacaagaccgtccgctccacgatccacatgttccgcaccgagatggactcgctccggctgaccgaagagccggataacatcgacgagctcatcgagaacacggtcatcgatattttcgagcgcatgtaccgcgagcttttcgagcttgagggctttttcccgaagaaccggtacgtagacatcgcgtacaccgatttctgccgcgccccggtcgatacgctgcgggatatttaccggcgtctggagctctccggctttgaggcagccgcgccgcgctttcaggcgtatgtcgattcgcagcgcggataccagaagaataaattcgacatttcgccccggcttgtgcgcaagatcaacgcgaagctgggcttctacatggaacactacggctacgaaatgcgggaggttgaggaagaatga

SEQ ID NO: 1852 - DNA, 1920 bp, Unknown
  Artificiall/Consensus sequence
atggcgaaaaaagaatttcaggcggaatcccggcggctgctggagctgatgatcaattccatctacacgcatcaggagatctttctgcgcgagctgatctccaacgcctcggacgctatcgacaagctctgcttccgctcgctgaccgatgagaatgtcggcatggagcgcggagatttcttcatccgcatcaaaggcgacaaggaaaacggaacgctcacgatctccgacaacggcatcggcatgaccgccgaggagatggaatccaatctcggcgtgatcgcgaagtccggctcgctcgccttcaagaaggatctggacgccgccgagaaggacaaggcggacatcgacgtgatcggtcagttcggcgtgggcttctattccgcgttcatggtcgcgagcaaagtcaccgtcatctcccgcgcctacgggcaggagaccgccaaccgctgggagagcgagggcgcggacggctacaccatcaccccctgcgaaaaggagaccgtcggcaccgacgtcatcctcaccatgaagagcgacaccgaggacgactgctacagcgtgtatctcatgccctggaagatccaggagcttgtgaagaaatattcggactatgtccgctggccgatccgcaccgatgtggaaacgaccgaaaaatatgagaccggcgaggtagacgaggccggtatccagaagatgggcgtgcgcaccgtcacaaaggaagaggtcatcaactcgatgatccccatctggcagcgcagcaagaaggaagcctccgacgccgactgcatcgccttctataaggagaagttcaaggacaccgaggatcccgtgtccgtcatccgcgtgaacgccgagggtaccgtgagctaccgcgcgatgctgttcgtcccggcgaaggcgccctatgactactacacccgcgactatgtccccggcctgcggctctactccaacggcgtgatgatcatggagaaatgccccgacctgctgccggagtgcttccgcttcgtgcgcggcatcgtcgactctcccgatctttcgctgaacatctcccgcgagatgctccagcacgaccgccagctcaagctcatctccatgaatcttgaaaagaagatcaaaggcgagctttcccggctcatggagtgcgaccgcgagaagtacgaaaagttcttcaacgtgttcggcacgcagctcaaatacggcatcatcggcgattacggcatgaagcgcgatctgctgaccgatcttctgctctatcgcagcgcggagaaggaaaagctcgtctccctgcgcgagtatgtggacgcgatgccggaaaaccagaaatacatctattacgccgccgccgaaacgccggagcgcgccgcgaagctcccgcagaccgagcaggtgcgcgccaagggcttcgatattctctgcttctcgaccgacgcggacgagttcgtcgcggagatcctcggcagctatgccgagaagaagttctgcaatgtctgctcgcaggatctcggtcttgagtccgacgaggaaaaggccgccgccgacaagaccgacgaggagtttaagcccctcaccgattttgtcaaggagacgctcggcgacgccgtggcgaacgtgaagatctcccgcaagctcaagaattacgccgtgtgcctctccgtcgagggcggcatcacgctcgaaatggagcggtacttccacgccatgccgggcgccgacccgaacgcgatgcgcgcacagcgcgtgctcgagctcaatctcgatcgccccgccgtcaaagcgctcgacgccgcgcgtcaggagaacccggagcgcgccgccgtaatggcgaaggtgctcttcgcgcaggcgcagctcgtcgccggcatcaccccggacgatccggcggagtatggcgagcttgtctgcaaactattctga

SEQ ID NO: 1853 - DNA, 1200 bp, Unknown
  Artificiall/Consensus sequence
gtgtgctatactcgctttgaggaacggcgcaccttgctttttgcgtatgcgccggaaaaaaataagaagagtattatcggaggaaaaaggatgaaaaagatttttgcgctcctgctcgcggtcgtcatgacgctcggcctgctggccggctgcggccccgccgccgagaccccggacaccgaagccccggctaccgaggctcccgctgcggaagagcccgctgcggaagagcccgccgccgaacccaccgcgaagaagatcgacacactgaaggtcgcgttcgtcccgtcccgcgagccgcaggagatcatcaccgtcaccgagcctctcaaggagatgctcaagaacgaactcgccgcgctcggctatgaagtcggcgaggtggagatcaccgtcggcacgacgtatgaagcggtcggcgaaggccttgaagccggcacgatcgacgtcggcctcatccccggcggcacctacgttctctatgacgacggcgccgaggtcattctcaccgccacccgcgacggtctgagcaaggattccgacaacgcgaaggattggaacgacggccagcccaccgaggcttccgaccgtcaggcggtttcctaccgcgctctgttcatcgccggcccgtccgaaaagggcaaggagctgcaggacaaggtcaacgccggggaagagctcacctgggaagacctcgacggcgccaactggagcgtcatgggcacgtcctctcccgcgggctacatttaccccgctctctggctgcaggaccactacggcaagggcatctcggatctctccagcgccgtgcagtctgactcctacgccagcgcgttcgcgcgtctcgcctccggccaggtcgacgttctcgtgacctatgccgacgcccgccgcgactatgccgagcgctggaacagcgagttcggccgtgaaggctccatctgggaggagaccggcgtcatcggcgtcaccgcgcccatctacaacgacaccatctccgtgagcaagaactcgcccatcatggatgccgatctgatcgccgcgctgcagcaggcgttcatcaacatcggcaataccgatgccggcaagcaggtcatcgccatctacagccacaacggctaccagatcgcgcagtcctccgactatgacaacgagcgcgccgcgcagaagctcatccaggagctctccgccgccaactga

SEQ ID NO: 1854 - DNA, 1230 bp, Unknown
  Artificiall/Consensus sequence
atggaaaagaaaaattacgagcagtccaaaaagctcgacaacgtctgctacgacatccgcggtcccgtaatggacgaggccatgcgcatggaagcgcgcggcgcgaatatactcaagctcaacatcggcaatcccgcccccttcggcttctatgcgccggacgaggtcattctcgacatgatctataacctgcgcaactgcgagggctattccgattcccgcggtctcttctccgcccgcaaggcgatcatgcagtactgccagctcaagggcattccgaatgtcggcatcaacgacatctttaccggcaacggcgtgagtgagctcatcacgctcaccatgcagggtcttctggacgacggcgacgagattcttgtccccgcgccggattatccgctctggacggcgtccatcactctcgccggcggcaaggcggtacactatctctgcgacgagcagcaggactggtaccccgatatcaacgatcttcgatccaaggtcacgccgcgcacgaagggcatcgtcgtcatcaacccgaacaacccgaccggcgcgctctatccgaaggagatccttgagcagatcgtgcaggtcgcccgcgagaacgaccttatcctctttgccgacgagatctacgaccgtctcgtcatgcagggagagccggagcacatcgcgctcgcctcgctcgcgcccgaccttctgacgctctgcttcaacggcctttccaaatcccaccgcgttgcgggcttccgcgtcggctgggtgtgtctcgccggtgataagtcccacgccaagggatatatcgaggggctgaatcttcttgccaaaatgcgcctttgctccaacgttccggcgcagagcatcattcagacctctctcggcggctatcagtcggtggacgaatatctctgccccggcggacggctttacgagcagcgtgagctgatctggaaaacgctcaactccatccccggcttgagcgctgccaagccgaaagcggcgttttacattttcccgaaggtggacacgaagaaattcaatatccacagcgacgagcagatggcgctcgatcttctgaaggaacagaagatcctcatcaccgccggtacgggcttcaactggggcgagccggatcatttccgcatcgtctacctgcccgacctcgtttcgctgaaggaggcctccgtgcgtcttgaaaaattcttcggcagctaccggcagaaggattaa

SEQ ID NO: 1855 - DNA, 1659 bp, Unknown
  Artificiall/Consensus sequence
atgaaatacagaaagatctttgctctgctgctcgccgcggcgacgctcttctcgcttgccgcgtgcggcgagaccgctgccgggccggaggcaacgcccgatcccgcgctggacgagagcgccgcgaccgtctccggccagacgctcaccttcgccggcgccgcggacgacgtgttctctctctcgctcgactacgaggagagcctcaaccccatcaagacgcagagcacgctcaatcagctcgtggactgcctcgtgtacgaccgcctcttcgaggtcgatgagaacttcaacgtgacgtcgcgcattctttcggactggtattactccaagaacgaagacagcgcgggcgtgtgggtgctcaaggtgagggagggcatccagatgcacgacggctccacgctcaccgcgcaggacgtggcgtactccgtgtcctgcatcttcacgagcgagagacacaagcatctgcagcagcaggtcgggcgtgtctattcgagcgcgtacaacggcgaggtgtatctcgccgtggaaggcgcggacaacgcgcagctcccgcagcgcatgagcatcccggtcatcaagtccggctccgtcggcgacgagatccccgtcggatcgggcccgtatatgtataatgaagaccgcacggcactcgtgaagtttgacgggtatgaaaacagcgagagtctcccgctcgacgaggtgcagctgcgcgcctaccgcggcatggaggagctcatcaccgagtttgaaagcggtctcgtcgatctcgtcgtgaacgacccgaccggcatctacaacatgggctacggcggcaaaaacgaaaagcgcaccatcaccaccacgaatctccacttcatcggcttcaacagccagagccgcttcttccagtatgacgcctaccgctacgcgatgaactggatcgtgaaccgcgacaagatcgtatcggacacgctcgacggcaacgccgtggcgacggtgctccccgtccacccgaacagcgcgctgtacgatacctcgatcgcctcgcagttttcctacgatccctcgcgctgccttaccgagctcgagcgcggcggctgccgcgatctggacgcggacggcatgcttgaatttgcgctctccggcatgaaggtggacattgagctcaacttcgccgtctgcgccgacaacgccgccaaggtgcaggaggcgcgccggatcgccgaggatctggaagccatcggcatcggcgtcaacctgcgcgagcttacatggaaggactatctcgccgcgctgcgctccggatacatcgacttcgatcaggaggagcccgagatcgttatggatatgtatctcgccgaggtcgcgctgaccggcgactggaacattctcacgctgatctccggcgactgggaggatgacaacaccctcaactacggcggctgggacaacagcgagctggaagagctcaccgaggcctatctcggcgcaaaggacgacgaccgcgcgcaggccgtaaacgactggctgcagctcctcacgacgaccacggtgatcctgccggtgtgctttgagacgcgcgaggttatctcccatctcggcgtgatctccggcatgtcgcccaaccagtacgacgtattcaataatattaccgcctggacagtcaatatcggctga

SEQ ID NO: 1856 - DNA, 1992 bp, Unknown
  Artificiall/Consensus sequence
atgagcattgtagccatgaaaaagctccggctcatcggcgttcattcccagaaggaagaactgctgcgtgagctgatgcttctcggctgcgtggaggtgtcggatccggccgaccggccggaccgggaggagctggcggccttccggcgtccggacggcggaaaggtctggcagaagcgctcggaacagacaacaatcgtcaacgcgctgcggctgctggacaagcacgcccctgccaaaaagggcctgcttacgccgaagccggaggtcgaatgcgccaagctgctcgacgagagcgctttggccgccgatctcgctctggcgggagagatcctctcgctggatgcggaggcgcgcagccttctcacccgcgcaagccgggaacgcgcctcggcggaggccatgactccgtggacggcgctgaacgtcccgcttgagcgcatggagacgcaaagctgcgaaatgcagctcggcacacttcccgccgctgtccccatggaggaagtaaacgccgcgctctcggagctggaggtcagctttgatctcgtttccgaggacaaaaccagccggtatgtatcgctgctcttccgccgggaggatcgcgaagcgatcgccgcggcgctgcggccgttcggcttttcggccatttctctgccggagggcaccggaacgccggagcaggtctataacgccgcgctccgccgcagcgaggagctgacggcacaggcggccaagaagatcgaagagcttgcctcctacgcggcgcaccgcgacgcgctgcagctcggcgcggacacgctctcgacgcgcattgcgcgcgaagagacggccgaaaagctcctgcagtcggacagcaccttctattttgaaggctggctcaccgcgccggaggagaaaaagctcggcgagactctctcgaaatactgctgcgcctgggaaacggaggagcccgatccggagcacccggaggaggtccccatccagctgcgcaataacgcgctgacccgtccgtacaacattgtcacggagatgtattctctcccggcgtacaacggacttgaccccaacccctttatcatgccgtttttcgcgctgttcttcggcatcatgttcgcggatatggcgtacggcctgatattgctgatcgcgggactgctctttctctggaaggcaaagccgaagggaagcatgaaaaacgccgcggggctgctgatcgaatgcggcatttccacattcatcataggcttcctgaccggcggcttcttcggcgacgttgtctccgtcatcggcggttggttcggcagggactggtcgatcgtaccgcacctcggcacgatccatatcggcagcatcgcgatcgatctgccgctcaacctgctcgagggcaacaacccgctgtatgtcctcatcgcggcgatctgcctcggcgcgatccatctggcgctcggcacgggcatcggcatctatctcaagctcagggacggcgagtgggcggacgctctgctcaacgatctgtgctggtgggtaatgatcgcgggcattctcgtcatggtgaccggcggaacgaagatcgttctcttcgtcggcatcggcatgctcgtgctcggacagctcatcaccggcaagggcttcggaaagatcaccggcattttcggcgcggtatacaacggcgcgaccgggtatctgggcgatctgctctcttactcgcgtctgatggcgctgatgctcgccggcagcgttattgcgagcgtattcaaccagctcggctcgctcggcaacgccaacggcatgaccgtgggcggcacgatcctcttcgtgctcgtgttctgcatcggccatgcgctgaactttgcgctgaacctgatcggctgcttcgtgcacacgctgcgactgcagttcctcgagttcttcggcaagtggtaccgggacggcggcaaggctttccgtcctttgaaaattcaaacgaaatatgtagatatcaaggaggagtaa

SEQ ID NO: 1857 - DNA, 1932 bp, Unknown
  Artificiall/Consensus sequence
atgtcggaaaatacaccagtcaatcccaatacctatgacgccagtcagatccaggtccttgaaggtctggaagcggtgcgtatgcgcccgggtatgtacatcggctcgacgagcacgagcggtctgcatcaccttgtatacgagatcgtggataacgccatcgacgaggcgctcgcaggcttctgcacgcatatcgaggtctccatcgaagacggcgagagcatctgcgtgaccgataacggccgcggcatccccgtggacattcaggagcagacgggcaagcccgcgctcgaggtcgtctatacggtgctgcacgcgggcggcaagttcggcggcgggggctacaaggtctccggcggtctgcacggcgtcggcgcgagcgtggtgaacgcgctctcggactggctcgaagtgcgcgtattcaaaaacggcaatatctacgagatgaaattctcccgcggccatatcacgcaggagatgaagatcgtcggcaagaccgacaaacacggcacgcaggtgcgcttccatcccgatcccgagatgtttgacgacacggtctataactatggagtgctcttcaagcgcatgcgtgagcaggcgtttctgaacgccggtctcaccatcatcatggaggacaagcgccccgagcaggagcagcggcaggggctgtgctacgagggcggcatccgcgaatttgtcaccgagctcaaccgccacaaaacaccggtgcatgagagcgtcatctatatgtccggcgagcgggacacctccatgtgtgagatcgccatgcagtggaacgacggctacgatgagcgcatcgagtccttcgccaacaacattctcacgcccgagggcggcatgcacgagaccggcttccgcacggcgctcacccgcgtgatcaacgcctacggcaaatcgagaaagattttgaaggacgaggagacgctctccggcgaggactgccgcgagggtctcaccgccgtcatctccgtcaagctcgaaaacccgcagtttgagggccagacaaaatccaagctcggcaacagcgacatccgcacgatggtggacagcgttgtgagcgacaaactcgagcagttctttgaggaaaaccccgccgttgccaagcagatcttggaaaaaggcatttccgcctcccgcgcgcgcgaggccgcgcgcaaggcgcgcgacagcgtccgccgcaagaccgggctggagtccggccagatgccggataagctgcaggactgcaacgagcgcgatccgtccctctgcgaaatttacatcgtcgagggcgacagcgccgcgggcagcgccattcaggggcgcgactcccgcttccaggccattctcgccatgtggggcaagatgctcaacgtcgagaaggcgcgcgtcgataagatctacggcaacgacaagctctatccgctgatcgttgcgctcggcgcgggcatcggcaatgagttcaacatcgataagctccgctatcacaagatcgtcatcatggccgatgccgatgtggacggctcgcacatccggacgcttttgctcacgttcttcttccggtatatgcggccgctcatcgaaaacggctatgtctattccgccgtgccgccgctcttcaagctgagccgcggcaagcagcagcgcgtggcgtactccgacgaagagcgcgacgcgatctcccgcgagctgcgcggcgacaacccggacgcgaaggtggacatctcccgcttcaaaggtctcggcgagatggacccgcacgagctctgggaaacgacgatggaccccgagcgccggacgctccgccgcatcacgctcgaggacgcgcagcgcgccgatgagatatttaccgttctcatgggcgacgaggtcgagccgcgccgcgcgtggatcgagacaaaggcgcgctacgtcgtcaatctggattattaa

SEQ ID NO: 1858 - DNA, 1434 bp, Unknown
  Artificiall/Consensus sequence
atgaaaaagatccttgcactgatccttgccctcgttatgctcttcgctctcgccgcctgcggccagcagcccgctgcgcaggagccgaccgaagcgcctgccgagcagcccgcggaacagcccgccgagcagccggcggaagaggagcccacccccgataccatcaccgtgatggttcccccggtttccggcacctatcaggacgacatcgacacctggatcgccgagttcaaagagctctacccgcacctcgatgtggaagtgatcaagacctcctgggacgatcacaacggcaagctctccaccatggcgaacgccggcgaagctccggacatcgctgaggtctcctactccgccatcggcacctacgtcgagctgggcgtcgccgttgacattgcgcagtacatggaccctgagcgtctggccgactacgatcagaacgcgctcgactacatgagcattgagaacaccgtttacggcctgcccctgtacatcaccatccaggctctcggcgccaacaaggatatgctcgaggccgccggcgccgacgtggcgaagatccagtccgaaggctggacctacgaggagttcctcgaagtcatcaagaacggcaccaccgatgactgcttcggcttcgtgttcgccaactccggcgtcaccgcgtccgacttcctgaacatcttcggcgtcgccgcgggtctgaacaacgcgttcaccgacgatctcaagtatgcctacacctccgagaacatgctcaagctgctcgaggccgtggaagagatgaccaagtccggctacatgcccaactacggcatcgaggccggccagcgcatggtcatgtgccagcagggcaaggccatgatcttcggcaaggccatgccgctcttcgagaacaacatcaacaagaacaacgccgctcttgaggccaacgacggcaccgccgtggaaaactccatccccgtgaactacgcgttcctgcccgttccgacgatggaaggcgcggaagcctcctgcttcggctccgtggacggcctgatcgccctccgcaacaacaagaccaccgacgagcacctcaagaacgtgtgcctgttcctcgactacatctcctccggcgagcgcatcgctgccgttgaccagaccctgcttctcgagcccgtctgccagaccggccgcgacgcttacgtctcccccgaaggtcttgacgagggcaacgttgcctccgccgcccgctgcatcggccttgtcgttgcgcctcccgccggtgtgaccgccgagcagagcgcttctgccaagaccatcatggacgaagtcatcgttccgaagttccaggctctccttgccggcgaagccaccgcgcaggaagtctatgacgctgtctgcaccgccgctaccgaggcgttcggcgccgacggctgcgtctccggcgctctctaa

SEQ ID NO: 1859 - DNA, 1146 bp, Unknown
  Artificiall/Consensus sequence
atggcgagcccccgcggctcgccatacttcgtattttccgagtattttccgaaaatatccgccaaccacccacagtccctgcaaaagagaggaaggaatgccactgtgatccggctcaataacatcgtcgtcaaattcggcgacttcaccgcgctgcacgacatcaacgtccaggtaaaagagggcgaattcttcacgttcctcggcccgtccggctgcggcaaaacgacaacgctccgcaccattaccggcttcatcgagccggccgagggccaggtgttcgtccgcgataaggacatcacccatgtgcccatcgaggaccggaacatcggcatcgtgttccagagctacgcgctcttcccgacgatgaccgtgtacgacaacatcgcgttcggtctgcgcgtcaagaaaatgaagaaggccgaggtggacgaaaaagtccgcgctatcgccaaaaaggtcgatctttcggacgagcagctcaagaaagccgtgtcgcagctatccggcggccagcagcagcgcgtcgccatcgcccgcgcgctcgtcaccgagccggcgatcatctgtctggacgagccgctctccaacctggacgccaagctccgcgtgcagctccgtctggagcttaaaaagatgcagaaggatttcggcatcacgagcatctacgtcacccacgatcaggaggaggcccttacgctttccgaccgcatcgcggtgttcaacaagggcgtgatcgagcagatcggcacgccgaacgaaatttacaaccactccgccacggaattcgtgtgcaacttcatcggcgacatcaaccgtctctcggacgatatcgtggaaaagctcaacgccaaaggcgcgcagcttgacccgacacaccaccactacatccgtctcgagcgtgtccatgtgaacgacgctcggcacgcggaatccggcgccgtttcgctttccggcaccgtggaatcgagagagtattacggtctgtatataaagtattacatcaacgtcggcagccagacgctcaaggtcatcgagcgcaacgacggcgtgcatctgcacgataccggcgacgccgtgaccgtcaccgtccaccccgacgatctcatgagctacgctcccaacggggaggaggccgagaaatga

SEQ ID NO: 1860 - DNA, 1755 bp, Unknown
  Artificiall/Consensus sequence
gtgaaggccgtgaaaaaaaagaaagactttacccggggcagtgtgcaggtgttcttttcctactataccccgcaccggaagctgctgctgctcgatctcgtgatggcggtctttgcggtagcggcggagctggtgttcccgtacgccacgcgctacgcgctcaaccgcctgctgccgaacggcctctacaaagcctttttcctgctgatggcgggacttctcggcgcgtatctgctgcgcgctctcgcgcagtatatcgtgaccgtgtacggccatgagctcggcgtgcgcgtcgaggcggacatgcgcgaggacatttttgccaaggtgcagacgctctcgttcgcctttttcgataagcaccgcaccggcaagctcatgtcccgcatgacgaccgaccttttcgacatcaccgagcttgcccaccacggcccggagaccgtgatccaggcctcgctcacgatcgccggggcgatcgtcatcctcgccacgatccgctgggagctggcgctgatattgtttcttctgctgccggtgctgctcgcggtcgtgatgcggctgcggctgcggctccgggcgcgcagtctggacgtgaagcgcgagaccgccgagatcaacaccgctgtggaggcgggcgtttccggcatccgcaccgtcaaggcgtttgccaacgagcaggacgccatggacaagttccgcacgtccaacgagaaattcaaaaaggtcaaaaaaagctattaccgcattttcggcgtgttcaacgcctcgaccgagtttgccatggcgctcatgcagctcgtaacgctcgccgccggcggagtgttcattatgcagggcaaaatggacgcggtcgatctcatcacgttttcgctgtacgtttcggtgttcatggcgccgatccggaagctcacgcagttcgttgagcagttccagaagggaagctccggcttcctgcggtttctggagatcatgcgcgccgagccggacgtgaaggacgcgccggacgcgaaggagcttgaaaacgtaaaaggcggcgtggagtaccgggacgtgtcgttccactatcagaacggcgaagaggtgctgcgccatgtggatctcacgatcgcgccgggcgaaacgctcgcgctcgtgggcccgtcgggaagcggcaagacgacgctctctcagctcctgccgcggttttacgatgtgaccggcggcgcggttttcgtagacgggcaggacgtgcggaaggtgacgcaggcctcgctccaccggtacatcggcatcatacagcaggacgtattcctctttgccgacaccgtgcgcgagaacatccgctacggccgccccggtgcgacggacgaggaagtcgcgcaggcggcgatcctcgcgtccatccacgaggagatcctggaaatgccgaacgggtacgatacgttcgtcggcgagcgcggcgcgatgctctccggcgggcagaagcagcgcatcgccattgcgcgcgtgtttctgaaaaacccgccaatcctcgtgcttgacgaggcgacgagcgcactcgacagcgtgaccgaggccgcgatccaggcatcgcttgaaaagctcagccgcgggcgcacgacgatcgtcgtggcgcaccggcttgccacggtccgcggcgcggatcacatcgccgtcatcgacaaagaaggcgtgagcgagtacggcacgcatcaggagctcatggagaaaaacgggctctacgccgcgctctggaatacgcagaaactgtcgtga

SEQ ID NO: 1861 - DNA, 1560 bp, Unknown
  Artificiall/Consensus sequence
atgccgcaaatgtccgtatggatgatcgtcgccagcatcattgccgtgctggtgtttttgctgatcggctttgtgctgggcgtcatgtaccggaaaaaggtttccgagcgcgagatcgccagcgccgaggatgaagcgaagcgcatcatcaacgaaggcattaaagccgctgaaaacaaaaagcgcgaggcgctgctcgaggcgaaggaagagatccatcgcacccgcaccgagtgcgaccgcgaagtaaaagagcgccgcaacgaagtttccaagcaggagcgccgtctccagcagaaggaagaaaatctcgaccgcaagaccgaagcgctcgaaaagaagaccgagactctcaaccgcaagctccaggaagccgatgcccagcaggaggagatcaagctcgtcaagaagagccagctcgacatgctcgaaaagatctccggctactccgtggaggaagccaagcagtatctcatcaagagcgttgaggccgactgcacgcacgaaatggccgccaaggtcaaggaagttgaagcccagttcaaggacgaagccgagcagagggcccgcgaggtcatcgccacggccatccagcgctgcgccgccgaccacacgagcgagatcaccgtttccgtcgttcctctccccaacgacgaaatgaagggccgcatcatcggccgcgagggacgcaacatccgttccatcgaaacgctcaccggctgcgatctcatcatcgacgatacgccggaggccatcacggtctcaagctttgatcccgtccgccgcgaggtcgcgcgccttgcgctcgaaaagctcattcaggacggccgcatccaccccgcccgcatcgaggaaatggttgccaaggcccagcgcgaggtcaaccagaccatcaaggaagagggcgagcgcgccgtgttcgagacgaacgtccacggcctgcaccccgatctcgtcaagctcctcggccgccagcgctaccgcacgagctacggccagaacgtgctcaaccactccatcgaggtcgcccagatctccggtctgctcgccgctgagctcggcgtggacattgccctggccaagcgcgccggtctcctgcacgatctcggcaagtccatcgaccacgaggtcgagggaagccacgtgaccatcggcgtagaccttgcccgcaagtacaaggagtccgaagaggtcatccacgcgatcgaagcgcaccacggcgacgtggagccgcacacggtcatcgcctgcatcgtgcaggctgccgacacaatctccgccgcccgtcccggcgcgcgccgcgagaacatcgagaactatgtcaagcgtctcgaaaagctggaggaagtctcccgctcgttccccggcattgcaagctgctacgctatccaggccggccgcgagatccgcgtcatggtcaagcccgaagaggtcagcgaggatcagatcgtcctgctcgcgcgcgacatcgccaagaagatcgaagccgagcttacgtaccccggccagatcaaggtccacgtcctgcgcgagaccaaggccgtcgattacgcgaaataa

SEQ ID NO: 1862 - DNA, 1428 bp, Unknown
  Artificiall/Consensus sequence
atgaaagcaaacattcttgtttatgatgtcggcagcacctatacgaagggcgcggcctttgcccttgcggacgggaaactgacgttccttgcccgcggccagcacccgacgacgctggagaacatcagcgacggcgcacgcggcgccgaggcggagatccgtgccaagggcgtggaattcgcgcccgatatggtccggttcagctcgtgcagcgccgcgggcggactgcgcatggtcgccatggggtatatgccccgcgtgaccgcgaaggccgcgaaggaagttgccatgaccgccggtgcgcgtgtcatggaggtcgtctccgcggacgagccgcccgagttccgcgaggaagtgctgcgcgagatcaagcccgacatcatcctgctctccggcggtacggacggcggcgacatggccaacgtgctcgaaaacgcggacatcatctgcaaggtgcacggcgaaggcacggtcattctcggctgcaacaagttcgcccagcgcgaggcggcggagaaattccgcgccgcgggcattgactgcatccgcgtgccgaacatcctgccgacgatccacgagctgaacgtgaagcccgcgcgcatcgccatccacgagcagttcatcaaccagatcacccacgcgaagggtttgcaggagttccgcgattcgctcgcggatcagaccgtcatcccgacgccgggcgccgtgctccttgcgagcgagctgcttgccaagggcagctacgagcaggagggcgtcggcggcgtgatcctcgtggatatcggcggcgctacgaccgacatccattccgccctgcccgagctcatcgacatgaacatcgaagagcgcggacttgttgtgagcaacgaaaagcagttttcctaccgcaccgtcgagggcaatctcggtctgcgcgtgagcgcgaccggcattcccgaggccgtgggcgacaaggccgttctccgcgccatggaccacgattacggtctgacgccggaggatgtggaaaactatgtcgatctgctcgaagcgcacaacgatcatattcccgccgacgagaaggaggcctgtctcgaccgcgcgcttgccgcgtgcgccgcggacgtcgccatccgccgtcacgccgggtattacgcgaaggaggccgatcccgtcatgggcatcatggccggcgctccgatggggcgcgatcttcgcaacgtgcgccaggtgctgtgcgtgggcggtattttcctccactgccacggcgaggagcgcgagaacatcgtgcgccgcacgttcgataaccccggcatctccctgctgccgctcaacgacccggacatctggttcgacgaggactatatcctctacgccatgggcgttctggcgcagcacttccccgaagaagttctttcgtacatgaaagagcatgtgataaagaaataa

SEQ ID NO: 1863 - DNA, 2070 bp, Unknown
  Artificiall/Consensus sequence
gtgaccggcggcgagaccgtgaccggcggcgagccagagaccgcgccgcgcgcgctcagccgcaaggagcgccgtgagcgagaagccgcggcggaacgggagaaaaattcccgcgccgcgaagcgcgcgaaacgcgaggccgaatacgccgcgcccccggcggatctcccgccgctgccggtgcgcgcgcgccgggccgagcgcgaagatccggaggagaaagcgccgaaaaagcgctcccgccgcgcgagcgaagcgcccatcacgccggatgcgcccgcgccgcgcgggggctggaagctgccggtcatcatcgtgtgcgtcgtgctgctgcttctgctcgcactcgtcgtgacaggcgcgctgctcgtgcacaaagtggatacgatctatccgggcgtgacgatcgccgacaccgatctctccggcatgacgcgcaatgaggcgcgggataagctgcttgtgctcggccacgagcgctacgacggttactccgtcacggcaaacctcccgctcggcaatacgctcgccatgtcctccgcggacgcgggcatgcgcttttccgccgacaccgcggcggacgccgcctggaactacggccgcggcgacgggctcttcggcgcgctggtgaaatatgtccagtgccgctatctcggcaagtgcggctttgcgtacgacggcgagctttttgacataacgctcgacgaggcgaagatgcgctccatcatcgaggcgaaggccgtggatatcgacgcgcagcttctcgagagcagcatcgtcgtcggcgaggacagcatcacccttctcaagggcgcgagcggcatgacgctcgacaccgattcggtgttcaactccttccgcgatgcgttcctctccggcggcagcacgtcgttcacctacgagagcgcgccgaacacggacgaatcgttcgatttccagtcgctctataacgacatttattccgaggtcgccgaagcggagatcgtttataaccccgacattgagacgaccgaccccggcaaggatgacggcaagggcgaaaagcccgccgcaacgcccgaacccaccgcgacccccgcgccatccgacacgccggaggcctccgcctccccggaggcaacgcccgcggcgggcagcaagaccgatccctcgcagatcgacttccacggcgagccgttcatcgtgacgcagtcctccgtcggccggacatttgacgtagccgaagccgaaaaggcctgggccgcggcgtcctacggcgacacggtcacgatcccgatgaccgtcacgaagcccgagcacaccacggaggagatcaacgacatgctcttccgcgacgagctctccaaaaactggacgatggtccggctctggaaccgcgactactgcaacgaggtgcgcacatcgctctccggcagcagcgacaaccgcatttccaacgtgaagaaggcgtgcgggctgctcgacgggctggtgctcatccccggacagacgctctccttcaacgacacgctcggcgagcgcacggaagtcaacggctggaagcccgccacggcctacgccaacggcgaggtccggcaggaatacggcggcggcatctgccaggtgagctccacgctctacaacgccgtgctctacgccaatctggagatcgtcgagcgcgcctgccaccagttccaggtgggctatctcccctggggcatggacgccacggtgagctggggctggccggacttcaagttccgcaatgacgccgagtaccccgtcaagatccacgcgtgggtagacgaggagacgaacgagtgctgcgtccagatcctcggcaccgatgtgaagcaccagtatgtgctcatgcagttcaacaactgggaggtcttcgacgagaccggcacgtattttgacgccaacggcaatccgctctccgtcggcatggcggcggcaacgtggcggctggtgttcaacgacggcgacgattacaacaccgccacccccatcagcaaggaatacgaggcctacagcacctacaattaccacaccgaggacatcgaagcccgcaacgtcccgcagggctga

SEQ ID NO: 1864 - DNA, 1830 bp, Unknown
  Artificiall/Consensus sequence
gtgaccaagatcgaggagctgcgcgagaaagccaaccgcctgccgcttctgccgggcgtctatattatgttggacgcttccggcgaggtgatctacgtcggcaaggctaaggcgctcaaaaaccgcgtgacgagctatttccgcggcgaccatctgccgaaggtcgcggcgatggtttcgcacgtgaacgacttcaacgtcatcattgccgagacggaatttgaagcgctcgtgctggaaaactcgctcatcaagcgccacaagccgcattacaacatcctcctcaaggacgataagggctatccgttcctgcgtcttgaccggcgggagccgtacccgcgctttacgctctcaaaccgcgcgaacccggacggggcaaaatactttggcccctacggcggccggggacagacgatgagcatcatcgatacgctctgcaaaacgctgggcctgccgacctgccgccgcgtgttcccgcgcgacatcggcaaggaccggccctgcctgcagtaccagatgggcgcgtgccgcggctggtgccgcggcgagccgggcggggaagagtaccgccgcgcgatcggcgaggccgtggatatccttgaagggcgcagcgcggagctcgtccggcgcatcgagactgagatgaatgccgcggccgaagaccttcggtttgaagaggccgggcgtctgcgcgaccggatgcgcgccgtatccacactggaaaaccgccagcgcgtcatcgccgctgcccgcgccgatacggacgccgtcggtttcgtgcgcggcgcgaaaagctgcttttccgtgctgcactatacgaacggcgacctctccggcaaggatgtatcgctcattgacgatccgacggaaacggacggggaggctctgtccaccctgctgcgccaatattatgttaaccgttcaagctggccgaaaacgatccttctgccgtttgagccggaggataaagaggacattgagcgctggctttcggatatggccgggcggcgcgtgtatctcgaagtgccgcagcgcggcgaccgcgcccgctttgcggaaaaggcggcagtgaacgcccgcgaggagatattgcgctccacgaccgccgagcagcgccggagcaaaacgctctcctggcttcaggaggtgcttcagctcacggaatttccgcaccggatcgaggcctatgatatctccaacaccggcagcacgggcatcgtcgcttccatgacagtgcatgtggacggcaagcccctcaagcgcgattaccggaaattccgcatccgcagcaccgaaacgccggacgactacggctccatgcgcgaggtcatcatgcggcggttcacgcactatctggatgaggacggaaagttctccgcaaggccggacgttttgttcatcgacggcggcgcggagcacgcttcggcggcctgcacggcgctcgaagcgctgggactcagcctgccggtgttcggcatggtgaaggacgacaggcaccgtacgcgcgcgctcataacgccggagggacacgaaatcggcatacaggcaaatcccgccgcgttcgcgcttgtaggccgcattcaggaggaaacgcaccgcttcgccatcgagtatcaccgctcgctgcgcgacagcgtgcgcggctccacactcgataagatccccggcgtcggggaaaaacggagaaacgatcttttgaagaccttcggctcggtgcgcgcgatccgcgcagcgagcgcggaggagcttgcccgggccgtgccgaaaaacacggcgcaggctgtatacgactattttcacaaaaccgaggaggaaacaccatgcgagtga

SEQ ID NO: 1865 - DNA, 1374 bp, Unknown
  Artificiall/Consensus sequence
ccgatggcagagactaccgtcactctcgaaagcacgctctccgcgctgatcgaggggaagaaatacgccgcgctccgggacattctcgtaacgatgaacccggcggacgtggcggcggtttttgaagagacggatgagcttgccctgccgctccttttccggctgctgccgaaggagctggcggcggaaacattcgtcgaaatgcagcccgagcagcaggagctgctcatccgcggcttttcggacaccgagctcaaagaggtcgtggacgagctgtatgtggacgacgcggtcgatctcgtcgaggagatgcccgcgaacgtcgtaaagcgcattctccggcaggccgaccccgacatgcgccggatgatcaacgagatcctgcgctatccggaggacagcgccggcagcatcatgacaacggagttcgtctccctccgcccgcagatgaccgtggaggaggcgaccaagcgcatcaagcgcaccggcgtcgataaggaaacgatcaacacctgctatgtgatcgacaagggccggctcatcggcgcgctctcgctgcgcacgctcatcctctcggacgacgacgacgtgatcgaggacatcatggagccgaacgtcatttccgtcacgacgtccgaggaccaggagaccgtcgcgcagatgttctccaagtataacttcaacgccctcccggtcgtggacaccgaaaaccggctcgtcggcatcgtcaccgtagacgacgccatcgacgttatggaagaagaggccaccgaggacattgaaaagatggccggtatggcgccttcggagcggccgtatctctatacgagcgtgctcgaaacatggaaagcgcgtattccgtggcttctcatcctcatgctctcggccacgttcacgggcctcatcatcaaccatttccaaaaccagctcgcggcatgccttgtgctctcgtcgttcatcccgatgctctccggcacgggcggcaacagcggcacgcaggcgtccgtcgccgtcatccgcggtctcgcgctcggcgagatcgagttttccgatctctgggcggtcatctggaaggagatccgcgtgagcgtcctctgcggcgtgtgcctcgcgggcgcgaatttcgccaaaatgatgctcgtggacaacctgctgctccacaacggcgtcaccgcgctcgtcgcggcggtcgtgtgtctgacgctcgtgtgcgtcgtgttcatcgcaaagctcgtcggctgctcgctgccgatcctcgcggaaaagctggggtttgaccccgcggtcatggcaagcccgttcatcacgacgatcgtggacgttctgtccctgctgatctatttttccatcgcctccgccctgctggggctgtaa

SEQ ID NO: 1866 - DNA, 1824 bp, Unknown
  Artificiall/Consensus sequence
atggatgaaaagaaggtaacgtccgccccggagcagtccggggatcgggaccaggcgctgttcgcctcgatccggcgcgaaaagcagcgcaaaaagcgccgccgcatcattgtgacggtgtcgatcgttgtggtgctcgcgctcgccattttcttcggcgtgcgcgcggcaaagaaaaaggtcagtgaggccgtcggcagcatgaaggccccgaccgtgagcgaggcgaccgtcacgaccggcagcatcagcacgaccgtttccggctcgggcatactcaccgacgcggacacgcagcagatcgtcctgcccaagggcgtgaagctcgaaaagatcctcgtcaaagcgggcgagaccgtgaagaagggcgacgcgctcgccacggtggagctctcctccgttatgggcgcgatgagcactgtgcaggcggagctcaataagctcgacgagcagctgcgcgccgcgaccggcgaaacggtgcagccgtacataacgaccggcgtgaacggccgcgtgaagatcgtctacgcgcagaaggatgatgacgtctctgcctgcatgatggagcacggcgctctcgcggtgctctcgcttgacgggtacatggccgtggatatcgacgccggctctctcgccgcgggcgacaaggtcagcgtgaccgtagacgaaaagacgtaccccggcacggtggacaagctccagagcggcaaggcgaccgtcctcctcaccgacaacggcccggcggtcgatgctgcggccagcgtgcaggatgcggacggcaatgccgtcggcagcggcacgctctatatccacaacccgctgcgcatcaccggctatgcgggcgttgtctccgcggtaaacgccgccgagaaccggcaggtgtacgcgggcaactccctcttcacgctgcgcgacacggcctacagcgcgaactacgaatccgtcctcaagaaccgccgtgagaaagaggaggatctcatggcgctgctcggcatgtacagcgccggagcggtgacagcgccgtttgacggctctgtctcctccattgactacagcgacaaaacgacatcttcctccgataaaacggactcctccgccggcggcggaggcatggtgtacggcggcatgatgaatgcctacacttcctacggctcagacggctcggattcctctggagacggctcgtcctcttccggcagcacggcggcaaccggcgaaacgaagctcctcacgctctcgtcggatacgagcatgaagctcaccgtgagcgtggacgagacggatatcctctccgtgcagaatgggcagaaggcgcagatcaccgtgagcacgatcggcgacgaggtgttctccggcgtcgtaacggcggtggagcgctcggcaaagagcagctacggcatcacgagctacagcgtggagatcacgctcgacaaagacccccgcatgctccccggcatgaccgccaaggcgctcatccgcattgagggcgtggataacgctctgctcatccccgaaaaggcgctgcgccagacgcgcgacagctcgttcgtctatacgacgtatgaccccgccaccggcacgctcggcggtgaaacggcggtcattcccggtcttaccggcggcggcatggtggagatcaccgagggtctcaccgaaggacagaccgtgtactatcaggaggcctacgacccctacgcctattattacggcacgggcggcaacgcgagcggcggcgacgcgtggattgaggacgcgagcggcggcgacgccgctatcgccgaggacgacggctcctacgcggacagcgagccgctggaaggataa

SEQ ID NO: 1867 - DNA, 936 bp, Unknown
  Artificiall/Consensus sequence
atgaaacgaaagatcctttctctgatcctctgctgcgcgctgctcttctctctcgccgcctgcggcaagaccgaagcgccgcagccgacggcaagcgccggaacggagaccgctccgaacagcgaaaaacccgccgcggcggagggcatttcctatgccgatgcctacgcgcagtacaccgcgatctacggcgcgctgctcaacgccgtgcagcagcggctcgacacgcacgacgccagactccaggccgcgtatccggacagctactacatgaactccgattaccttctgctcgtgtacgttccgttcacgacggcgtatccgtcgctcgggcgcgagctgcgcgccgacaatctggacgcagcgcagacgtcgctccgcgaaacgttccccgacgccgtgctcacgatgaccgcgccgggacgcttcgaggcggtatacacctatgtggataagacctccggcacggaggtgcagcgtgagggcaaatgccagtgggactgcgacgggctgaccggcgcgatccgcgtccgcgcgtacattgacggcgagctgaccgagttcaccgagtttgtccccctcggcggcagccggtacctgctctacaccgcgaccgacaaggcgatcgtcgagtacatcgagggcgagatcaccgcgctctggcacgcccaccgcatcagtgagccggcgcagggcctgttccccggcgacatgcggcttatgagcctcgccgagcaggactttttccccggtgagggcgcttccttctccggcacggactggatcaccggcgatgccgacgcgcagtatgtcatcacgctgcaaaacggcgaaatggtttataccggcaagatctcgcaggatctcgttgatcaggacggcaaccgcaccggcatcgtctggcaggacatcgcgccgatcacgctccttgcgtga

SEQ ID NO: 1868 - DNA, 2211 bp, Unknown
  Artificiall/Consensus sequence
atggcagaagaaattattgaacagggctatcgggagcttgccgataccattttggaacataaccccggcgtcgatctcggtcgggtgcgcgcggcgtttgagctggccgaccgcgcccacagcgggcagaagcgcaaggccggcacgccgtatgtgacgcactgcgtcgccgccgcgcagatctgcgcggagatggggctggacgaggacagcatcgtcgcggcgctgctgcacgactgcatcgaggacaccgccatcacccacgaggacatcgcccggcagttcggcgccgaggtcgccgatatcgtggagggcgtcacaaagctcacccgcgtgcagttcacgagccgcgaggacgagcagatggaaaacctccgcaaaatgctcatggcgatggcgaaggacatccgtgtcatcctcatcaagatcgccgacaggctgcacaatatgcgcacgatggaatacatggtcgcgcagaagcagctcgaaaagtcgctcgaaacgatggagatctatgcccccatcgcccaccggctcggcctgcagaaggtgaagtgggagctcgaggatctctcgctcaaatatctcgacccggacggctaccgtgagatcatcacctacctcgacagcaaggcggacgtgctcaacgagttcatgtccgatgtcaagaagaagatcaccgaccggctcacggagtacagcatccacgcaacggtgcagagccgcatcaagcatacctacagcatttaccgcaagatgtatacgcagaagcgcggtctggacgagatcttcgatctctgcgcgttccgcgtcatcgtggacgatattcccgactgctacaatgttctcggccacatccacgacatgttccgccccgtgccgggccgcttcaaggactacattgccacgcccaagcccaacggctaccagagcgtgcatacgaccgtcctcggcgaggagggcatcatgttcgaggtgcagatccgcacctgggagatgcaccgcatcagcgaatacggcattgccgcgcactggaagtacaaatccggcggcgcgggcgtccgcgccggagatgaggagaagttcgcctggatccgccgcctgctcgaagcgcagcaggacaccgacgcgcaggacttcgttcacaatctcaaaatggatatgttcaacgacgaggtgttcgtattcacgccgcagggcgacgtggtgaaccttcccgccggcgcgtgcccgatcgactttgcctacggcatccattccgccgtcggcaaccggatgatcggcgcaaaggtcaacgggcgcatcgtgccgtttgactatacgctgcaaaacggcgatatcgttgatatcatcacgtccaaatccgcgccggggccgagccgcgactggatgacgctctgcaagtccaacgccgcccgctccaagatccgccagtggctcaaaaaggagcgccgcgaggagaacatcgtccgcggcaaggagatgtttgaaagcgagctgcgccgcgcgggacttacgacggcgtatctcgaggacgacgatcttttgcagacatgcatcaaaaagctctccgtcacgagtctcgacgatatgtacgccgccatcggctacggcggcatcacctgcacacgcgcggtcaaccgcttcaaggacgagatcgcccgcgccgcccgcgcgcaggcgcaaagccagaaaagcgagcttgaacggatcaacgaagccgtcgagcgccgcagcgcgcagcagaccaaggcggtgcagggcgttctcgttgagggcatggacaactgcctcatcaaattttcccgctgctgcactccggtgccgggcgatccgatcgtcgggttcatcacgcgcgggcagggcgtttccatccaccgcgccgactgcccgaactatctcaacagtctgtgcaagcgcgaacaggaaggccgctggctgaatgtttcgtgggccgataagacgatggggctttactccacaacgctgcgcattctcgcgcgcgaccgcaacgggctcattctggatattgccgccgtgctcaacgcgctcaacgccaaggtgcgctcgctcaacgcccgctcgctccccgaggggaacgcgctcgtctatgtcaccaccgaggtccccgatctcgcctcgctgcggcttatcatggcgaggatccgcacgctcggcggcgtgcgcgagatcgaccgcggcaacggataa

SEQ ID NO: 1869 - DNA, 1221 bp, Unknown
  Artificiall/Consensus sequence
tccatggaaaaaaataatttacaaacaacggtaaagcagctcgaggagtttctctctgcctattaccgcaagaccggcgttcgccccacccttggcgaggcgcttgatatgatggaaaaggacaatctcctttccgctccgcctgctgttgccgcggccgattccaaggtccagcataccgtggaagagatctgtgatatcatcgattctcagccggtgaatgccaccgcgttccttcagaacacctctccgtcggagtccggtacggctcatgtttccggtgaggacgcgatctttgcgcccggccgcgatgttaccgtgacgcgcgttttctcctacctgagcgcggatgccgcggagtatgactactttacgatcgccgtcgttctcaagggcgagtgcgagttcttctttgctggaacgcccatccccgtcggcgtcggcagcgttatcatcgttcctccgcacacggcgcacatcaaggccgtcccgtcggacgcgtacgtcatagcgctgcatatgcgccgctccacgttcgatgcgcagttcggcgatctcatgacgagcagcgacaaaatgagcattttcttccgcgagtcgatatacggcgagaatgaaatgaattatatgagcatgacggcgaactttgagtcgggaaacgtgctctctacgctgcacgagctcgtcaaggagtgcgcgtccaaggcaccgttcgcgaatctcacctccgtgtgctggacaaagatcttccttgcgtcggtgttccgcacacaggccggaagtgccgccgtgcttcgtgctgcgcgcgatgaatcgacccgtgccgactgcggcgcaattttgcagtacatccagcagaactaccgtaccgtgcgcctgagcacgctggcgagagcgttccattataacgagacctatctctcccgtatgctgcagaactacatgggcatgagctttacggagatcgtccgcggcatcaagatgacccgcgccgaggaatacctctcgacctccacgctccgcatccatgatatctccgcgctcgtcggctacgacagcgtggatcacttctcccgcacgttcaagtctacgcacaacatgtcgccgcaggcctaccgccgtcttacgacgaagcgcgggctgcgcacgctcgcggcctcggccgtgaagggcgagagcgcggaaaagaacgcgaagacggagaaggagaagaacgaataa

SEQ ID NO: 1870 - DNA, 1659 bp, Unknown
  Artificiall/Consensus sequence
atgagatacgccggagaaaagcgcttcaacggctggacagcgctgacgctcgttttgctcgcgctctttttgctgttcgtcatctatcccatcggtatgctgctcatcaagagcctttttaccggcgggaagatcgatctgagctactttgtgaagttcttcacgaagaagtattactggggcgcgctcgtcaacagctttaaggtcacggtcgtgtccacgcttgtagcgtcgctcatcggcgtgccgatggcgtatctgctgcgcagcgtgaagatccgcggcgcgggtctcatcaacatccttatcgtgatctcctatctctcgcccccgttcatcggcgcgtattcgtggatccagctcctgggccggaacggctttatcacccgcatcgcaaacgccctcttcggcgtgaagctgccgggcatttacggctttgccggtatcgtgctcgtcttttctctccagtccttcccgctgatctacatgtatgtttccggcgcgatgaagaatctggacaactccctgaacgaagcggcggagagccttggctgcaacgccttccagcgcgtaacgaagatcatcttcccgctggtgatgccgtcgctgctcgcgggcgcgctgctcgtattcatgcgcgtgtttgccgacttcggcacgcccatgatcatcggcgaggggtataagaccttcccggtcatgctgtatacgcagtttatgggcgaggtcggcacgaacgacggttttgccgccacgatgtgtctgatcgtcatcgttattgcgctgatgttcttcttcctgcaaaaggcgctcggccgccggttcacctattccatgtcggcgctcaagcccatggaggcggtagatccgaagggctggcgcggtgtcgtttcccacatcgtggtgtatctcgtggcgctcgtcgcggcgctgccccagatcacggtgcttgtcacgtccttcatcggcacgatcaacggctcgctcttcaccggcgagtttacgctcgataactaccgcaacatctttgccaagagcaacaccagcgccattaccaacagctacctcttcggcctgatcgccatcgtgatcgtagtcgtatgcggtatactgatctcgtatctcagcgtccgcaagcgcaatgcgctcacctcggtgctcgatgtgctcaccatgttcccgtacatcatccccggctcggtgctcggcatttcgttcctgtacgccttcaacgggcctccgtttatgctcggcggcacggtgctcatcatcgttatatcgctctccatccggcgcatgccgtatacgatccgatcgagcaccgccatcatcgggcagatcagccccagcgtggaggaggcgtccatcagtctcggcgcatcgcagctcaaaacgtttctgcgcgtcacgatccccatgatgctccccggcgttctctccggcgcgatcatgagctggatcacgctcatcagcgagctgagttcctcggtcattctgtacaccagcaagaccatgacgctcaccgtggccatctattccgaggtcatccgcagcaacttcggcaatgcggcggcctactccacgatcctgactctcacttcgatcgtgtcgcttcttgtgtttttcaaactcagcggcaaaaaggacttgagcgtataa

SEQ ID NO: 1871 - DNA, 1608 bp, Unknown
  Artificiall/Consensus sequence
atgaaagcaatggataagctgatcgcgaagatcgacaaaaagctcgagcgctttgaccccatctggcaggccgaacacggcaccggcggccagagaacgcgctattacgataagaccggcgttgcgaagtggcgcgaatggcgcggcgtgaaggacacgctctatgactatacgcagtggctcaataacctctcgagcatggtgcagatggtggcgtccgctcccgtctcctgtctcaagggcttctgggaataccgctggatgggctcgtatctcggcacgttcatgttcatcgaccgcctgtttgagggctaccgcggctatgagctgcgcaccgcgcacacgaacatgcacgccatcgtgcagagccttaccaagcgcatcgcgctcgtcctctccaacgacaagcgcctcggcggcggcccgcgcagcgacgatttcctcccctttgacgaggtgctgcccccgctgtttctgacgggcttcaaggagctgatcccgttcccgctgcagacgctgccggagttcatcatctgcgacgtggaccagcacatcgagccgtactatatcgacgtggccgagtccttcggtctggcggcggacgtgtgctcgcgctgcgccgcggagaccggcgtcgctatcgacgatgcgttccccatcatcggcaaggcgttcctcacgacgaacatgccgtgcaacgcctccgagtgtacctccatgatccagcgccgccgcgtggcgctgccggacttccccgtaacgctcgcgatgatccacaacgagccgggcgcgcacccctattccacgcagatgctcaaggacgccattgccttcgtcgagaaggaatacggcatcaagtatgactgggacgagctgttcaagtacgcccggcttatgaacgagcagaacaccattgagctcgaaaaatgggactacttcaagaccccgtattccgcgctcgtcggcattgccgaaacgctctaccggctgtattcgtgggcgtccgtcaacggcaccgacccgtatttcaacaaggtcgatcgccgcgttatcgagattatgcgccgggcatacgaggaaaagtaccagcctttcggcggaaagacgcgccaccgcgccttcctttgggggccctctgcggtatactataccgacttcccgacctggacgcagaactgctggggcatcaacattgtgctgaacatggactccaccatgggccacaacatgatcgacaccgaagaccccgaccaggcgatccaggatctggcgctcttctccgagaaggccaccatgcgccatcacgccgtcggcggctgggagaatgtcaacgccatctgggagtgggcgaagaactttgactgcgacatggtccttttcaacgacaacatcgcctgcaagggcatgctgggcgtccacgctctcatggaggagcaggcgcgcgagctgggcttccacttcatcttcgtcgagcacgatctggaggactgccgcaccgtatcccggcaggacatgagaaactgcgtcaacaagtatatgtccgtcgttctcaacgagaagccgcttgacccgaccatcgtagagtttgacgactccatggcatactaa

SEQ ID NO: 1872 - DNA, 1248 bp, Unknown
  Artificiall/Consensus sequence
atgagcgaccaagacaaacgcctgggcgtatattttcacataccgttctgcgcatcgaagtgcgcgtactgcgacttttgcagtctgccgggcagggacaagctcatgccctattaccaggatgcgctgctcattcagctgcaggaaacgatgccccgcatgaccgattactttatcgacacggtgtacttcggcggcggcacgccgagctactacggcgcgcggcgcatcgtggagatattgcaggagctgaaggtcacgaaccggctgatgaagcagagcgagatcaccgtggagtgcaacccggacagcgtccggcgcaaggagctgcgcatgctgcgcaaggagggcgtgaaccgcctttccatcggcgcgcagagcgccaacgacgacattctccggctcatcggccgccgccacaactggcggcaggtggaaatggcggtcaagcgcgcgcgcaaggccggattccgcaacgtgagtcttgatctcatctacggtctgccgagccagacgcgcgaggactgggccgacacgctcaccaaggcgctcgcgctcaagcccgcgcacatctcctgctacggtctgcgtcttgaggaaggcacgcccatgtacgacgagtatgagggcaccgacattctcccctccgacgacgatcaggcggacatgtacctttacgccgtggacttcctttcgcgccacggcttccggcagtatgagatctccaacttcgcccgccccggctacgagagccgccacaatctcaagtactggcggctggatgactacatcggcttcggcgcggcggcggcctccaacatcgggctgctgcgctatacctacacccacaacgtccgcgagtatatttccggcgttttgggggacaagggtattatcgccgaagaggaggagctcacgccgttcgaccgcgcgagcgagtatctgatgctcggcatgcgcaccgcggccggcatctcccgcgaggagtaccggagcgtgtaccagagcagcttcgacaagctcgaagagatgctggaggtatttcaggaaaacggctgggccgtgtgcgacaacggccgctggcacttcacgcccggcggattcctcgtttccaacgtcctcatcggcgtgctgctcgaatcgcagacgaaagagaaattcaacgccaacccgtggatccgcgaggcgtttgaggcaaagggacagaaggtcccgctgccgacggcgtccgagccgtatatgaactga

SEQ ID NO: 1873 - DNA, 1677 bp, Unknown
  Artificiall/Consensus sequence
atgttttccgtgaaaataggcggcttctcttccgcaaaggattggggaagcgccgcgacacgggagttcactatgaaagttacctttttgggcgcgacccatgaagtcacgggcagctgcacgctcatcgagtgcgggaataaccgcggccttgttgactgcggcatggagcaggggaaggacatctttgaaaaccagaagctgccggtggcggcgggggagatcgactttgtccttttgacccatgcgcacatcgaccactccggcaatctgccgctgcttttcaaaaacgggttcgacggccccatttacgccacacgcgagacgtgcaatctctgccgcatcatgctgcgcgactgcgcgcacattcaggagagcgaggccgagtggcgcaaccgcaaaagccgccgctccggcggaccggcatatgagccggtctacacgctcgacgacgccgaggccgccatcgcgcatctgcgcccggtgagctatcacgagctggtgcaggtcggcgagcacttcgccgtccgcttcagcgatgtgtgccacctgctcggcagcgcctgcatcgaggtctttatgaccgagaacggcgtggagcgcaagatggtgttcagcggcgatatcggcaatctcaaccagcccatcatccgcaacgtgccggaaacggtcgcggacgcggactatgttatgatcgaatcgacctacggcgaccgcctgcatgaccgccatgtcccgccggtcaagctgctggccgattatatccagcgcacgctcgaccgcggcggcaatctcgtcatcccgtcgttcgccgtcggacgcacgcaggagatgctctactatatccgcgagatccgcgagaaaaagctcgtcaccggtcacgacggcttccctgtctacgtggacagccccatggcaaacgaggcgacggcgatctatctccagtgcggccacgaatgtttcgacgaggagacccgcgctctcgtggacgccgggatcaaccccatctggtcggacggcatccgcatttccgtttcgagcgaggattccaaggccatcaacgaaaaccccgagcccaaggtcatcctctcggcgagcggcatgtgcgaggcgggacgcatccgtcaccatctcaagcacaatctctggcggaaggagagcacggtgctctttgtcggctatcaggcggagggaacgctcggccgcaggctctatgacggcgaaaagcatgtaaagctcttcggcgaggatatcgaggtcaactgcgagatcggcttcctgcccggcaagagcggccatgccgaccgcgacgggctcaccgcgtggctcgcgggctttgagaaaaagccgaagcttgtgttcgtgaaccacggcgaggacgccgtgacggacgcatttgccggctatctggagaccgagcacggctataaggcgttcgcgccttacagcggcacggtgttcgatctcgccgaggggaaattcctcgtctgtccgaagggcgtgccggtcaaaaaggcggagaccgcttcgggcgccaaggcgagcgggctttatcaaaagctcgtcgccgccggagaatcgctcctttctctcatccgcgcgagccgcggcaagccgaacaaaacgctcaaacacttcctttcggacgtggaagagcttctcaaaaaatatcgctga

SEQ ID NO: 1874 - DNA, 1737 bp, Unknown
  Artificiall/Consensus sequence
atggcatttcccgaacggtttctcgacgagctgaccgagcgcaacgacattgtggacgtggtgagtcagtacgtccggctgacaaaaaagagcggggcgaacctcttcggtctgtgcccgttccacagcgagaaaacgccctcgttctccgttgcgcccgataagcagatctaccactgcttcggctgcggaaagggcggcggcgtcatcaacttcatcatggagatcgaaaatctctcgttcccggacgccgtggcgtttctggcgcggcgcgcgaacatgcctctgccggaggaagcgcagagcgaggatacgtcccgccgggcgcggctattggagctcaaccgggacgcggcgcggtttttccatgatatgctcaaatcgccgcagggcagcccggcgcaggactatgtccgccgccgcgccatttctcccgcgatggtcacgcgcttcggtctcggctttgcgcccgattcgtgggaatcgctcgcgaacgcgatgcgcaggaaggggtacagcgatcaggagatgttcgaggccgggctcgtgaagcacggcaagtccggcggcgtgtacgacgccttccgcaaccgcctcatgttcccggtcatcgatgtgcgcggcagcgtgatcggcttttccggccgcattctcggcgacggcgagccgaagtacttaaacagccccgaaacgcccgttttcagcaaaagccataatcttttcggtttgaatctggctaaaaagtcaaaaaacgggtatatcattctcgtagaaggcaacattgacgtcgtctccctgcatcaggcggggtttgacggcgcggtcgcctcgctcggcacgtcgctcacgcccgagcaggcgcggcttatttcgcgctacacgaacgaggtcgttctctgctacgacagcgacgaggcgggaaaaaaggcggcctcgcgcggcatcggcattctcgaaaagctcgatctcaaggtgcgcgtattgcaggtgccgggcgcgaaggacccggacgagttcatcaagaaaaacggcgcggacgccttccgcaatctcattgacgcgagcgccggacagatcgaataccggctgcgcgacgtggaagcgaaaaacccgcccacgaccgacgaggggcgcgtggactatctcaagagcgcggcctcgcttctggcgtcgctgccgggcgcggtcgagcgcgaggtatacgccgcgcgcgtggcggaaaaggcgggcgtatcgcgcgaggcggtgctgcaggaggccgaacggctgcgccgccgccgcattgccgacgcgaaaaagcgggaagcgcgcgacgccgcccgccccacgcagacggcgcagcccgcgcagcgctccatccggtacgacgatccgcgctcggcgcgcgcggaggaaggcctgatccggatactgtatctcgatccgggcgcggcgaagggcaagaccctgccgccgccggagagcttttcctctcccgtgctcgcgcggctctaccgcgagcttctgcgccgcgtgcagaccggcgagacgatctccatggcggtgctggcaggacagttcaccggcgacgagatgagccacttcacctcggtgctcggcgcgccggaggacctttcccacgcggacaaggccatatccgattacatagccgttattaccggacgcacggaggacgccgaggacgatctccgcgctctggcggaaaaatacagaaagacaaaaagttttggaggataa

SEQ ID NO: 1875 - DNA, 2349 bp, Unknown
  Artificiall/Consensus sequence
atgagcgaaaataccagccgaatcatgacattgccgacgctcgcgctccgcggcgtttcagtatttcccggaacggtgctgcactttgatgtggagcgcccgatgagcattgccgcgctcaacgccgccatcggcaccgaccggatgatctttcttgtagcgcagcgtgacatcgcctgcgacacgccccgcgcagacgatctctacacggtcggcacgatctgccgcctgagccagatcctgcgcgcgcccggcggcggaaacgtcaaatgcatcgttgacgggctataccgcgcgaagctcctgcgcctcacggcggagaccccggcgctttgggcaaatgtccgggtgcttgccgataagccggtcgatacggacacgctcgaatgcacggcgcttatccgttcgtgcaacgacctctttgccgagtacgcctccgcgtcgggaacgatcggaccggagactctgcttcgtgtagcggaccggaaggagccgggcttcgtctcggactacattgcacagaacgtctttctgcagccggcggaaaagcagctgcttctggaagagtgctcgccgcttcagcggctcaccatgctctgcgatatgctgcaccgcgagctggagatcatggatatccagcagaatctccagtccacggcggcggagcgcgtggcgaaaaatcagaaggactatttcctgcgcgagcagatgcgcgtgatccaggaggaactgggggaagcgtccgaaacggacgatctcgacgaataccgccggaagatccttgatctcggactcgatgcggagatcgagaaaaagcttctcaaggagctctcccgtctcgccaagcagccgttcgggtcggcggaaggcgcggtgctgcggacctatcttgacgtctgtctcgagcttccgtggaacgagaggacgaaggacgtcaccgacatcgcccacgcgaaaaaggttctggatgaggatcactacggtcttacgaaggtcaaggaccgtatattggagtatcttgccgtgcggcagctctccgcgcaggtcaagggcggggtgctctgtctcgtagggcctccgggcgtcggcaagacgagcatcgccatgagcattgcccgcgcaacgaaccggaaatgcgcccgcatctccctcggcggcgtgcacgacgaagcggagatccgcggccaccggaaaacctatgtcggcgcgatgccggggcggatcatcgccggcattcagcaggcgggctcccggaatcccgtgctcgtgctcgacgagatcgataagcttggctcggactaccggggcgacccgtccgccgcactgctcgaagcgcttgacggcgagcagaacggctccttccgcgatcattttctggagatcccgttcgacctctccgaggtcttgttcatcacgacggccaacaccgccgacaccatcccccgcgccctgctcgaccgtatggaggtcatttccctcggcagctataccgacgaggaaaagctccagatcgccaagcagcatctgctgccgaagcagcggacgaagtacggcctttccggaaaccagctgcgtgtttcggacgatgccgtccgcgagatcatagcgctctatacccgcgagtcgggcgtgcgcatgcttgaacgcgaactggccgcgctctgccggaaggcggcccgcggcattgcctccggggagagaaggtctctgcggctgcgcgcgggcgagctcgagccgtggctcggccccgtcaaattcaagccggaggtcaacttctcgaccgattccgtaggtcttgttcacggccttgcgtggacgagcgtcggtggcgaggtgctcgatgtggagtgctctgtcgtgccgggcagcggaaagcttgagctgaccggaaatctcggcgatgtgatgaaggaatcgtgccaggcggcggtaacgtacatccgcagccgcacttccgagctcggcattgatccggctttccataagaataccgatattcatctgcatttcccggaaggcgccgtgccgaaggacggcccgagtgccggcgccgcgatctgtttgtgcgtcgtttccgcgcttacgaaccgtccggtccgcgccgatatcgccatgaccggtgagattacgctgcgcggccgcgtgctgccgatcggcggcattcaggaaaagacgatggcagcgctccgcgccgggatccatgaggtgcttctaccggaggacaacgtgagcgatcttgccgagatggatccgaacgtgcgcaacgccgtgaactttacggcggtttcccacatggatcaggtgctgaaaaaggcgctccgcccggcgggggagaaggtggcggaatga

SEQ ID NO: 1876 - DNA, 1320 bp, Unknown
  Artificiall/Consensus sequence
gccggaaagaaaaggacaaagccgatgaataattcaaacgaaacgaaagaaaggaaaaagctggatctcaaacgaatcacggacagccgtgttttctggatgatcctctcgctgcttgcggcgtcgcttctctggatgtatgtgacgacgaccgagggcgttgaggtggaaaaaacgctcaccggcgtaaagatcgagtttctcggtgcggacgcgatgcgcgcgtcgagcgatctcatcgtcaccgagcaggaccgcaccaccgttaacctgacgctctccggcacgcgccgcgtgctctccaagctcacaaactccaacgtgacggcaacggtgaatctcagcaacgttgcggcggacgggcggtattcggtttcctacgatatctcctatcccgccggcgtgaacgcgaacgaaataacgctcgtccacacgtcatcggacgtcgtgaatttctatgtggacaagctagcccgcaagaccattgaggtcaagggcgcgttcaccggcaacacggcggacggatatcttgccgacgagagcatggtgttcgatcctctggtcgttgccatcagcgggccgaagacggtcatctccaaagtcgaccatgcgtttgtggccattacgcgtgaggacgtggaccgcacgctgagctattccacgacgtattctctcgtcgattccgacgataacccgatcgaagactcttccatccagcgtgaaacggaagaagtcaccgttacgctgaacgtgctctccacgaaggaagtgccgcttgacgtaacgatcatcgacggcggcggcgcaacgcgcgacgccaatacccgcattgacattgaaccgaagacgatcatgctcgcgggagatgcctctgccatcgacagcacgacgaagctcattctcggcacgatcaatctttcgagcttcgccacggacttctccgccacctacaccatcatcccgccgaacggcaccgagaatatgaccggcgttaccgaggcaacggtgagagtatccatcacgggcgttgctacgaagtccttctccgtgaatccggaaaatatcgtctgcatcaacgttcccgacggctacaccgcggagaacatcacgcaggcgctcaacgtaacggtccgcgccccgcaggaagtccttgaccagatcagcgaggtaaatctccgcgctgtggccgatctctccaatctcggcacgaacgcctccggcgttttcaccccgacggtcgagatcaagatcgacggcttccccgaagcgggctgcgtcggcgaatataagatctatatcacgctcaaggaaaagcattaa

SEQ ID NO: 1877 - DNA, 1866 bp, Unknown
  Artificiall/Consensus sequence
atgccgaaccgtaatccgggtacgtatttattgcgcgaaccaccctatttttgcatcgtgaacccgccgacgggcggacggaacgaacctgataaaaacagaaacgatatgtatttggagaaaatcgactccccggcagatgtgaaacggctttccgtcggggaactcaccctgctgagcggtgagatccgtgaagcgctgctgcacaaggtcagcgcgcacggcgggcacttcgggcccaatctgggcatggtcgaggcgaccgtggccctgcactatgttttcgattcgccgaaagacaagctcgtcttcgacgtttcgcaccagagttacgtgcacaagatgctgaccggacgccgccgggcgttcctcgatcctgcggaatacgacggggtttcgggttattccgaaccgtcggagagcgaacacgaccacttcgtcatcggccacacctccacgtcggtcagtctggcgggcggactggccaaggcccgcgacttgcagggcggcgaagggaatgtcgtggccgtcatcggcgacggatcgctgagtggaggcgaggcgttcgaggggctggactacgctgccgaactgggcacgaatttcatcgtcgtcgtgaacgacaaccagatgtccattgccgagaatcacggcgggctctacggcaatctgcaagagctgcgcgagagcggcggaaactgcgcctgcaacttcttccgggcgatgggcttcgattatcgctatgtcgccgacggcaacgacgtggaggctctgatcggggcgttctccgccgtgaaggatacggcgcatcccgtcgtcgtgcatatcaatacgctgaaaggcaagggatacgcccgtgccgagcaggaccgggagacctaccattggcgggcgccgttcgacctgacgacgggtgaaccgacggctccggccggagcggaggggtacgacgcgctgacggcgcgctatctgctcgaacggatgaagcaggacccgcgcgtggtggccattacgtcgggaaccccttcggtgatgggcttcacgccggagcgccgccgggaggccggggcgcagttcgtggatgtcggcatcgccgaggagcatgccgtggccctggcctccggaattgccaagggcggcggcaaacccgtctacggagtttacagcacgttcattcagcgggcgtacgaccagctttcgcaggacctttgcatcaacggcaatccggccgtgctgctggttttctggggctcgctgacggcgatgaacgacgttacgcacctctgtttcttcgacattccgctgctggggaacattccgaatctggtctatctggctccgatctgccgggaggagtatttcgccatgttggattggagcatgcgccagacggagcaccccgtggctatccgcgttccggccgcggaggtttcctcgcgcgaggggttcgtcgcggcggattacggcgaactgaaccgctacgaggtcgtccgtcggggaagcggcgtggccgtcgtggcgctgggttccttcttcgggctcggcgaggaggttgcggagttgctgaaagagcggacgggaatcgaagccacgctgatcaatccgcgctacattaccggcatcgacgaagcgctgctgtcggaactgaaagccgatcaccggctggtggtgacgctggaagacggcgtgctggacggcggtttcggcgagaagatcgcacgcttctacggcacgtcggagatgaaggtgctcaactgcggggcccggaaggagttcgcagaccgcttcgatcccgaagagttcctgcgcgaaaaccggctcacgcccggacagatcgtagaggatgtcgtcacagtcatgaattga

SEQ ID NO: 1878 - DNA, 2079 bp, Unknown
  Artificiall/Consensus sequence
atgagaaagagcgttgcaatcatcgcactactgctgtttccggcgctgctgcgggcgcagtcggaccgatccgagaccggcgcggcgtcgtggcgggaaaagggcgtcgtgcccatccgcgaagtcccggtctggggccgccggccgatgaaaagcatcggcgtgcaggagacccggctcgactccttgatcctgaaagagaacatcgccctgtcgatcgccgacgtgctgaccttcaactcgccgatcttcgtcaaacagtacggccgggcgaccctctcgaccgtatcgttccgcggcacgggcccctcgcacacgcaggtgacgtggaacggcatgcgcatcaacaatccgatgctgggcatgaccgacttttcgatgatcccgtcgtacttcatcgacgacgcctcgttgctgcacggcacctcgtcggtgaacgagacgggcggcgggctgggcggactggtgaggctctcgacggccccggccgacatccgcggattcggactgcaatacatccagggaatcggcatgttcaggaccttcgacgaattcctgcgcctcgaatggggcgacgagcactggcaggtctcgacccgcgccgtctaccagtcctcggccaacgacttcaaataccgcaaccgcgacaagaaggagaacatctacgacgacgagatgaacatcgtcggatcgtattatcccaccgagcgcaacaagagcggcgccttcgacgacgtgcatgtcttgcaggaggtttactacgacacgaggcggggcgaccgtttcggactgaacgcctggtatatcaactcgaaccgcgagctgccgctgctgacgaccgactatgccgacgacaaacagttcgagaaccgccagcgggagcacaccctgcgcagcgtgctttcgtgggaccactaccggagcgactggaagttcgcggcgaaagcggggtatatccatacgtggatggcctacgactaccggaaggaccccggcagcgggatcatgaactcgataacccgctcgcgcaacaaggtagacaccttctacggacaggccgacggagagtacacgcccaacggaaactggttcttcacggcaggcatttcggcccatcagcatctggtcgaaagcatcgacaaggacatcatcctgcaacagggcggcaaagacatcgtcggatacgacaaggggcgcatcgaactctcggcatcggtctcggccaagtggcgccccacggagcggctggggctgtcggcggtcctgcgcgaagagatgtacggcacgaaatgggcgacggttccggcctttttcgccgactgccagctgtcgaagcgcggcaacatcgtcgccaaagcctccgtgtcgcgcaaccaccgcttcccgacgctcaacgacctctacttccttccgggcggcaatcccgacctgcggagcgaaagcggcttcagctacgaagcgggattgtcgttcgccgtggggaaggagaacgtctactcgctgtcgggatcggcgtcgtggtacgaccagcatatcgacgactggattctgtggctctcgacgcccaaagggttcttctcgccgcggaacatcaagcaggtgcatgcctacggcgtggagatgcaggccagcctggccgtcataccggcccgggattggaaactgacgatgaacggcacgttctcgtggtccccgtcgatcaacgagggcgagccgataagccccgctgaccagtccgtcggcaagcagctgccctacgaaccggagttctcggccacggtgaccggacggctcacgtggcggagctgggggctgttgtaccagttctgctattacagcgagcgctacaccatgtcgagcaacgacatcaccctcagcggccggctgacgccctacctgatgaacaacctctcgctcgacaaggctttcgccctgaaatgggccgacctcacgctcaaaggaaccgtcaacaaccttttcaacgaggaatacctctcggtgaccgcacgcccgatgccgcgcatgaacgtcgagttcttcatcggcatcagacccaagtggggcggtcggaatcagtaa

SEQ ID NO: 1879 - DNA, 3225 bp, Unknown
  Artificiall/Consensus sequence
ggggggggaaatccgatcaacctgaacgccacggtgagtatcgcggcgacggaacaacccgtcgggacgatactggatgaaattaccaaaaagaccgggatcaagatcgcttacgatcccgaagacatccgccggctcccgcccgtaagcggggaattcaaaaaggcggcgatctcggacgtgctcgaccgctgcatcgccggatcgagtttcaaataccagatcgaaaacaacgtcgtgctggtctacgacacgacggtcaagacgcgccgcttcaccgtagcgggcacggtctacgactcgaacaatacggtgctgcccggtgccacggtgctgctggcaaacggatcgggacagggagtctcgaccgacgaaaagggtgaattcaccttctccttcacgaccaagacgagccccgccctgctggaagtgggattcctgggcatggagacacgccaggtagtggtcacgggctcgatgaaagggctcaaagtgaagctcaaggagggcggcacgcagatcgaggacgtggtggtcaacggcatgttctcgcgcaacaagagcacgttcaccggttcggtgaccacggtcaagggcgaagagctcgtttcgatctcgaacaccaatctcatgacggccctgagcgccgtgaccccgggcatggtggtcgtacagaacaacgcactcggctcgaaccccaacgccattcccgaaatcctgatccgcggttcgaactccatcgccacctcggccgaggagaaagcctacaacaacccgctcatcatcctcgacggcgccgaaatctcgatggaggagctttatgacctcgacatgtacgagatcgagcgcatcgacgttctgaaagacgctcaggccgccatcgtctacggcgaccgcgccgccaacggcgtgatcgtcatcgaacgccagcaggtgacggacagcaaaccccgtctgagctacaacttcgttcccgaactgagcatccccgacctgagttcgataaacctgaccaatgccgctcagaaactggagctggaacggctggcaggcttctacgaaacggccgacgggtcgatggacaaagcctacgcctacaaattgcagaacgtccgccgcggcatcaacaccgactggatacgcgccccgctgcgcgtgccgttcagccacacccattcgctttcgctgagcggccgcgcccagaagatcgactaccgcgcgtcgctgcgtttcagcgacaaatacggcgtcatgaagggcgacaaccgccgcaactacacgctcaacttctcggtgggctaccactcgcgggacaaactcacgctgcgctacacggccaactattcgctgaccgactccaaagagtcgccctacggcaatttcagcgcctacacgaaactgaatccctacgaatcgccctacgacgaatacggcgatctggtgaaggcgttctatttcaaccccgaagacccctcgacgaccagccagggattccaggccaacccgctctacaacgccacgctgtcgagcttctcgaccgcccggacccagaatctgcgcaacacggtcgatgccaaatgggagattacgcccgacttctacgtcagcggccagttcaacgtcgatatagaaagcagccagtccgaccgttacatctcgcccgacgacgcacagttcctcagcaagtcggagccctcggagcggggaacctaccgcctgggcaccagcaagggattcaactacgacggcaagatcgtgctcaactacggccgttcgctcgacagccagggatcgggattcgtgatcaacgccggaacggacatccagcacacgaacctcacctcgtcgtacgtcacagccatgggcttcctgaaagacgaactttcggacatcaaatacgcgctggggtacgatccgagcaacctgccctccggcagcgaaacgctgctggccaaagtgggattcttcgccagcggcaacatctacttccgcaaccgctatttcgccgacatctcctaccggacctccggctcgtcggcctacggctcggagaaccgcttcgcaccgatgtggtcgttcggtctgggctggaacctccacaaggagaaattcctcgacgatgtggagtggatcgacgtaatgcgcctcacctggtcgtggggttacaacggccaaaccaccggcagcccctatcaggccatcaccacgtaccgctatgacaacaagaacatgtactacacgggggtgggaaccgtcccgatccgcatgggcaaccccgaactgaaatggcagcgcgtactgaaaaacaacatcggcatcgacctcacgctcttcaaggagcgtctggtcctgagtttcgactatttccgcaacacgaccaaggaccagctgatgagcattccgctcccggcctcgaccggcgccgagaacatcacggtgaacttcggcgagaaccagaacacgggttacgacttctcggtcgccgcacagatcatccgcaaccgcaactgggcgtggacctcggtgatcaacggctcgcacgtcaaggaccgcatcaagcgcatcagcaatacgctgaagaacacctcctatcaggtcgatctggacagcccgctgatgctgcggttccgggagggcggctcgcaatacgacatctacgccgtgcgttcggccggcatcgaccccgccacgggacaggagatcttcatcaagaagaacggcgaatacaccttcaaatacgacaccgaagacgaagtggtcgtgggcaacacgcagcccaaactgcaaggcacgtggctcaacacgctgcgctacaagggctggtcgctgaatttcgtattcagctacacgttcggcggagacacctacaacaagaccctctgggagaaggtcgagaacatcgacccgcgctacaatgtcgatgaacgcgccttcaccgaccgctggaagaaccccggcgacctgtcgcgctacctggccatccgccaaaccacgcaaacgtacaactcggaacgtttcgtggaacgcctcaacgaactgtggctgtcgagcgcgacgatctcctacgagttccaggccaagttcctcaaacggctcggattcaaacgcctggccgtcggcgtcggcgtcacggacctcgtgcgtttttccagcgtgaagtacgaacgtggtacgagctatccgtacagccgtacgatcaacctgatgttccgtcccactttctaa

SEQ ID NO: 1880 - DNA, 1281 bp, Unknown
  Artificiall/Consensus sequence
ttggaagaagctcatccctggatcgcttacaacgggttctcgccccagatcgccgtgctgtgcgcggtgacgttctgtctgctgtgtgtttcggcgctcgtatcgggtgccgagacttcgtttttctccctttcgcacaacgatgtccgccgtttgcagaacagcaagagcatgtcggccgctgccgtgctgcgcctgctgaccgatgtcgatctgctgttggccacgatcctggtggtcaacaatctggtgaatatctgcatcgtcattcttacggccaatatcatcgactcgcttttcacgttcctgcgtttcgaattcctgttcaagaccgtgttggtgaccttcctgctgctgctcttcggcgagatcctgcccaaggtgctggcgcagaccatccccgtgaggttcgcctcgatggtggcccggcccctcgtgctgctgcggtggattttctacccgctgtcgtacatcctcgtccgcacgagcagccgcatcagcgaaaaggccgcccacaggagcgaaatatcgttggacgaactggccgacgccgtggacatgacccagagcacgagccccgaggagcacgtgatgctgtcggggatcgtcaacttcgtcaataccgaggtgcaggagatcatgaaaccccgcgtggacatcacggcgctcgatgccacggacgactacgaaacggtcaagaagacgatcatcgaatcgggattctcgcgcatcccggtctacgaggaggatatcgacaacatccgcggcacgctctacgtcaaggacctgctgccctacatcaacaacggcagcgatttcgcctggcagcagctggtccgcaaaccctacttcgtgcccgagcacaagaagatcaacgacctgctggccgatttccagtcgaacaaggtccacatggccatcgtcgtcgatgagtacggttcgacgctggggctggtttcgctggaggacatcatcgaggagatcgtgggcgagatctccgacgagagcgacaacgacgagtcgttctatacgtgtctcggtcccaagtgctatctcttcgagggcaagacccacctcggggatttcgaacgcatcctcggcatcgacgaggacaccttcgccgacgtgcagggcgaggccgagaccctcgcggggctgatgctcgaactcaagcgcgactttccgcgcaaaggcgacgccttcacggcgcacgacatccgtttcacggtgcaggagatggacgggcaccgcatcgacaaaatccgcgtggacatcccatga

SEQ ID NO: 1881 - DNA, 2361 bp, Unknown
  Artificiall/Consensus sequence
atgaaaagagcaatcctcctcatcgtcattctggcttcggtcgcaagccgactctccgcggcccgtctctgcccttcgacggggcgcgtggtggacgaacagggcaacgccgtcgaatatgcgacggtcgtgctgctgaaaggcgcagagcaggtggcgggccggacgaccgacgcccggggacggttcgaactgaaggccgcaccgggcgactacacgctgcaaattcagtttctcgggttcgaccccgtgacgaaagcggtgcgcgtggaggcggacaacgatctgggcgtattcgtgatgcgggcctcggccaccggcatcgagagcgtggtggtgaaggctcagctggtgcggcgcgaggcggaccgcttcgtggtcgatgtggccaacgccccggcggccatcggcaaggacggcatcgaactgctcgaacgggcgcccggcgtctggatcgacggcgaaaagatctcgatcaacggcaaaagcggctcgaaaatctacgtcaacgaccgggagctgcgcatggagcccgaacagctgctgacctacctgcggtcgctccgggccgaagagattcggaaaatcgaggtcgtgcccgtgacgggcgccgactacgacgccgactcggcgggcggcgtgatccgcatcacgctcaaaaagcgccgcgagaacggcatcgacggctcggtggcgtacaacacgacgcagtcgggcatcaccgaccgccacaatccctcggccaacatcaacgtccactcgggccgcgcggacctctacgcctcggcgtggggatctttcgggagcgacagaacgatcaccgacgagcaaacgctctacaatgcggtggacaagtcgctcaacgcccattcggagatgaagggccgcacccgcagcttcggggccagcgccgggacggtcgtcgagatcgcctcgcggcacagcatcggcgcggagctcgaatactggcgcaaccgcgacggagagcccaacgacacctacaccgatttccggacggcggacgagacggtccgcacggagagccggttcgacaaccgcaaccaccgggacaactattcggcgacgttcaactacatctggaagatcgacacgctgggctcgacgctcaagctgctggccgactatacgcgccgcgaaaccgacacccggaacgacaacgagagccgcatcacggcccccggaagcgtcctcgactcggtctaccgcgacaacgccacgagtctctacgacatcgccgcggcgacgctggccctcgaaaagcacttttcgccccgctggtcgctgaaagccggcgccaaatacacccgcaacgacatgcgcaacgacgcgctctacgaataccgcaggggcgacgcatggctgcgcaacgagcggcagagcttcacgatcaactacacggagaacatcgcggcggcctacgccatcgcctcggcgaaactcggcgccgtgagtttcgtggcgggagtgcgcggcgagtacacccacacgacgggaaaaggcgtcgggcaggactacttctcgctcttccccaacgccagcctctcctggagcgtctcggagcagcaaggctggtcgctgatcgtccagtacgcccggaccatcgagcgtccgcggttctggagcctcagcccccagcggatgcagctctcggactacacctaccagaccggaaatccgtcgctcgacccgtcgttcaagcacgacgtgagcctgacgctggtggccgcccacaaatacaccctcacggcgggcgtgcagatcgtgaacgacgaaatccagcagacgatgaaggccgactccgagaactccgacctgctgcaagtggcctgggtcaactacgacgccacgaaaggctattacctctcggtcaacctcccgttccagcccgcgaagtggtggcagctgaacgccgacatcacctacatgcgccgcggacagcgcgtcgaacagcacggcgccgaggagttcttcgactggggattcgtcaacctctcgacgaccctcaccctcccggcgaaattctacatcgacctctcctaccgctaccagagccgggtggatctgggcaactgctgggtgaatcccgaccaccggctgcaagccggcgtcaagaaacgcttcggcgaccgtttcaccgcctcgttctcggtgcagaatctgctggaccaggggcaggtgatcggagcccgcggcgacgggttcgtccgcacggtggacgcccggcagacgtggagcaaccgtacgtatcgcatcggggtgacgtggaacttcaaatcgggcaaagccttcaagcgcaaggccgtcgaggcgggttcggccgacgaaaagaaccgtctgtaa

SEQ ID NO: 1882 - DNA, 1662 bp, Unknown
  Artificiall/Consensus sequence
atgaaaaacctgttgtttaccgccctgctgctcgccgcaacgccatccatcctggcacagaacgacctgaaaagcgtgctctcgcaactcgacgccaccctctcgcaccgcgactcctacatcgcaggccgcgaacaacggatcgaatcgctgaaaagcatcctcggcaaatcggacttttcggacgcccagcgttacatcctgaaccaacaactgatcgacgaatacaccccctaccaggccgattccacgatcgactacctctaccgcaacatcaatctggccaaaaagatgcacgacgcacggcgcctcgacgagagccgcatccaactggcctacctttacagttcagcgggcatctacctcgaagcggccacccttctgcaacagatcgacaccgcgaaactcgaccggaaacagctggtcgattactacgtcgcccgccacaaactcaacgacgaactccaactctactcccacgactcggtacagggcacgcaatcgtggcacctcacggtgctctacgcccggctgatcgtggaaaacaccgagccggaatcgaccacgcacctcaatttcaagctctggcaggcgatcaacgaccgcaattacgagcaggcggtggagatctccgaacggctgtgcaacaccctgccgcccctttcgcgcggctacgccgaggcgtcgtacatgcgggcgctggtggcggacctgatgaaggacaccctcacggcgcaggtgtggttcgcccgctcggcgatgaccgacatccagctggcgatccgcgacaatgcggcgctgaaaagcctcgccaacacgctgctcgacgacgacaacatccagcgggcgatgcgctacatgcggatcgtcatggacgacgcgcggttcttcaactcccggctccggccctggcaggacgcgctggccctgcacgtcatcgaggaagcctacacggcccggcggcagcggatggacgccatgtacaacatcttcgtggtgtcgatcgtctgcttcatgctgctggccctcgggggcgtgatcttcgtcctgcgtcagaaccgcaagctcagcctcgcgcggctcgaactgcaacaggctaacaaccggctcaacatctcgaacaacgacctgcaacggatcaacgaacagctggccggcctcaacagccagatttccgaagccaacgaggtgaaggaggagtacatcggcattttcctgacgatgtgttcggaatacatcgacaagatcatcgactcacggcgccgggtgcgccgtctgctgcgcgacgggcgcatcgacgaactgaagaaggagtacgcatcgagcgacggcgacagccgcgaactggaggagttctaccgcaatttcgacacgacgttcctgcaactctaccccacgttcatcgaggatttcaactcgctgctggacaaggaggcgcgcatcgagcccaagaagggcgagctgctgaacaccgagctgcgcatcttcgcgctgatccggctgggcatcaacgactcgtcgaagatcgccgccctgctgcgctactcggtgagcacgatttacaactaccgttcgaagatcaaaggtcacacgctcgtttcgcgggacaatttcgaggagcgcatcaagaccatcggggcattcagcccgcagcatctctga

SEQ ID NO: 1883 - DNA, 1692 bp, Unknown
  Artificiall/Consensus sequence
atgttttgctttcaatgtcaggagacggtcatgaacaaaggctgtacgatcaagggcgtctgcggaaaagaacccgcgaccgccggattgatggacgtgctgatctatgccgtccggggcgaggcgatcgtcaaccgggcgctgcgcgcaaaaggcgccgccgacaccgccgccagccgccggatactcgacgcgctgttcagcaccatcaccaacgccaatttcgacgacgaggcgctgaagatgcgcatcgccgaagcgctggcgacgaaaaaccgcctgatcggaacggccgagaaacgcggcatcgcgctgtccgacatgcccgaagtgaaatttcaccccgccccgtcggaatacgaagccgaagccgcaaaagtgggtgtgctgagcatgcgcgacgaggacatacggtcgctcaaacaactgatcatctacggtgtgaaaggagccgccgcctacgccgaacacgccctgaacctcggccacgaagacccgtcgctctacgagatgctggaaaacgccctggccgaggtcagccgcgaagacatcggcgccgacgagctcacggcgctggtcctgaacgtcggcgaagcgggcgtcaaggcgatggcgctgctcgacaaagccaacacctcggcctacggcgacccggagatcacgaaggtcaacatcggcgttggcaaacgccccggcatcctcgtgagcggtcacgacctgaaagacttcgaggagctgctcgaacagaccaaagacgccggcgtggacatctacacccacagcgaaatgcttccggcgcactattatccggctttcaagaagtacagccacttcgtcggcaactacggtaatgcctggtggaaacaacgcgacgaattcgagactttcaacggcgtgatcctcttcacgaccaactgcatcgtgcccccgcggccgaacgcggcctacgccgaccggatctatacgacgagctcggccgggctgcccggcgcaacgcatatcccggaccgcaaggagggcaggccgaaggatttctcgcagctgatcgagcacgccaagaagtgcccgcctccgacggagatcgagcacggggagatcgtcggcggcttcgcccaccatcaggtgctggcgctggccgacaaggtggtcgatgccgtgaagtcgggagcgatcaggaagttcgtcgtgatggccggatgcgacggccgcatgcgctcgcgggagtattacaccgatttcgcttcggcgctgcccgaagatacggtcatcctgacggccggatgcgccaaataccgctacaacaaactgccgctgggcgacatcggaggcattccgcgcgtactcgacgccggacaatgcaacgacagctattcgctggtgcgcatcgcgctggcgctgaaggaggctttcgggctcgggagcgtcaacgacctgccgatcgtctacaacatcgcgtggtacgagcagaaggccgtcatcgtgctgctgtcgctgctgagcctcggcatcaagaacatccacgtcgggcccacgctcccggcgttcctgtcgccgaacgtactgaaagtgctgaccgacaaattcggcctcgggaccatttcgaccgtggaagaagacatgaaaaacctgatttatgaaaacaacgacggaaaacacgttcccgaaggcatcggtgatgcggttcgcggataa

SEQ ID NO: 1884 - DNA, 1506 bp, Unknown
  Artificiall/Consensus sequence
atggaaaaacagtccctttccatgaacgcaaaaaatcccgtatccactgaactattacaacaacttctcaacgcatcggacatcggatggtggcagctcgatttcggaaaacgcgaaatgacctgctccccgctggcagctgaactcttcggcacggatcgtacgcgcatcacgttcgacgaagtttgcctgcttcccagagaagaacaccgcgcgcagatctacacccgctgcgccgcactcaaagtcaccgacacgctcgatgagacattcgtcatgacgaacggcaacaagtgtctgcaaatcaaagccgtgaaagtacgcaccgatccgcggacgaatacccgcacggccttcggcagcgtgcgccgcgtcacgagcggcaaccccgagagcgcggaactcgccgccatcaaccagaactacaaggcggcgcagcgcaattacagccatctcgcgcagctgatcgaacatctgccgatcggctacctgcgcatcaacatcctgcgcgacaaaaccgaccgggccgtcgattacctgctttcgtacatcaaccagcaggcaggccggatactgggcatccgcacgcaggacttcaccggaaaaacggccagcgaaacgggtgtgaatccccaggagaatatcccgagattcatgcacatcccctccggagactcccgggaacacctctggcaggctccggattcgggacgctattgccgcagcctgatctacaataccccgaacgacgacgacgagctggtcatcctgctcgaagacatcaccgaagcccggcgcaacgaggaacagcttcggcgtgccaaggagcgcgccgaagagtccaaccgcctcaaatcggccttcctggccaacatgagccacgagatacgcacgccgctgaacgccatcgtcggattctcggaactgctcgccaaagaacccaggagcaagacccgcaaggagtacagcgacatcatccggcgcaacaacgaactactgttgcagatcatctccgacgtgctcgacctcgcgctcatcgaatccggacggtcggaggtcgtccgcacgactttcgacgcccgggagttcgtccgcgaaacggtcgaggtgttccggccgcagtgtcccccgggcgtggagctccgcatggaggaggaacttccgccgcgcccgatccgggcataccggcagggagtcacccggatcatcggcaactacctgcgcaacgccctgaaattcaccaaggaggggtctatcacgatcggattctgcgagatccccggctacgtccgcttccacgtccgggacacgggcatcggcatcgcccccgaagaccacgggcgcatcttcgaacgcttcgtcaaactcgacaccttcacgcagggaaccggactcggactctcgatctgcaaatcggtcgccgaacagctgggcggccgcgtcggcgtcgattcggccgtcggacggggttcgtgcttccggctcgacgttcccgtccggaaataa

SEQ ID NO: 1885 - DNA, 4596 bp, Unknown
  Artificiall/Consensus sequence
atgcgcaaaggtataaaaatattgggaaaggtgttctcggcggcggttttgttgctgataattctgcccgttttcctttcgctgctgctcgacattcccgccgtgcagaacttcgtggtgcacaaggccgcggaggccgtttcgcgcaagctggagaccaccgtgtcgatcgaacgcgtggacatcggcatcttctcgaaaatcaaggtcaagggcttctacgtcgaggattacgggcgcgatacgctgctctacgtcgggaagctcgacgcctacgtcacgggcttcggcctcttcggcgggggcctcgcgttcagccgcggggggatcgccgacgccaagctctacctgcggcagatgcccgacggggagatgaacatcaagcagatcgtcagccgcatatccgatcccgacaaaccccggaagggcaatttcaaactctcgatcagccgggcttcgatcgagaacatggacctctgcctcgaacggatcgacagcctcgcgcgacaccgcgactacggcatcgacttttcgcacatgcacctctacggcctgacggcccgcgtggacgacttcaccatcgacgggtcggccatctacaccaccgtcgcggccctcacggcccgcgagcgcagcggcttcgtgctggaccacctcgcggggcgcttctacatgacgcaggggtgtctgggcttcgaggacgcctcgatcgtcaccgcgcgttccaacgtccggattccctacatctcgctggtcggcaactcgtgggccgaatacaaggattttatcgggcaggtgcgcatcgacgccgcgctgcgcaacacctcggtctcgaccgacgacattgcgtggttcgctcccgggctgcgcgactggcatctggatttcagcgatatagacatcgaggtcgcgggcgtggtggcggatttcacggccaaggtccggagcatgcacatcggcgagggcacgacgctcgtggccgacgccgcggtgaaggggctgccggagatccgcgacacgtggttcgacctctcggtgccccgcctgcattcctcggccgaggcgatggacgggctggccctcggcatcgccgggcgcaagctcccggacaggctggtcgggatactcggcaactcggggagcatcgacctcgatgcccgcttcaaggggaagctctcggcgttcgacatgcagctgggggccgcgaccgaggtgggcgacgtgtcctgcaacctgcggatgtcgccgctgaaaaggggcctgagcagtgtgcggggcgatgtcgagacgcgcgacctgcggctgggcgacctgctcgaccgccgcgatctgctgggcaacgccacgctcacggcctatgtcgatggcgtgatcggcaagggcgtggccgacgccaacgtcgtgggcaacgtcacccggctgggcttcaacggctatgtctacgactcgctgcggctggacggccgtctgcgcaaccgggagttcgacggcctgatcacggcccgcgaccccaatttggacttcgacttcttcggactggtggatttcaacgactcggtgccgcgctacgacttcacgatggacctgcggcacgccgatctggcgcgcctgcacatcaaccgccgcgactcggtgtcgcagctttcggcgcacatcgcggccaaggccggggggcgttcgctggacgacctgaacggccgcatccaggtgaccgacgcccgctaccgctacaacgacaaggagatcgaggcgacgaacatgaccgtcacgggcgagaactccgcgcagagcaagttcgtggagctgcgctcggacttcgccgacgccacgttccgctccaagaccagctaccgcacggtgttcgaatacctgcggcggagcgcgtggaaataccttccgatgctgagcgaggccccgcccgaaacggggccttcggagcgcaaggccgccgtggcgaacgatttttcgctgctttcggtcaacatccgcaacttcaaccccgtggccgacgccgtgtcggcgggcttacaggtggccgacggatcgtcgctccagctgctgttcaatccggccagcgaccagttgtcgctcaaagcctcgtcggagtacatcgagcgccggcggatgctggccacgcgcctctcggtcaacgcctcgaaccgcggcgattcgctggcggtctacgcctcggccgaggacctctacgccggggtgctgcatctgccgcgcctctcgctgacgggcggcgcccggcagggccgcgtgcagctctcggcgggcttcgacgacacgacgcgccgggtttcgggtctcgtgggaatccgtacgtcggtggccgacgagcacggcgccaacgggcgtgtggtggatctgcgcatactcccgtcgcacatcacccgcggcaacaagacgtggcagatctatgcccgcaagatactgatcgacacggcgcggatcgtcatcgacaggttcttcgtgatgaaccgcgaacaggaactgctgctcgacggcgtcgcctcgcgcagccgcgaggattcggtgaccctctcgctgcgcaatttcgacctgtcgcccttcacgcaggtcgccgaacgcatgggctacgtcatcgagggccgcacgaacggttcggcgaagatgaagtcggtgctgcggggcggcgagatctcggccgacatccttttcgacagcgtcgaggtcaacgacattcccgcgccgccgatgcgtctggcgtcgcgctgggatttcgcccgcaaccgggcgggcgtgacggtggtcaaccgcgtcaagcgcgacacgctcgtgcggggcttctacgccccggaccggatgcgctactacgcccggctggatgtcgatagcctcgacatggggctgctcgacccgattctgacgggggtgatctcctccaccgagggcgtcgcctcggccgaactcgtcttgcagggacagcgccgcgacgccgaactcgccggcgaggtccgtgtctcggggctgaaaacccgggtcgatttcacgcaggtcgcctactcgatgcccgaagcggtgctgtcggtgaagaacaaccgcttcaaggcttcgaacgtcgcggtgttcgacccccagggccaccgcggacgcttcgacttcgacatgagcctgcaacacctgtcgaacatctcctacgacgtgcgggtggccccgcagcagatgctggtgctcgacaccggccccgacgacaacgacgttttctacggaaaggtctacgccacggggtcggcccgcatctcgggcgacaagggggccgtccggatggacatcacggccgccaccgacggcaattcgtcgttcgtgctgccgctgtcgagcaagtcgaacatctcgaacgccgatttcgtgcgcttcgtgcagcccgaaaagaccgatacgctcgacaacgtggcgcgcaagaaactcctcttcgaacgcaagcaccgccagcgtgcggacgccgccagccagatgaacatcaccatggcgctcaacgtgcgccccgatgccgaggtcgaaatcgacgttgagggcaacacggtgaaggggcgcggagaagggaccctgaacctcgaaatcaacccccgggccaatatcttcgagatctacggcgactacaccatctccgagggcagtttcatgctctcgctccagcagatcatcaacaaacgtttcaccatcgagagcggttcgtcgatccagtggaccggttcgccgatgaacgccctgctggacatcgacgccgtttacaagctcaaagcctcgttgcagcctttgttgcagggcacctccgagaatctcggcggcgaccgttcggtgcccgtggagtgcgtcatccacctcggggaccggctgtcgaacccctcgatcggtttcgacgtgcgggtgcccggctccgatcccgagacccagacgctggtggccaacgccctctcgacccccgagacggtcgatacgcagttcctctacctgctgctgttcaacagcttcatgtccgagagttcgtcgcaggccaacgccaacatcggcagttcggtgtcggcggccacgggactggagttcgtgtcgaacatggtgagcaactggctttcgtcgtcggactacaacgtggtgatccgctaccggcccaagtcggagctgacgagcgacgaggtggatttcgggctctcgaagagcctcatcaacaaccgcctgttcgtcgaggtcgagggcaactacctgatcgacaacaagcaggcgacggtgaacaacaactcgatgtccaacttcatgggcgaggcttacatcacctacctgatcgaccgcgccggaacgctcaaactgaaagccttcacgcagacgatcgaccgtttcgacgagaaccagggtttgcaggagaccggcatcggcgtttacttcaaggaggatttcaacaacctgcgggacctgcgcaaccgcatccgggaacgcttcaccaacaagaagcgcaaggcccggcgcatggcgcggcgcacggcccgggcggccgaaaaagcagccgaagaggcggaaaaagagcggcagcgggagccggcggatacgctatttataattaagaatgaagaatga

SEQ ID NO: 1886 - DNA, 3198 bp, Unknown
  Artificiall/Consensus sequence
atgaaagaaaacgagatactgcgagcggtattgcaagataccgggaccggctggtgggaggcggatatgacgaggcggatatttcacatgtccgattttttgcagaggctgcttcggtattccaccccggaggtaggattcgacgaaatgaaaagtctgatcccggaggcttatgccgaaatattcggaccggggaattgcctgttgcaggatgcgcatacgcccaaacgcgccattcccctgatcgcgcccgacgggcgccggctgtggctgcaatggaaggtgctcggccgggaaacgactcccgacggccgtgacgttatgaccggctatgtacagcagatcgaattcgaaccgccttcggagaacggacgcgaccgcgtccggatcgacaacctgctctaccggctcaacagcatttcgcatacgctgcttgcgctgctgcacagcgacaggacccgcgatacggttaacaagattctctatgaagtgcttacgatgttccgcggcgacagggcctacatcatcgagttcgactgggagaaacgcacccataactgcacctatgaagtgacggcgaacggcgtttccagcgagcaggaccggctcagttcgattccgatggaggattttccgtggtggacgaagcatgtctcacagggcaattccattattctttccgacatcagcgacctgccttccgaggcggcgggcgaacacgatctgctggcggcgcagaagatcaaatcgctgcttatcatgccgctggcctcgcgggacaaggtttggggctatgccggcatcgacatcgttgacagacgccgcgagtggaccgacgaagactgccagtggttcgcatcgctggtcaacatcatcgggctgtgcctcgatttgcagcgttccgaacaggcggcgcaggccgaccggctctatctgcaaaacctctatcggcatatgccgatggggtatctccggatgaagatgatcggcgacgaagcgggccggccgcgcgactaccgggtgatagatacgaacgatgccgcggacaagatgctgaaccttccgcgcgaatcctacgtcggtcacctggcctcggaactcggcggcgagctggctccggtgctggaagacgcctcggaggtgctccggacaggacgatacgtcgaggggcacatcgatctggagcggaacgggaaactttacctcaattacatcctctactctccgtgcgccaaggaggtcgtggccttcttctcggaccggaccgaggtgcacaaggcccacgaggtgctctaccgcaacgaacgtttcctgcgcaatattttcgacaacattcaggtcggggtggagctttatgccccggacggcacgctgatcgacatcaacaacaaggacatggagatcttcggcgtgacccgcgaagaggctctcgggctcaacttcttcgagaatccgctcgtaccgcaggatgcgcgcgagggggtgcgcgccggactcgaacaagccttccatgtcaactatcccttcgaacggctcaacggttattacaccccgtccaagaccggttttttggagatctacaccacggtcaacatgctctacgacatcgaggggaacatctccaacttcatgctgataaacatcgacaacaccgagatcaaccgcgcccacacgcggctggcggagttcgagagttcgttcgcgctggtgagcaaactgggcaagatgggcttctgccgcttcgacctgttgacgcgggccggcagcggggtgccccaatggtaccggaacctcggggagcggcccgatacgccgctcgaccggatcatcggcgtctacgaccacgtcgatcccgtcgatagggcgtcgatcctcgaaaatatcgcccgcgtcaaggccgggacatcggacagcttcaacctcgacctgcatatcctgaatgacgacggcacggagaaatggacacgcatcaacggggtgcgcaatccgatgaacaacgatccgtcgaagatcgagatggtctgcgtcaattacgacatcacggagctgaaaatgaccgaacggaacctgatcgaggccaagaacaaggccgaggtcagcgaccggctcaaatcggcctttctggccaatatgagccatgaaatacgcacgccgctgaacgccatcgtgggattctcgaatctgctgaccgaaacggacgatcccgaagagcggcgcgactacctgcgcgtggtcgaggagaacaacgacctgctgctcacgctgatatccgacattctcgacctttcgaagatcgaggccggaacgttcgagttcaactacggaccggtcgatgtgaaccagatgtgcgaggaggtggtgcgctcgctgagcctcaaagtgcagggtcgccccgtcgaactgcgcttcgtcggtcccggaagcccctgcttcatcctgggcgacaagggccgcttgacgcaggtcatcaccaacttcatcaacaacgccgtcaaattcaccgccgagggcagcatcacgctgagctatgcggtcgaagggaccagcatacgctttgcggtcgaggataccggttcgggcatcgacaaagagcatctggacaatatcttcgaacgcttcgtcaaactgaacagcttcgtgcagggcacgggtctcggtctgtcgatctcgaagtcgatcgtcgaacagatgggcggacagatcggcgtcgagtcggaaccgggcgagggagcctgtttctggtttacggtgccgatggggacttccgaggcgcttccggattccgacacggcctgtccgccccggatgactgcgcagccggcatcccgcagcggacgccgccccgtgctgctgatcgccgaggataccgacagcaactacctgctgttgtcgctgatgctcagaaaggagtatgaagtgatccgcgccggcgacggcgaggaggtcgtgcggctgtgtgagcagattcagcccgacgccgtgctgatggatattcagatgcccgtgatggacggcctgaaagccacgcagcagattcgccggagcgggagccgggtgccgatcatcgccgtgacggcctacgcctacgaccgcgaccgtcagaaagccctcgaagcgggatgcgacgaatacctcgccaaacccctcacgggcgatacgctgcggcagacgctgcacagactgctggcgggagaatga

SEQ ID NO: 1887 - DNA, 2721 bp, Unknown
  Artificiall/Consensus sequence
ttgacacgcttcatcctgctgcttatcgccatcgccggcctctccggcccgatctccgcacgcaccgtgcagagcggaacgccgcaggtataccgcagctaccgccctgcacgggtcacgatcgccgtcgaggacaaggagacgaaggacccgctgatcggagccacgattgcgatcatgagcggcgcagacacgctgcggggcaccacctccaaaaaggatttctaccgcacgctggccgtctacgagtgcgaccgcatcttccgcgactcggtcgatctggaggtcgcctacctcgggtacaaaccatacaggaagcggttcgccgcgaccgagttccggagccgcatcgaggtcggaatggaggtcgatgaacagtcgatcgcccaggtcgtggtcgtgggcaagcgggtcgccatggtcttcaagggcgacaccatggtctacaatgccggagcattcaaaacgatggccgacgaccgcttcgaggagctgttgaaacagcttccgggggtcgaggtccgggacaacaagatcctcgccggcggcgaggaggtcaaacggatgctgatcgacggcaaaaacctcttcggcaacaaatcccagtacgcgctgaccgacctcgaagcctcggatgtcaagagcgtgcgggtctacgaagagctgagccccgaggccaagcggctgggcaacaccacggcccggaaagagaaggtgatgaacgtcgagaccaaatcgaaacgcagcgtccttcagggcggcagtctggaagcctcggtcggcgcgagcctcgaaaaggactactccgggcgtcgtgagatccgccattcggaggccgggacctactaccgcaacagcgaaaaaggcaactggcggatcgaagcctccaacctgaaagacgacaactcccgggcggagggcgcttcgttcgattcgaaactcacgccgacgaagcagaccgacgcccaagcggagtacacctaccgccgcggcgactcgacctcggtttcgaccgcggtcggtttccagcgccgccgccagagccgcatctcccgctcgatgacggagtatttcccgaccgacgattatgccctgcgcaccgaggagaactccggggagtccctctccaaagccctctcggcgaatctctccaacctgacaagcatccggcgcggaaaaaattcttttttagccatgacggacttctcgttcgccaacaattcgtcgctgagccgcaactccacctcccagcgtatcgacgacgacgagacccgcacactcctcaacaacgactccgacaaccggaatttcagtttcaacatccgactcaactattacatttccctctccgaaaaatcgtcgctgtcgttctgggtcaacggcgattacggcacgcaggaccaggacggctggcagatcgacacggcggcctcggcgcagggcctgcaagtcaaactgcgcaacaacggcgacggccgccggtacggtttcgaagcatcggtcgattacggctacaagatcggggagaatctccggttctcagccgcctactccttcaagcgcagctacgaccgctcgaagatgctgtccgtggattttctcgacgatccgcagggaacgctggaccccgtgaactcctacaactacacgaacgacagctattcgcacagcctgcaagccggcctgaattacagccgcgacggactctggatcataggcaccctcacgggagtggtctatcagatcgcccgcagcgaacgctttccggagaaggaacgcttcccgaggcagttctaccagctgaatccctggttcagccttatggccggccaatccaaaaggcggttcaccctcaacatcagctccttttcgcagatgatcccgaccgaatcgctgcgctcgacgatcgacgccacgaaccccctctcgctgcgggccggaaaccccggtctcaaactgccgaacgacatggcgttgctggcaagaatctctttcaacaacgcaccgaaggcgcggaccttctcgatcgggctcaacggcgggtacaccttcaactacatcgcctcgcagcgcatcctgttcctcgaagagacctacctcccccagtacgactacacggcccggaaaggtgcgcagctctcgacgcagaccaacgtcggagggtgttacaaactcggcggttcggccgatttctcccaacagatcgcctcgctgcgctcgacggtcagcgccaccatcggctacgatttccaacagaccccctatttcctcgacgaggcgctctgccactcggaccgccatgcgctctcgttccgcgccggcttcgaatcgggcttttcgagcaaggtcaaaatcgccgtctcctccgtaacctcgatgagctcctactccacgcagaacagcaccacgcaggacctgcgcgaaacggtccgcacccggctggacctgcgcttcggaaagtatttcgcctccgtggcgaacgcctacgaattctactgcaacagcaattcgcatacgctcacgcgccacaacgtgatcctcaacgccgcggcgggccgcaagttcggcaaggagaaccggctgggactttcggtgggcgtcatcgacatcctcaaccgtccggactatgcttcgacggtgttcgaaaccgactacatgcgcacctcctcgatctcctacctgggccgttacggctatctgcgcatcgcgtacacattctga

SEQ ID NO: 1888 - DNA, 1338 bp, Unknown
  Artificiall/Consensus sequence
atgaaaaacgttaaattcctgctttccgctgcctgcgcgctttttgcagtcgcggcgatggctcaacaagatttcagcgacccgaagtatgcggtctggggcgatacgcctgaggcgcgtcagcagaacatcctgaacagcaacttcctgaaggagtcgtgcgacaacaaggattacaacgccgccgcacactacctcaaagagctgctcgacaagtgcccgaaggcttcggagaacaccttcgtgcgcggcaccacgctctataagaacaagatcaaccgggccaaaagtctcgccgagaaaaacgtgtacatcgactcgctgatgctgctctacgacctgcgcaacgagtatttcggagaccatccgaagcgcggcacggcctatatcctcgaccggaaggcccgtgagtacctgacctacaagccttcggaccgcaagggcatccgggaggcgttccgcgcggctatcgaggccggcggcgacaacaccgatcccgagaccgtcgtggcttatttctcgaatctctgcgacgactacaagaacaccgacgaggtgatgcccgacgagatcatcgccgagtacgaccgtctgacgccgttcttcgagaagaatcccgaggccggcgagtacaagggccagttcgacgctgcgttcggactgagcggcgccgccagctgcgagaacctcgaaaagctcttccgcggcaagctggaggccgcacccaacgacgaggctctgttggcacaggccgtggcactgatgtcgcgcgccaagtgcgacggcgaattctacttctcgatcgccgagaaatactatcaggtgaaaccctcgtcggagaccgcgatgttcctggcgcaggctttccagaacaagggcgactatccgaaggccaagacctatctgaacgaggcgctggccgttgagcaggaccccgccgagcgtcagaagctgctcgtgcgcattgcgctggtgggtctcgtttccaacgacatccagggcgctgccgccgctgcgcgtcaggcccgtgacctgaatcccgaggacggcgttccctatttcgtgctgggacagtgctacgcttcgtcggccggggcttgcggcgggttcgccggacaggccacctactgggccgcttacgacacgatggccaaggccatcgagctgctgccgagcgattcggaatacctcgaacacgccaagacttcgctcagcgctttccgcagccgtttcccgagctcggaggagtgcttcttcaacgagcttcaggagggcgcacgctacacggtgaactgcggtaccgctgccggtatctcgaccaccgtacgtgcccgctaa

SEQ ID NO: 1889 - DNA, 2226 bp, Unknown
  Artificiall/Consensus sequence
atgatgaaaactcacagaatcctatggctcggctgctgtctggcggtcgcaggctgcggcggcgacaagtcccccggccgtaattacgacaaggaaatcgaccggctcatgggccgcatgacgctcgccgagaagatcggccagatgaaccaggtatcgggcaagagcaatcccaccggcgtcctgaaacagtactcgtcgctcgaaggacgtgtccgcgaaggcaagatcggtaccgtgctcaatgtcatgggagccgtcacgacacgggaactccagcggatcgccgtcgaggagacccgtctgggaatccccctgatcttcgcgctggacgtgatccacggctacaagaccatttcgcccgtacccctcgccgaaagctgttcgtgggacatggaaacgatcgaagcctcggcccggatggccgccgtcgaagcctcggcagcgggtctgcaatggactttcgccccgatggttgacatcgcccgcgacccgcgctggggccgcgtcatggagggagcgggggaggacccctacctcggatcgtgcatcgcccgggcccgcgtccggggattccagggcggcgatctctcggcatcgaacaccatcctcgcctgcgcgaagcatttcgcgggctacggagcctccgaaggaggccgcgactacaacacggtggacatctccgaccagcggctgcgcgaactctacctgccgccgttcaaagccgccgcagatgcaggcgccgcgactttcatgaactcgttcaacgaactctcgggcgttcctgccaccggcaaccgcttcctcgtgaagcagatcctgcgcggcgagtggggctgggacggcgtcatcgtctccgactgggggtccgtggccgaaatgatcccccacggcgtcgccgaggacaagaaacaggccgcgctgctggccgtaaagaacgaatgcgacatcgacatggagggcggctgctatccgagttccctcgaagagctggtgaaagagggcaaggtctccgaaaaggagatcgaccgctccgtccgccgcatcctccggctgaaatacgagctgggactcttcgacgatccctaccgctactgcgacgagcagcgtgaaaaagaggtgaccctctcggcagctcaccgcgaagcggcgcgcgacatggcccgcaagtcgatcgtgctgctcgaaaaccgcaagtccgtgctgcccctcggcaagccccggtccatcgccgtcgtcggaccgctggccgacagtccggtggacatgctgggcgaatggagggccaaaggcgacccgaaggaggtcgtgacgatcctccggggcatcgaaaaggccgccggggccggcacgcgcatcgtccatgccaaaggctgcaacgtcacgggcagcgaccggagcggcttcgcggaggccgtccgcgcggcacgcggcgccgacgtggtgatcgcctgcctgggcgagagcgccgacatgagcggcgaaggctactgccgctcggaactgggacttccgggtgtccagcaagagttgctgaaagagcttaaaaagaccggaaaacccgtcgtcctgctgctgagcaacggccgtccgctgacgctggcgtgggagaaggaaaacatcgaaacgatcgttgaaacgtggttcctgggcaccgaggccggaaacgccgtcgccgacgtgctgttcggcaaatacaacccctcgggcaaattggtcatgtcgtttccctacaacgtcggccaaatcccggtctactacaaccacaagcacacggggcgcccgttcgagccgaaccagcgctatgtgatgcactatatcgacgctccggtcgatgccctctatccgttcggctacggactgagctatacgacgttcgaatacggcgtcccgacgctcagcagcgaccggatggccgacgacggccgcatcacggcgacggtgaaagtcgccaacaccggcgactatgacggcgaagaggtcgtacagctctacatccgcgacatcaaggcgcagatcacccgtccggtgaaagagctgaaaggcttccggaaaatcttcctcaaaaagggcgaatccgccgacgtgaccttcgacatcacgcgctccgaactggaatacgtgctggccgacggctccgtcgtttccgatcccggcgagttcgaactcttcatcggcggcagctccgcagacctccgtcccgtccgattcacagtacttcaataa

SEQ ID NO: 1890 - DNA, 1845 bp, Unknown
  Artificiall/Consensus sequence
atgtgcggaattgtaggatatgtcggccggcgtgacgcctgcccgattctggtgaagggtctgcatcgcctcgaataccggggttacgacagcgcgggcatcgcgctggtcaatgcgacgggggcccttcacgttttcaaatgcaaaggcaaggtctcggacctggaacacttcctcgaaggcaaggacctcggcggaaccatcggcatcgcccacacgcgctgggccacgcacggggttccgaacgacgccaacgcccatccccactactccgaatcggagcagatcgccctgatacacaacggcatcatcgaaaactaccgcgtactgaaagacgcgctcgtcgagaacggctacacgttccgcagcagcaccgattcggaagtgctggtgaatctgatcgaatacgtccgccggacgaacggctgcacgctgttcgaagccgtgcagcaggcgctccgtcaggtggtcggggcctatgccatcgccgtcgtcgagaagggaaacaccgaccggatcatcgccgcacggcagagcagtccgatggtcgtgggcatcggcgagggcgagtatttcctctcgtccgacgccgcgtcgatcatcgaatacacgcaggatttcgtctatgtgggcgacggggagatcgccgtgatcgaacgcgacaaacccctgaaagtcgtgacgctggacaaccacgaggggaagatcgacatccgcaagctccagctctccatctcgcagctcgaaaagggcggctatccccatttcatgctcaaggagatttacgaacagccctcgacgctcgtggactgcgtccgcgggcgcatcaaccccgacacgtgcgaggtgaagctctcgggagtgatcgaccaccgcgacaaattcctcgccgcccggcgcatcatcttcgtggcgtgcggcacctcgtggcacgcctcgctgatcggcgaacacctcatcgagtcgatctgccgcatcccggtcgaggtggaatacgcctcggagttccgctaccgcaaccccatcatccgcgaggacgacatcgtgatcgccgtgtcgcagtcgggagagacggccgacacgctggccgccgtggagctggcccgcaaggccggggctttcgtcttcggcatctgcaatgtcgtgggatcgtccatcgcccgggcgacggattcgggggcctatatccatgtaggtcccgaaatcggcgtcgcctcgacgaaggctttcaccgggcaggtgactgtgatggcgatgctggcgctggccgtgggccgcgaaaaaagaaccgtttcggacgcatattaccacgaagttgcgagcgccctgctccacctgcccgaaacattggaggaggtgttgaaggtcgcgccgcaggtcgccgacctggcgaagatattcacctacgcccacaatttcatctacctgggccgcggatacaactaccctacggcattggagggtgccttgaaactcaaagagatctcctacattcacgccgagggctaccccgccgctgagatgaagcacggccccatcgcgctgatcgacgccgaaatgcctaccgtagccatcgccacgccggatcacacctacgaaaaaaccgcgtcgaacatcgaggagattcgggcccggggcggcaagatcatcgccgtcgtcgcccgcgccgaccagcaggtgcgccgttcggcggattacgtgatcgaggttccggtcatcgccgaatgtctcatgccggtcgtggtgtcggtgccgttgcaactgctggcctactacattgcggtttacaagggccgcaacgtcgatcagccccgcaacctcgccaaatcggtgaccgtggagtag

SEQ ID NO: 1891 - DNA, 2202 bp, Unknown
  Artificiall/Consensus sequence
atgatgaaacgactgctaaccatcctctccgccgcgctgaccgcaggcgcggtgtccgccgctgccccgcagcagctcatcgacatccgcaccgacgacgtatcgatcgtgctcgccgcccgtccggacggagaggttcatttccgccacttcggaagccgcatcgacgacccctctccgctggccgactacaagagctcccgccgtgccgaccacggaaccgacgacctggcctgccccgcgatgggcggtcggaatttccgcgaaccggccctgcgcatcacccacgccgacggggatatgaacaccgatttgcgctacgtgtcgcactcgtcacggcagctggccgatcccaacgtcaccgagacggtcgtgaagatgaccgactgctgtcaggcgctggatgtcgaactggtcttcacggcctacgcccgggagaacgtcatcaccacgcacacggtgatccgcaaccgcgaggagggtcccgtcacgctccacagcttctattcctcggccgtgacgctgaaatccgacaaatacctgctgacgcacctctacggcgcctgggcgcgcgaagcgcaggtcgatcacacgctgctgacccacgggtcgaaaagcatcgagtcgatgcgcgaggtgcgcaccacccacaccgaaaatcccgccttcatgctcacgctgggcagcggatcgttcagcgagaactgcggcgaggtcatcgccggggcgctggcgtggagcgggaatttccggctcaacttcgaggtggacgaatacgacgtgctgaccgtgctggccggggccaaccccaacggctcggaataccggctgcgcccgggcgaatcgttcaccacgccggagatgatctacacccactcgctgcgcggcgcaggaggcgcctcgcgcaacctccacgactgggggcgcaactacggcgtctaccacgccgaacgggtggtcccgacgctgctcaacagctgggagggggcctatttcgacttcgacgccaaggtgctgaaacagatgatcgacgacgcggcctcgatggggctcgaaatgttcgtgctcgacgacggatggttcggcaacaaatatccgcgcaacgccgccaacgccggactgggcgactggcaggtcaaccggaagaaactcccggcaggcatcgacgacatcgcctcgtacgcacaccgcaaggggctgaaattcggcatctggatcgaacccgagatggtcaacctcaagagcgaactggccgagaggcatcccgactggatcgtgcgcccgccgaagcgcgaagcgcccgaaacccgcaaacaatggctgctggacctctcgaaccccgccgtgcaggacttcgtcttcgagacgttcgacaacacgatgaagctctcggacaagatcgactacatcaagtgggacgccaaccgcaacgctaacaacgtgggttcggcctacctccccgccgacgaacagtcgcgcttctggatcgactacgcgcagggattctataaggtgatggagcgcatccgcgccaagtatcccgacgtgctgatccaagcctgcgcctcgggcggcggccgcgtggagtacggggcgctgcggtatttcgacgagttctggaccagcgacaacaccgaagcgttgtcgagagcccgcatccagtacggcacgagcctcttctatccggccgtggcgatgggttcgcacgtctcggccgtgcccaaccaccagacgggcaacgtcacgccgatcaagttccgcttcgacatggcctgcgccggacgcctcggcatggagctccagcccaagcagatgaccgacgccgagaaggagttcgcgcgccgcgccatcgccagctacaaggagtaccgcgacatcgtgatgcaaggcgacctctaccgcatcggcacgccctacgacgagaacggatgctacggcgtgctgtacgtcgccaaggacaagcggcaggccgtgctgttcgcttacagcctgcgttaccaggggcgttcgctgatcccgaaattccgcctcgacggactcgaccccaagacgggatacaccgtgcgggagctgaacgtcgataaaccccgcttctggttcgacggaaagaccctcagcggagaactgctcatgaacgccggcatcaatccccatctgtcgaagatatacgacagcgccgtattcatcctgaaagccaagtga

SEQ ID NO: 1892 - DNA, 2097 bp, Unknown
  Artificiall/Consensus sequence
atgaagaaactctttttactctttgctgctgcgtgcgtcaccttttcggccgcggcagacgagggcatgtggatgctgccctacctccagaagatgaatgccaaggacatgaaggcccgcggctgcaaactctcggccgaggagatttacagcatgaacaactcctcgctgaaggacgccatcgtcatcttcggaggcggctgcacgggcgagatcgtgtcgcccgacggactgctcttcaccaatcaccactgcggctacgggtcgatccaggccctgtcgtcggtggagcatgactatctgaagaacggcttctgggccatgtcgcgcgccgaggagattcccgctccggggctcaaagtgcgctttatccgcaagatcgtcgatgtaacgtccgacgtactgggcgccgtgcccgatatcgccggcggcgaggagcgttcgcgcctggtcgcagagcatgcggaggccgtgaagaaccgcttcgaggcggagaaccccggcatggagatttcggtgaaacccttcttcggaggcaatcagttcttcgccttcgtgatcgaggtcttttcggacgtgcggctggtcggcacgcccccgacgtcgatcggcaagttcggcggtgacaccgacaactggatgtggccgcgtcatacgggcgatttctcgatcttccgggtctatgccggacccgacaacaagccggccgactatgcgcccgaaaaccgcccttacaaggctgaaaaattcctgaaagtctcgctgaacggctacgacgaagccgacttcgctatgatcatgggtttcccgggatcgacgcagcgttacatgacttcctatgagattgaccggatgctggaggtggagaatccccagcgcatcttcatccgcggcgagcggcaggcgatcctcaaggaggatatggccgccagcgacaaggtccgcatccagtatgcctcgaaatacgcccagtcgtcgaactactggaagaattcgatcggcatgtcgcgcggcatcaaacggctggatgtaaagggccgcaaacaggagcaggaggccgctttccggacatgggccgccaaaaacacgctgccgaccgagggctacgtggatgcgctggacaagatccgcgagtcggtggaggagacgcttccctcgtatgcgtcgttgcagtatttgcaggaggcattccttcgggccgtggagattcttaccccggcgcgctattcgggttcgctgaaaggcgctgaactggagaaggccctgaaaggtttctataaggactataacatgcccacggaccgccgtgtcgccaagcggatgttccggatcgtcaaggagaactgcaaagagctgccttcggtcttcgccgaggtgatcgacaagcgtttcggcggcgatacggatgcctatgtggattatctctacgacaattcggtcttcgccgacgaacagcgggcgttggcggccgtcgcttcgggcagggagctcaaggaggacccggcggcggtgctgagcgagtcgatcgtcgggaagatgcgcgaactgagcaaggcccagaaggaggggcgtcagaaatacgccgacggccaccgtctttacatcgcgggtctgatgcgcatgcagcccaagaaagcgtgggcttcggatgccaatttcacgatccgtctgacctatggacgcatactgccctacaaccccgcggacggcatccgctacaactattatacgacgctcaaaggtgtgatggagaaggagaatcccgaaaatccgacggaattcaccgtgcctgcgaagctcaaggaactctatgccgccaaggatttcggccgttacgccaatgccaagggggagcttccgacctgcttcctggccgactgcgacatcacgggcggtaactcgggatcgccggtgctcaacgccaagggatcgctcatcggactggctttcgacggcaactgggaggcgatgtcgggcgacgtggccttcgaacccgaattgcagcgcacgatcgctgtggatgtgcgttacgtgctcttcgtgatcgacaagttcgccggtgcgggctggctgctcgacgagttgcagttcgaataa

SEQ ID NO: 1893 - DNA, 2547 bp, Unknown
  Artificiall/Consensus sequence
aagaagccgggccgcaaatcgaagaaaaccgaagccgccgccccgaaggccgactcgctcaaaaaagacaagaagaaaggctacgacgaattgctgaaaggcgccgtgaccgacaagggtctgttcgatgtccaccgcaaaggcacggatttcctgttcgagatccccgactcgctgatgggccgcgacatcctgatcgtcaacaaaatatcgggcgtaccctacgccctgaacgacagcggcatcaacaagggcatgggctacggcgaaaagatcgtccgtttccgcaaggacaccctctataaaaaagtctgggtcatgacctacgacccgcgcatcacctcgcccgagggcgaccgcatcacccgttcggtgaaggacaactaccgcgaaacggccatcgaacagttcccgatcgaagcctacaactccgactccacgacggtcgtcatcaaggtcaacaaggtcttcgacggcagtgaaaagagcttcaacaacgtcttcggagcgctccgcatcagcggctccccgaaaaaggagctctcgaaaatcgagtccgtgaagtcgttccccgaaaacatcgtcgtcaaatcgaccctctcgggctcgcactccggcgagggaggttcgatgtccgtcaccgtggacatcacctcgaacctcgtgctgctggccgaggagccgatggtagcccgcttctccgacgagcgcgtgggctatttcgagatcggacacctctatttcaacgacaaacagcagaaggccgaagagcgggcgttcatcaaccgctggcggctggaacccaagcccgaggacgtggaacgctacaagcgcggcgaactggtggagccccggaagccgatcgtgctctggatcgacccggcgacaccccccgtatgggtgccctacatcaagaaaggcatcgtcgagtggcaggaggctttcgaagccgcgggattcaagaacgccatcgtcgccaaagaggtcgatcccgacgacgaagagttcgacatcgacgacgtgcgctactcggtggtgacctatgccgcctcggaaacggccaacgccatgggtccctcggtgatcgacccccgcagcggcgagatcatcgaagccgacatcatctggtggcacaacgtcatgagcatccttcaggcatggattcgcctgcaaaccggcgccgtagacccccaggcccgcggcaacgaactccccacggagctgatgggcaacgccgtgcgtttcgtctcgtcgcacgagctgggacacagcctcggactgaagcacaatttcggcgcctcgtattcggtgccggtggattcgctccgttcgaaaacctacacggcgtcgcacggcacggccagctcgatcatggactacgcccgtttcaactacgtggcgcaacccgaggacggcatcacgcagctgacgcccaagatcggaacctatgacaaacacgcgatcaactggggctaccgctggctcggcgccaaagacccccacgaagagctgccgacgctcaacgcctggctgcgcgagcatgaggacgatcccgaatactggtacggcgagcaacggttccagaacaacgaggacccccgttcgcagtcggaggacctgagcgacgacgccgtggcggccagcctctacgggctgaagaacctgcaacgcatcgttccccacatcacggactggacggcggcggaaggcgaactgcaatacgaaagcggccgcttcctgatggcgatcgtctttcaatggatggcctatgccgaccacgtgaagaccaacgtaggcggtttctacctcaacaacgtcgtggcggggcatgacatcgaccgctacgtcccggttccggccgactaccagcgcaagagcgtcaaatacctgatcgaccagatgttcaccatccccgaatggctgttcagcgccaaagcctggaacaaagcctacgcccagcggctgtcgcccgtggggatgatggagtactcgccctacaacctcgcgcgcgaactccaatacaaagcctactatgaactgctggccgacgaacgcatggtgcgcatgtacgaagtcgaggcgcggcagggacgcggagcgaagacctacacccccgaacagatgatggatgacatcacccgcgcggtcttcatccgccccggaggccggaccctctcgatctgggagcgcatgagccagaagaactacctcgacgcgctgatcgtctcgtcgaacatcacgatggtcaagaccaccaagctgggatcgacgctccacgaccacgacggacgcggatgctgttcgctgatgcaggaagccccggaggtgcatctcgaaccgctgccgaggcccgaggacatgcagttccgcacggcccgcaactacgaactgatgaagcgcgtcagcgaaacgacctcggccaagcgcgccgagatgcgcaggctgctgactcttgtgcagagccgcaccggaagcggcgaccaggcgacccggaaccattaccgggacctcgaactgagactgaaagaggccctgcgcatgttataa

SEQ ID NO: 1894 - DNA, 1575 bp, Unknown
  Artificiall/Consensus sequence
atgaaaaacttcttacccatcgtgaaactggcctgcctgacggctgcggctgcgctgatcgtctcctgcggcgacggtgccgattaccggaacgtgctgccggccgattcgttcgtgacgatgtcggtcgatgccgcatcgctcctgaagaagagcgggacgtgcgacgccgcctccaatccgctcctcgaccgcctgaaagcggagttggacaaggcggaggagctctccgccgaagagaaggagtacctgttttcgctgttggagaacccggccgaatcggggctcgatctgaaaaaggaactcttcctgttcatgtcggcggacggtgccgacatcaataatcccgaggtgggcggcggcctgctgttcccggtcggcgacaaatccaaactggacgccctgatcgcgcgcatcaacgagaagagcggcaccgagacggtgaccgaggcgggcgtttcggtggtgaagatcggcgaggagtcggaggcgtccggtgtctgcgcctataacgacatcgcctgcctgctctatttcaagaccgatccctgcggagtcgtcgaggagaaggttcggaagctgttcgcccagaagcgcgctgaaagcctgatgggcgacaaggccgtcgccgcacggctggccgcgcgcaacgacgtgaacatggtcgtgtcgtatgccaatctgtcggccatgatgaacaatccgatgctgggtgcgatgcccatgatggatgtgctgaaaggggctctggtgatgggctccgccaatttcgagaagggacgcatcgtcagcgacgccgcggtaagctacaaggacaaggcgagcgtggagaaagcggcggcgttttacgcctacgtgaagccccagacgggcgatctgctgcgctacgtgcccgccggcagcctcgccgcgctttcctacggactcgacggcgaaaagctctatgcgatgctggccgccatgcccggttacggcatgatgctgggcaatccgatggtcaagcaggtgctcgacgctttcgacggcgactgcgtgatctcgttctcgggaatgaccccggacggacgtttcccgatcgcgtcgctgctggcccaggtcaatgatcccgccgtgttgcagaccgtcgtcacgaatctggcgggcatgcccgttcagcagaccgccgagggcgagtacgtgttcaattcgggcgatgtttcggtgctgttcggcgtgaagaacaaggtgctttactgcacgaccgacacggccgtgaagtcggctctcgacggtgcgaagatcgaatcgctgatgtcgctcgacggcatcgtgaaagggcagtcctgcaccttctgggtcgatttcaaggggctgagtgccctggtttcccagctggccggagaggccgggacgccgcaggcggaagccgcgctggcggtgctcggcatgttcgacgacatggaggcgtacagcacgatggagggcggaaagctcgtcgtcaacatggccgacaaggagcagaacgctttcaagaccatttgcgacacgaccggcgcactgatccgtcagtatatgccggaagcggacgaaatctaa

SEQ ID NO: 1895 - DNA, 2184 bp, Unknown
  Artificiall/Consensus sequence
atgaaacgtatcaccgctttattgacacttattctgaccatgacactcgtgtcctgcaaatccgacaagcatgcgggcgaaaatccctttttcgccgaatggaatacgccctacggggtgccgcccttcgaccggatagctcccgaacacttcctgcccgctctggagcgcggcatgtcgctgcacgacgccgagatcgacgccatcacgtcggacaacgacgccccgacgttcgagaacgtcatcctcgcctacgaccgctcggggcggatgcttgcgcagacggagctgatcttcggcatgctctgcgccgcggagaacacccccgagatgcaggctttgcaggaacgggtgatgcccctgctggcggcgcacgccgacaagattctgttgaacgaaaagctcttcgaacgggtgaaggccgtctacgaccggcgcggtgcattggagctcgatgccgagcagagccgtctgctggagaagacctaccgcgatttcgtgcgcgccggggcgctgctcgacgccgagcagaaagcccgtctgaaagccatcaacggcgaactgtcgctggctgcggtgaagttcgggcagaacatcctcgccgagaacggcaactatgcgctggtgctcgaatcggccgacctggacggcattccctccaacgtccgcgatcaggcccgcgagaaggccgaagcgacgggcaagaagggcaagtatgtcttcacgctgcacaaacccagcctgatcccgtttctgacctactcccagaaacgcgaactgcgcgaggagatttacaaggcgtatctcaaccgctgcaacaacggcgacgagtacgacaacaaacagctgatcaacgacttcatccgtctgcgcacggaaaaggcccatctgctgggctatccgtcgtatgccgactatgtggtggccgacgagatggccgggacgaccgacgccgtctacaagctgctgaacgagatctggacgcccgcgctggagcgcgccaagggcgaactggccgagatggaggagcttttcaaaaaggattaccccgacggggagttcgcctcgtgggactggtggtactatgccgagaaggtccgcaagcagaaataccagctggaagaagagttgctgcgtccctatttctcgctggagaacgtgcagtcggggattttcttcctggcgaaccgcctctacggcatcacgttccgtcccatcgtcgtgccgctgtaccatcccgatgcgatcgcctacgaggtgctcgatgccgacgaatcgcatctgggcgtgctctatttcgactatttcccgcgcgacggcaagagccagggcgcgtggtgcggcaactacgtggagcagacctacgaggacggcaagcgcgtggcgcccgtggtgtcgatcgtctgcaacttcacccgcccgacgagcaacgcccccgcgctgctgaccctcgacgaaaccgaaacgctgttccacgaattcgggcatgcgctccatttcctcttccacgacgtgaagtaccgcggactgaccgaggtggagggcgatttcgtggagctgccctcgcagctgatggagaactgggccttcgatcccgaggtgctgaagcagtacgccgtgcactaccgttcgaacgaggtgattccggagtatctggtggcgaagctgcgccgcagcgagttgttcaaccagggcttcatgaccacggagctgatcgccgcgtcgctgtcggacatggacatccactcgatcaccgaatacgagccgttcgacccgatggagttcgagcggaaggccctgaccgaaaaacgcgggctgattccgcagatcgagccgcgctaccgctatccctacttctcgcacatcttcgacggcggatactccgcgggctactatttctacacgtgggccgaggtgctggacaaggacgttttcgaagccttccgcgagagcggcgacctgttcaacaagaggatcgccgacgatttccgccgcaagatcctcgcccgcggcggctcggaggacggcatgaccatgtaccgcgatttccgcggcaaggaccccgacaagcgggcgatgctccgcagccgggggctgtggaacgaacccgaaccggccgattcgctggccggctcgcctgagcctgccgagggcttccgtgtaaaggctgttcccgaaaactga

SEQ ID NO: 1896 - DNA, 1473 bp, Unknown
  Artificiall/Consensus sequence
atgtcaaacgaaatgtcgagaagaaagttcctgaaaacaggagctgccgccgcactcggtctggcggtcgtgcccagcacggtgttaggtaaaaaattcggccacaccgcccccagcgacaagctcaacatcctgggcgtgggtatcggaggccgcggcgcctcggtgctgaaagggctcgaaagccagaacatcatcggcctgtgcgacgtggactggaaatacgccgaccacgtgttcaagcgctacccggcagccaagaagtacaacgactaccgcaagatgtacgacgaactgctcaaatcggccgacgccgtgatggtcgccacggccgaccacacgcacgccatcatcgccgccgacgccatcacggccggcaagcacgtctacgtcgaaaagccgctgacccacaccgtctacgaatcgcgcctgctgaccaaactggccgacaagcacaagatagccacccagatgggcaaccagggagcttcgggcgagggcgtccgcaaggtctgcgaatggatctggaacggcgagatcggcgaggtgcgcaaggtggagaccttcaccgaccgtccgatctggccgcagggactggcccgtcccgagaacgacgagcgcattccgaagacgatgaactgggacgccttcatcggtccggccccctaccggccctacaactcgatctatacgccgtggaatttccgcggatggtgggacttcggcaccggcgccctgggcgacatggcctgccacatcctgcatccggtgttcaaggccctgaagctgggctccccgaccaaggttcagggcagctcgacgctgcttctgaacgaatccgcccccatggcgcagcgggtgaagttcgtcttcccggcccgcgacaacatgccgaaggtggccatgccggaggtcgaagtgcactggtacgacggcggtctgatgccggagcgtcccgaagggctgcccgcaggcaaggacctgaacatgagcggcggcggcgcgatcttctacggcacgaaagatacgctgatctgcggatgctacggcaaggacccctacctggtttcgggccgcgtgcccgaggctccgaaggtgctgcgcgagatcaccgaatcacaccagatggactgggtgcgcgcctgcaaggaggaccccgaataccgcacgccgagcgcctcggacttcagcgaggccggaccgttcaacgagatggtcgtcatgggcgtgctggccgtgcgtctgcaaagcctcaaccgggagctcgaatgggacggtgaaaacatgcgtttcacgaacattcccgacgacgccatgatcaagacggtcatcaaagacggtttccacatcaaggacggacacccgaccttcgacaagacctggaccgatccggtcaacgcgcagcagttcgcgcaggaactcatcaaacacacctaccgcgacggttggaaactgcccgacatgccgcgctga

SEQ ID NO: 1897 - DNA, 2826 bp, Unknown
  Artificiall/Consensus sequence
atgaaaaaattgatgatgctggccgttgcggcgttcgccgccgccggggccgcagcacagatgaaccagccgatccccgcggaccccgagctccgcaccggaaagctggagaatgggatgacctactacatccgtcacaacgaaaagccgaagggacaggccgatttctacatcctgcacgacgtgggagccatccaggagaacgactcccagcagggactcgcccacttcctcgaacacatggctttcaacggcaccaagaacctcccgggcaagcagctcacggagtatctggaaaccgtgggcgtgaaattcggcgccaacctcaacgccggaaccagctgggaccagacgatctacaacatctcggacgtaccgacctcgcgcgaaggcatcatcgactcggcgctgctgatcctgcacgactggtcgcacttcatcgccctggaacccaaggagatcgactccgaacgcggcgtgatcatggaggagctccgcacgcgcgacggcgcatcgtggcgttcgacgatgaagctgctgcaagcgctgggcaagggcacgaaatacgagcaccgcaacctgatcggctacctcgatggactgaagagcttccggcataaggagctggaggatttctacgcccaatggtaccgtccggactatcaggccgtcgtcgtcgtgggcgacatcgacgtggacgccgtggagaacaagatcaagacgctgatggccgacattccggcacccgccgccgacgcttcgcagaaagagaccatcgtggtccccgacaacgaggaaccgatcgtgagcatcttcaccgaccccgaaatgcagggcacgaaggtgcagctcttcatcaagcgcccggcgcttcccgagcagctggccaatacggtcgtcgccgaggccaacaacgtgatcgaagcctatatgacgaccatggagaacgcccgcctgcaagagatcgccatgcagcccgacgcaccgttcctcggcgccggcatgggcacgggcgacgtgatcggcatcatcccgacgctcaacgccacggtattcgttgcgatgacgcaggacggcaagctggcccgcggcttcgagacgctctgcaccgagctggagagggtccgccgccacggcttcacgcagggtgagttcgaacgcgcccaggagaacctgatgcgccaggccgaacgcacctacgccaaccgcaacgaccgccgcaacggcgagttcgtgcagacctacctgaacaattacagcaagaacaccccgatgcccgacgccgagaccgaatggcagctcgacagcatgctgatcaagatgctcaacgtcgatgccgtcaacgccttcgccgcgcagaccatcaccccgaacaatcaggtcatcatcgtcaccgcccccgagaaggaggggctcgcggcgccgaccgccgaggagctgctcgccatccgcgacaaggtgaccgccggcgaagtcgccgcctacgaggacaatgtggtcaaggagccgctgattcccgaaggcaccgttctgaaaggttcgcccgtcaagaagacggccgaggacgccgaactcggcacgacggaatggacgctggccaacggtgcgaaggtcgtcgtgaaacacacggatttcaaagccgacgaggtgcgcatgagcgccgtcgccaaaggcggtctgtcggtgctctccgacggggagttctacatgggcgagatgatgcccgccgtgaactcgatgtcgggcgtcggcaaattcccggccacggagctcaagaagcagctttcgggcaaaacggcgtcggtgcagccttcggtggagaactacgccagcgccatgaagggcgtctgctcgcccaaggacatcgagacgatgctccaactgctctacctcaacttcacgcagccgcgcttcgaccgcaacgactacgacaacctgatcaagatgctccgctcgcagctggagaacgcccgcacgaaccccgactacctgatgcaggagaaggtgatcgacgtgacctacggccacaatccccgccggcagatgatctcgaacgagatcatcgacaaattcgacttcgagcagctgcccgccgtctacgcgaaactctaccccggcgccaacggattcgtcttcacgttcgtgggcaacatcgaccccgaaacgctgaaacccctcgcggagaagtacatcggttcgatccccgccgccaggaagcccctgaattacgtcgatgacaaggtagaacccgtcaaaggcgaggttgcggaggagttcaccgccccgatgcagcagccgaaggtgtcggtggtttactacttctcgggcaagatgccctacacgttcaaggacaaggtggccctgacgttcctcacccaggcgctcgattcgcgctacctgatctcgatccgcgaggagaagggcggcacctacggcgtaagcgtccagggttcgacggagtacatcccccgcgagacctacgacatgaccatctcgttcgacaccaacgaggagatggccgacgagctgtgcgaaatcgtgatgaaagagatcgaggagatcgccgcgaacggccccaggagcgaggacatcgagaaaacccgcgagttcatgctcaaaagctggaaaaacagtctggagatgaattcgggatggatgaactacatccaggccaaatacggctcggggctggactacgtcggccaatacgagcaggccgtccgcaacctcacgaatgccgacgtgcaggccctcgccaaaaagctcctcgccgacggcaacctcgtgaaagtcatcatgcgtccggcaaaggaaaaggaaaaatag

SEQ ID NO: 1898 - DNA, 1827 bp, Unknown
  Artificiall/Consensus sequence
atgacgatgaaacgactctgtgccacagccctgacgatcgcgtgggctctctgcgcccttgcggcggaaaagtccggaacgatcgtctacatcaacggctcgaagtactacatccacaccgtccagccgggggaaacgctctacggactttcgaaaacctacggcgtgggcgagaaggtgatcctcgaaaacaacccttcgatcgcccgcgggctgaaaacggccgaaaacatcaagatacctttcgtgagcgacgttcccgagccgaagtccgacaggaaactgcgcaagaccttcgatttccatttcgtgtcgaagggcgaaacgctttacgccatttcgcggcagtatgaaattcccgtgaaaacccttctggaggacaaccccaacctcgatccgctgcacatgcgccttggggaacgcatcctgatccgcaagaagcagatcggttcggaggacgaagccggcacgaaggagcagtgggaggagtaccgccagtcgctgaacagcgtggccgacgagggtacggcctatcacatcgtccatccgggcgaaacgttctactcgctgtcgcgccgcttcggaatcacggagaccgagctcagcgcgctcaacgacgggctgaaacccgcggacctcaaagccggggcgatgatcaaaatcccgcagccggacggcgccgtgacggcggaagctgccgacagcctgcgccgggacagcgtggccgcctcggaacggcaggtcgttcccgtcgaattccgcgccctgcgccgcagcgaaccgcttcatgtggcgctgctgctgcccatcgccacgggcggcgaggccaacggcaactacctggaattctatcagggattcctgctggggctcgacagcgttaaaatccggcagggcatttcggcagaggttcatctctacaacacggcccgcgacacagcccgcatccgcgagatcgtcgagcgggacgaggcgttccgcaaatcggatctgatcgtcggaccggtctacgaagaggggctcactccgataatccgcttcgccgaggagaaaaaggtgcccgtggtgtcgccgctggcgcatatcgtcaaccataacagcgacgtgctgttccaactggcgcccgatccggctcacaagtacgagaaagcgggagatctggtgggcggcgacaagcacgtgacgctgatctacaccgcctcgaccgacaaggagttcgagcgcgagatactggcgctgttgggcgactcggaatactcccgctacacctataaatacgagcattcgtcggcgcgttcggccaacagcccgagcgacctcacgccgctgctggagaacgggcaggacaaccttttcgtgattctgtcggacaacagcgtcgatgtggagcggattctcgcggccctggcgtcggccgatacgagcatcacgagccgcggacgcacgacgccccgtttctcggtgctgggcaacccgcgctggaaccgtttcgggggaatcgaccgcgccatctatttcaaggaccgcgtggtattcttctcgacctatcatgccaaacgcgactccgaggtggtgaggaccttcgacagcgcctacatccgtgcgttcggcgcgttgccgacgctctattcctaccggggttacgacaccgccgtgatcttcgccccggccatgtacggcgacattgagtacgacctcgaagaccgccgctatacgccgttgcagacgacctatctattcggacagggcgagggacgcgaaaaccacgtcaaccgcaactggatgcgagtcaactacaacagcgacttcacgataaccatcgaatag

SEQ ID NO: 1899 - DNA, 1836 bp, Unknown
  Artificiall/Consensus sequence
atgcgccgaaaactcgcttttccgattgccgtattcgctgcgaccgttgtgatgatggccgtgcagaagcccgtgttcatggcttattacgccgtggaggcggccggagcgggcatccgcggatggatcgacgtgctgtggcacggactgacgctcgacatgaccgtcgcggggtatgtcaccgcgctgccgatcctcgtgacattgctttcactgtggctccgcctgcccgaaaaggtgtggcggggtgtgctgacgacctggttcgtgctggtcgccgtgacgacggccgtgatcttcgccgtcgatgtcgcgttgtacgagcattgggggtttcgcattgattcgacggtcctgatctacctcgccgatcccgaggaggcgatggcgagcgtcgatttctggctcggggtgcgacagacgttgctggcggcggcttatgccgcggggatgatctgggtttatcaccgcatcctcggcgttttcgacggccggccggtcggttggcgggtcgcttcgctgggcagccttgccgtcgtgatgctcgccggattcgattttctggccatccgcggcggcacgggggcttcagtggccaatgtctcgaaggtctatttcagttcgacgcagtttctgaaccacgccgccacgaaccccgtcttttcgttcctcgccagtctgggcgaccggggcgattacgccgacgaatacccttttttcgacgaggcggtgcgtgccgcgaagttcgacgctctgcggggcaacggtccggcggcaggacccacggaaccggtgctgaacaccgcgcgccctaacgtcgtgatcgtcattttggagagtttcgcccgcacggtcatggacgccgaggtcggcggggagcccgtgatgccctatatgcagcggctgaagggcgagggcatctggttcgagaatttcttcgccaactcgttccgcaccgaccgcggcgaggtggcgatcctgagcggattcccggctcagacacgcatgtcgatcatgaaactcccggccaagagccgcaacctgccttcgatagcccgttcgctggcgggcgaaggctatgccacgagcttcgcctacggcggcgacctcaatttcacgaatcagtcctcctacatgtacgctaccggatggcaggagttgatctggcagaaggacctgcgcttcgacgcccctgcggccgactggggttatgatgacgcgctgatgtgcgactggttcgccgatcgggtgattgcgctgagcgacgccggaaaacctttcctcgcggggttgctgacgctgagcagccatacgcctttcgacgttccctactcgaaattcgacgacaaagtgctgaacgctatggccttttccgacgagtgcgtcggaaagatgatcaaccgcttgaaagcctctcccgcgtggaaagacctgctcgtggtgctggtcgccgaccacggctacccctatccgcggatgctgacctacaacgagccgctgcgccaccggattccgatgatctggacgggcggtgccgtcgcccgcccgcgcgtcgtggaggattacgccgcgcagatcgacatcgcggcgacgctgctggcccagctgggcgtcgcgcacgacgatttcgattacagtaaggacatcttcgcaccgacccccccccgcaagttcgcctactacaccttcaacgacggtttcggcgtcgtggacgcttcgggcgaggcggtgtgggacgctacggccgaccgggcggtgacggctacgaattccgaactgctcgatgtcggccgcacgatgttgcagacgacttatacggatatcggccgccgctga

SEQ ID NO: 1900 - DNA, 1479 bp, Unknown
  Artificiall/Consensus sequence
atgaaatcgatcaaacaatacagtcagaccctgctgctgctgacgctgctgctgacgctgctgctgagcggctgcggggcttacctcgatgtcaaccccaaatcggaggtaaccgacaaggaacttttctccacggccgaaggctgcgaggacgccatctacggaatctatgccgagatcggcggcgagcgcaacgggctctacggacaaatgctcgcctacaaataccccgagctgatgaccggcaatttcaccatcaaccaaagcgacaacatggcctacgtcgtccagcggcaatggacgcacgacaatgccatcgccgtcgccgaagagatctggaccacgggatacaaggtcatcggccatgtcaacaaggccctgtcccacatcctgccgaaagacgacagcgaattccgccatacgcggctctacaagggcgaacttctcgccctgcgggctttcctccacttcgagatggcgcgcatcttcgccgtatcgttcgccgcgggcgacgccgcggccaaagccaaggcgattccttatgtgaagagctacggcattcaggtcactccgtacagttcgctcgacaaggtgttcgaattcatcatcgccgacctgaccgaagccgagaagtacctcgaagaggatgcgaccctgctgccggtggtgcgcgacaacgccatgggcgacttcacgagcaaccgcatcacccatttcaacctctacgccgtcaaggcgctgctggcccgcgcatactggacgatgaacgatctggaaaaggccgagggctacgcacaggaggtcatcgacagcggcaaattcccgctgaaaacgaccgccggggcctggaacagtctcgaaacgggtacgctcgacatgcaggaaaccgtcgtcggtctctactcgacgaccttcacgtactactattatttcgacctgatccgcagctccacgagcatgggctccatgaaactcgcggagcaatacacctcgatcttcgaagcggatcaggagggcaatgccgaccggcgctacgtggcgtggttcgaccggaacaacaactggtgcacgaagcactacaatgtgatgtacgcttccagcaacgactccggttcgacggcgacctacaacggcaattcgatcccgggcgtgagcctgatccgcattccggagatgtactacatcgtcgcggaggccaacctcacgaaagatcccgacaaggccaccgagtatctcgactacgtggtcacgtcgcgcgaccagaccgcgttcgccgaccgggaagcgggcaaaatcaccgaggagaatatcttcaacgaccgccgcaaggagttcttcgccgacggagacgatttccacaacatgaagcgccttgcccgcgacctcaccatttcgggcatgggaactttcgccggcaacgacgacgcgacctacacgatgcccattccggcaagcgtggaagacaattacagacaataa

SEQ ID NO: 1901 - DNA, 1059 bp, Unknown
  Artificiall/Consensus sequence
atgaaaaagatcctgatcctcgcagcggcggccgccgtgctgtgcagctgcggaaacaaaaacaaatacaccgtcgaggggaccgtcgccggcgccaacgacaaggtatacctgctcgacgaagaggataccgtcctcgactcggcggtcgtcaaaaacggcaaattccgcctctcgggcatcgccgaagctccggccgtggcgatcctgcgcgacgcccgcgaccagggtgcgacgttcgccgcgatgctgatcctcgaaccgggacggatcaccgtgagcgacgatgcggacaacgcctaccgcaagaaggtgacgggcacgccggccaatgacgccagcgacgcctatgccgcggccagccacgcgctggtcaacgagttccgcgacgaggcgaccggcgaagaacgccgcgccgcgatcgaaaaggagtacgaccagctgacccgcacgacgatggagcagaaccgcacgaatctcttcggcgcactgctgctggctcagcagctgggatacgagctttcgggacaggagctgctggacgaaatcgccctcttccccgaggagctgcaacggaacagcgtgctcgaatcgctcaaagagagcgccgagcagaagatcagaaccgatgtgggacagccctacaccgacgtagcacaacccgatgccgaggggcaggaggtgtcgctcaaatcggtcgtcgaaaacccggcgaacaaatacgtcctgctcgacttctgggcttcgtggtgcgggccctgcatgggcgaggttccccacctgaaaaaggcttacggcgagttccacaagaagggattcgaaatctacggcgtatcgttcgacaaggaccgtgagaaatggctcgaagccatcgaccgcaacggcatgaactgggtgcacgtcagcgaggtgaacggattcgacaaccaggccgcccgggattacgccgtgcaggggattccgtcgaacttcctgatcgccgccgacggcacgatcgtcgccagaaacctccgcggcgaagcgctttacgagaagatcgccgaactgctggcccgatag

SEQ ID NO: 1902 - DNA, 1791 bp, Unknown
  Artificiall/Consensus sequence
atgaaacgcctgacagcgacaacgcttttctgcctgctcttcttttcggcgttcgtcgccgggaagggccctgcggaaacgcccggataccccgattcgctgcgcagcgtgtggctctacaccgagggcatcaagcaaaacatcatcgcgggcgacacggcccgggcccgggaactgtttctcgaagcggtccgcaacgactcgacctatgccccggcgtggtacgaactggccgggaaccttctgaattcgtcgcccgaagaggccgtcgaaatggcccgccgcgcctaccggctcgacaccgcgaacaaatggtaccaccagttctacggacaggcgctgatcatctccaaccgcctcgacgaagcgctgaaagtctaccgccgcctgctggaaaacgacccgaaggacccggacaactaccgcatcgtggcggccctctacgaacagaaacggtcgccgttcatggcccttgcgacactcgattcggcagagctgcgtttcggacgcatcccgctgctgagcgccatgaaacggcagatgctggtggccacgaaccagatcggcaaagccatcgacgaagcccgtgcgatggtcgaagccgcgccctacgaagcgcagcaccacgtcgtgctggccgacctctacgggctcgacggcaaggactcgctggccctcgccgagtacggccgggcgttgcagatcgactccacgaacgtacagacgctgatgtcgctggccgatttccacaccggacggcaggattaccgctcgctgctggccgtcacccggaaactgtttctctcggacgccctgccgctcgaaacgaagatcaagcgcttcgaacagttcacctccgacacgcgcttctaccgcgaatactatttccagctgaacgacctggcctcgatcctggcgatccgctatcccgaggatcggcgcgtcgtggagctctacgccaaccacctgatcgcctcgggcgaactggaacaggcccttacgctctacaagagccgtctcggagaccgtccgcccgtggaggacttctaccggacggtgatcgacatcgaaacctatctgcaacaccccgattcggtggaaaaatacgtcggcaaggcgctggaactcttccccgacaaggtcgatttccacatctcgaaagggcatgtgatgaacagctcgaagcagtacggccaggcggtcaaagcctacaaggagtcgctccgctacgccgacaccgactcgctgcggggcgtgatctggggcatgatcggcgacacgtggcaccagcaggccgccgcgggcatctccgaacaggacgagagccgcacggcaaaggagggccgttcgggaccctaccgcaaggccatgaaggagtgttacaaggcttacgagcgcagtctcgcgtaccgtcccgacaaccccttggtgctcaacaactacgcctatttcctctcgctggaggagcgcgatctcgaacgggccctctcgatgtcgagccgcgtggtggcgctcaccgacaacaatccgacctatctggacacccatgcgtgggtgcttttcaagctgggacgcacggacgaagccaagaaggtcctgcaaaaggccgtggcgctcgacggacagaagagtcccgaactgatggtccactacggcgacatccttcacgagctgggcgaacagttcatggccgaaatctactggaaacgcgccctcgaaaagggctacgacgcccgacagatcgaactgcggctgaaacagcccgccaaaagctccaaaaccgccgaataa

SEQ ID NO: 1903 - DNA, 1959 bp, Unknown
  Artificiall/Consensus sequence
atgacactcgattacgacatcatcgtcatcggcggcggacacgccggatgcgaagccgcctcggccgccgcacggttgggctcgcgcacgctgctgctcacgatggacatgggcaaaatggcctccatgtcgtgcaacccggcagtcggaggagttgccaaaggtcagattgtcagagagatagatgcattgggcggtcagatgggccgcatcaccgacctaacgaccgtccagttccggatgctcaatcgttcgaaaggcgccgcgatgtggagtccccgggcgcaatgcgacaaaacccgcttctcggaggagtggcggcatacgctggaaaacacccgaaacctctatatctggcaggatgcggcgaccgaactgctgttcgacgacgccctgcgcacggattcctcacgaccggacaccccgggcgcagaagcaaacccgaaccgggacaacctccggtccgccgcgcaaacgcaccgtatcacgggggtccggacccgcatgggcgtcgaattcacctgccgcgccgtcgtgctcacctcgggaactttcctcggaggactgatgcactgcggagcttcgcacgccgaaggcggcagggcgggggacgccgcttcgcacggaatcaccgagtgccttcgccgaatcggtttcgaaagcggacgcatgaaaaccggaactccggcgcgtctcgatgcccggaccatcgactttgaacggctcgaaccccaatacggcgacgaaaatccggccaaattctcgtttttacctgatacacagccggttaaagaccaacttccttgttttttggtctatacctccgccgaggttcacgacatcctgcgcagcggtttcgaccagtcgcccctgttcaacggaaccatccgcggcatcggtccgcgctactgcccctcgatcgaggacaaactccgaaccttcgccgataaagatcaacatcagctctttctggaacccgaaggacgcacgaccaatgaatattatctcaacggtttttcatcgtcgctgccctgggaagtgcaatggaaagcgttgcataagattcagggattcgaagatttgcacatctatcgccccggatacgccatcgaatacgactattttccgcccacgcaactgcaccattccctcgaaaccaagctggtttcgggactctatttcgccggacaggtcaacggaacgaccggttacgaagaagccgcagctcaggggctgatggccggcatcaatgcacaccgggcattggcaggggaggagcccatcgtactgaaacgcgacgaagcctacatcggcgtgctgatcgacgatctggtgaccaaaggagttgacgaaccttaccggatgttcacctcgcgggccgagtatcgcattctgctccggcaggacaacgccgacatccggcttactccgttaggatacgaaatcggactgatttcgcagaaaagatacgaccatttcgtcaaaaaaaatacgctcgtagaatcgcttgtagagttcgcgcgccggcagagcatcaaagcagccgaaatcaacgactatttgaaatcggtaaattcagagcctttgacgcagggcaggaagctttacgacatcctgatgcgcaacaatgtcaccttcgaatcgctgcaaagagttcttccgaagctgaaaaaattcattgctgataacgaaatgaacgccgaaatgatcgaggaggcggagatacagatcaagtacaaaggctatatcgaacgcgagaaattcatcgccgagaagctccgtcgcctcgaaaatatctccattccgtacgatttcgactttcattcaatgaattcgctgaccatcgaagcccgtcaaaaactctcgcggattcggccaacaacgatagggcaggcgtcgagaatccccggagtttccccggccgacgtgaatgtcttgctaataaaattcggtcgataa

SEQ ID NO: 1904 - DNA, 1596 bp, Unknown
  Artificiall/Consensus sequence
atgaaacgatatctatttctgattccggccgtcgtggcggcgctgctgaccggatgttacagcgacgacacgaacaccgactacaagacgctcgacctgccggtgatcgacaacccggaaaacgacctggcgctgttcgtccccaaccgggcctacaagatcaaactcgccgaccgcttgcagatcacgcccaacgtcgtctacaagaacatgaacgacctctcgtaccgctgggtcatcgacggcagggaggtagccacgacgaaggatctcgactgggagtgcgacatggaagccaaccgggtctactgctatttcgagattcaccgcaactccgcggaaaactccacgatcttccctttcagcatcgaactcgatcagccttacgtgacgggttacaacctgttggtcgaaaaggacggggcgctgcgctacgactttatcagctataccgtggcggcgctttacacattcgactactacgagaacggcgccggcatccagattcctttcacgggcgacaacccccgcttgcaggagtactggtcgtgcgaaaagtcatccgtcatcggcaaagagatgttcctcgacgacaatccggagaactgcgcctcgttcagcggcgaaaccctgctgcacgaaatgacgctgaagcaagagttcctcaatgaggagtttccggagaacttccgggtgaaggacttcatgcacggcggcttcatcagctacgtgatggccgacgacgggcgtgtcttccagcgcaagggctcgcgcatctactatacgggacatttcctcgacctgccggtgcgttacgacggcaagcagatcaacggggtgaaattcatcacggcgcgttacgccgaaggctacggtctgatctacgaccagactgaaaacggcggccgtttcctggtggccaatctcgattacagcacctccgaggcggattccggcgaaagggcgggaaatatcacggagttccccgacgacagcggcatgagcggcatcaccgactacgagttcatcgacggctggttcatcaaggacgccaacgtcatggcctatccccagcagtcgggcgtcatgatgctgttccgcaagaagtccgacggcaaatattacacgcgcgaggtgaagatctcctacacgccgagaacctcggccgtagagatgtcggaggtctacgaagaggtttaccgcgaactccccgagttcggtcccgacagcaagatgtgcgtcatccgcatcgacggcggcagctactacaagtcgggttacatgttctacaccgcggcgtcgaatccgcgcaaagtgctggtcaaggagcgcacggcgacgggagctcccacggagttccacacgttcgatcaggatgtcgtggccattgtcgaaggtacgatgaaaagcaacaactgctatatgctcttcgcattggccgacggcacggtgatgatgtacaccacttcgaaccggaacgtgggttcgggcgtgaacttcctcaccttcgaggaggagcgcgtcatcgagaaataccggatcgacggcaaaatccgctgggccggattcaaatacggcaacatctcgaacttctga

SEQ ID NO: 1905 - DNA, 1878 bp, Unknown
  Artificiall/Consensus sequence
atgaagataacggaatttttgaccgcggcgctgtttctcgccggaacggtgtttcaggcgaatgcttcggatattccccgcggggagtacccgcggccgcagttcgaacggacggcgtggatgaatctcaacggggtgtgggactatacgttcgacttctccgggtcgggattggaacggggattggagaaggcgaccgctttcgagggccggatcacggtgccgttctgtcccgagagctccctctcgggcgtcgggtacaccgatttcatcaactgcatctggtaccaccgcgaggtggcggtgcccgaagcgtggcgcggaaaggacattctgctgaatttcggggccgtctactacaatgcggaggtctatgtcgatggcgttttcgccgcccgccatatcgggggcagttcgtcgttcagcgtcgatctgacccgtctggtcacgcccggaaagagccaccatctggtcgtgagagccacgagcgacgtgcgctcgacgacgcagggcgccggcaaacagaatctgcaatacgcctcctacggctgcaactacacccgcaccacgggcatctggcagacggtgtggatggaggccgtggaccctgcggggctgctctcggcgcacgtggtgacggacatcgaccaggggcagctggtcatcacgccccgcttccggtcggagagcggcaacacgctgcatatcgcggtgaaggagggcggcaaggtcgtggccaccgcggcggtgagggccgcgaacagttcggtcgccgtgcttcccgtcaaacgtccgaaactctggtcgccggagtcgccgtttctctacgacatcacctaccggatcgtgaatgcgaaaggggaggtgctcgacgaggtgaactcctatgcgggcatgcgcaaggtccacatcgaggggaaccggatctacctgaacaacgaaccctattaccagcggctggtgctcgatcagggattctatcccgacggcatctggacggctccttccgatgcggcgctgaagcgcgacatcgaactttcgatggccgccgggttcaacggcgcgcgcctccatcaaaaggctttcgaggagcgtttccactattgggccgaccgcctgggctacatcacctggggcgaggcgcccagctggggcatggatgccaacggcatcgagacggcccgcaatttcctgaccgaatggtcggaactggtgctccgcgaccggaaccacccctcgctgctgatctggacgccgatgaacgaggagtggtggcccgaccgggtgcagtatccccgctttacggcggacctctacgacctgaccaaggcgctggacccgacccgtccggtgaacgacgccagcggcggcgtccatatcaaaaccgacatctggaccgtgcacaactacgagcaggacccggcccggctcaaggagatcatctacaaggacggtgtgtttttccagacgccgctgcggtccgtcggggtcgctccggccaacatcggcttcaacggcctgcggcagaacgaccgctacgagtttccggtttacgacgggaagatgccgttcctgatcgacgaggtcggcggcatcaagtgggcgaaggaccaggaccgcgagtcgcagaccgaatcgtggggctacggcaaaccgccgaagagcgaagcggagttcctgcaacggctcgaagggcagatcggcgccgttttggagctggcggaccaggtctggggctattgctacacccagctgaccgacgtggagcaggagcagaacggcgtctattattacgaccgtacgccgaaattcgacacggagcggattcgtgccatcttcggccgtaatcccggggacaaggcgctgaagaaagactga

SEQ ID NO: 1906 - DNA, 1236 bp, Unknown
  Artificiall/Consensus sequence
atggcaaagacaattttggaagagaacaagaacaatcccgcggctgacgcttccctttcgaccgacggccgcgagcgcgccgtgctggtctccgtcatccgggacaatcaggacccgcggcaggccgaggagttcctcgacgaactggaatttctggccgagacggccgacatccgctcggtgaagcgcttcacccagcgcctgccgcagccctcgtcgcgcatctatgtcgggccgggcaaattggaggagatcgccggatattgcaaggagaacgggatcgacgtggtgatcttcgacgacgagttgtccccttcgcagacgcgcaacatcgagaaggagatgccctgccgcctgctggaccgcacgcgcctgatcctcgacatcttcatgtcccgggcccagacggcctatgccaagacgcaggtgcagctggctaattacgaatacctgctgccccggttgtcgggcatgtggacccacctcgaacgccagcggggcggcacgggaacccgcggcggcgccggcgagcgcgagatcgagaccgaccggcgcatcatccgcaaccgcatcgccaaactgaaagaggacctgaaaaagatcgaccgccagatggccgtgcagcgttcgaaccgcggtgcgatggtccgcgtggcgctggtgggttataccaacgtggggaaatcgacgctgatgaacctcatctccaagagcgaggtcttcgccgagaacaagctcttcgccacgctggacaccacggtccgcaaggtggtgttcgacaatttacctttcctgctctctgataccgtagggtttattagaaaacttcccaccgagttgatcgagtcgttcaaatcgacgttggacgaggtccgcgaagccgatctgctggtgcacgtggtggacatctcgcacccgcagttcgaggagcagatcgacgtggtgaaacagaccttgcaggagatcggcgcgggcgacaagcccgtctacctggtcttcaacaaggtcgatgcctatacgtatgtcgaaaaggacgaggacgacctgacgcctccgacgcgcgagaaccgttcgctggacgagttgaagcagagttggatcgcacgggccaacacgccttgcatcttcctttcggcgcggacgaaggccaacctcgaaaaattccgttcggacctttacggcatggtgcgcgagatccatgccgggcgttatccgttcaacaatttcctctattga

SEQ ID NO: 1907 - DNA, 3978 bp, Unknown
  Artificiall/Consensus sequence
atgggaaaattttatccgcttgtcctggcgttttgttgcggcgtttttccgctccgtgcgcagtcgatccatttcgaccggctggacattaacgacggattgtcgcagaatacggtcacttctatcattcaggatgacaaaggcttcatgtggttcggcacgaaggacggcctgtgccgttacgacgggaaatcgttcaagaccttcatgcacgatccccgtctcacggccggactggggaacagcctgatcaaacgtcttgtccaggatcacggtcacagaatctgggtcggcaccgactcggggctttatatctacgatcccgagacggagcatttctccggcgtgccgctctacgctgccgacgggaagccggtcaccaagcccatttcgattctcgactgcgaccgggagggccgcgtctggatcgtcgtggagaacggcgacgttttctgctacgatccgcagacccgtgaggtcgaacgccgctacaagccgcggaagccgctgcgcagcctcgcttccgataagaacggggtcatctggttcgccggctacggcggcgggctttactgcaccgaggacctgttccggaccgtgaaaccgttcctcgacgccgacgggcgggagatttatccccaggacatcatctccttcatctgtctgagcgactacaacgagatgtacctcgggctggaggagcgcggcgtggcgaaggtggacctcgtctccggaacggttacccgcctgcggctgtcggacaaccccgatgcgccgctgttcgtgcgccatatcctgccgtattcgcccgaggaactgtggatcggaaccgagtcgggtatcgtcgtctacaacgtccgcacccggcgttaccagcatctgaaaagctccccgtacgatccctattcgctctccgacaacgccgtgtattcgctttgcaaggaccgcgagggcgggttgtggatcggttcgttcttcgggggcatcaattacctgccccagcggaactccgatttcgaaaaatattaccacaccgacgatccgcacagccttcagggccgccgcgtgcgggaaatctgccccggcagcgacgggcggctctggatcggcacggaggatgccgggctctacacgttcgatccggcgacgggttcgttcggcttcttcgccccgagccgggagttctccaacgtccacggactgctgttggacggggacgacctctgggtgagcaccttctcgaaaggcatccgcgtgatcgacacccggacgggccgcatccgcaaatacgacaacgacaacaagccggggcggctgttcagcaactatgttttcgccctctacaagaccaacggcgggcgcatctacgtgggaaccatgcacggactccagtattacaaccgcgagacggaccgtttcctttacgttccggagatcaacggcggcaagatggtccgcgacatccgggaggattcgaacgggaatctgtgggtggggacctcctccaacggcgtctaccgttacgacgcgcgcaacgacgtttggacgcagttcctgcacgatgacgacgatcccgactcgcttccctacgacaacatcacgggcattttcgaggacagcggccgccggatatggctcaccaccgagggttcgggcttctgccgcttcgaccccgccgggaacaccttcgtccgctacacctcctccgacggaatgcccagcgatgtcgttttccagatcatcgaggacgaccgcggctatttctggatcacgaccgaccgggggctggcgctgttcgatccccgggcgggccgtgtccggcaggtctacaccgtgaccgaccgtctgctgagcaatcaattcaactacaagtcggggtacaaatccccggacgggaccatctatttcggctgtatcgaggggctgatctccttcaaccccgagacgctcctcggccgcaagaccgactacgtgccgcccatctacatcaccgatttctcgctgcttgacgagaaagtcgctgtcgggggccgcaactctccgctgcgcaagagcatcatctgttcggattcgatccgcctgaaacacgaccagaactccctgtcgttgcagatcgccgccctgagctaccgcgagccgcagaccagccgcctgctctataagctcgaaggcttcgacgaccagtggcggcagtgcacgcccgggagcgccacgatcacctattcgaaaatcccctacggcaaatacagcttccgggtgcgtctcccggcggggtcggaccatgccggcccggaggcggagaagcgtcttttcatcgaggtttcgccgccgttctacctctctgcggcggcctatgtcgtctacgggctgcttgccctgggggcgctcgtgctgatccggatttactatacgcgccgcaacgtccgccgccagcagcagcacatccaggctttcgagcgcgaaaaggaacgcgaattgtacaacgccaagatcagcttcttcaccaacatcgcccacgagatccgcacgccgctgacgctcatcaaagggccgttggagaacatcctcggccgccagatgacggaccggagcatggccgaggacctgatcgtcatggaccgcaacaccaaccgtctgctggacctcacgaatcagctgctggatttccagaagatcgagaaagagcgtctgtcgctcaacctgacgcggcagaacgtgacggatatcgtcgaagagacgttctaccgtttcagctcctcggccaagcagcagcacaagaccttcgaactggacccgggcgaaggggcgattcatgcgcaggtcgatcgggaggctttcaccaagattctgagcaacctgatgaacaacgccctgaaatattccgagacgatgatccgcgtcgggctgtcggtggcgggcgatgcgttccgggtcacggtgaccaacgacggcgaggtcgtgcctccggagatgcgcgaggccattttcgccccgttcttccgccatacccgcaaggaggaatcgaccggaacgggaatcgggctggcgctgtcgcgctcgctggccgaactgcaccacggcacgctggcgatggaggccgacacggaactgaacgtgttcgtgctgaccgttccgctctgccggcaggaggcggaggcggtcgtggaaaccgtatcggcggaggatgccgagagcatctccgacgagcgcggcgatcccggctgggaggcttacagcgtgctggtcgtcgaggacaaccccgagatgtgcgccttcatccggcggcaggtgtcggaaagctactcggtgctcacggccgggaacggcgtcgaagcgctggagctgctggagaagaactacgtcaatgtgatcatcagcgatatcatgatgcccaagatggacggcatcgagttttgccggcaggtgaaaaccgacctgcgttacagccatatccccctgatcctgctgtcggcgaagacgaacctccgttcgaagatttcgggcatggacgccggggccgacgcctatgtcgagaagcctttttcgtcggattacctgctgtcggtgatcgccaacctcatcaagagccggcagatgctgagcgaggctttctcgaaaaatccgctggtgctggccaataccgtggcgacctcctcggtggacaccgatttcatcgtccggctgcaagagatcatccaggccaacctcagcgatcccgagttcaagatcaacgacatcgccgagatggtgcacatgagccgtgcgagcttctaccgcaagatcaaaggcgtgctgaacatgaccccgaacgactatctgcggctcgaacggctgaaaaccgcggcccggctgctccgggacaagcgttaccacatcaacgaggtctgctatatggtgggattcagttccacgtcctatttcgccaaatgcttccagaagcagttcggcgtgcttccgaagaagtatgcgtccgagtga

SEQ ID NO: 1908 - DNA, 1683 bp, Unknown
  Artificiall/Consensus sequence
atgaagccattcaataatttccgccgcaggctgctcccggccgcagcaatggccgccgcaatcgcagcggctttcgcgggctgcaccaaggtagacgacacgctgggcggaaacctcattccggaaaatcagcagatgaaagccggatacgtcgaactcctcggcgaggggctgaatccccggaaatacgtcgaaacgcggctgttccagagcgattcgctgatcggttcgaacatctcctacggctatttcggcacctgcatcaacgacacgctcggcgagcgcaaggccggattcctctcgcagatgatcaactactacaaggtcgatgaggggtatttcggatatatgccgatcttcgactcggcgcaaatcatgctcaaaatcgccagcataggccgcgacagtctgaccaagcaaaaattcgccgtgtacgaaatcctcagcaacgactacatcgacaaaaagccgattgccgccggcaagtcgcaggccgacacgacgttctacatcaatttcgacccgcagaaccccaacggagacggttccgcagcgccggtctataatcccgaaaaaccgctcttttggttctatttgggcggcaagggcacgaccccttcgacggccacgaacatcacgctggagcctaccgaggagggaaagaattacatcaagcggctgatgctgcaagagggcaaatacaaggacaaatactcgatttacagtcccgacagtctggaatactgggtcgaggagttcaaggggctctatatctgccccgatccgaatgagcccgtccagaagaacggcaccaaggagaccggtacgatcttctccacgtcgctcgactattcgggtctggcggtcttcggccgtaaccgggtggagggcgacccgacgctgatcaaggacacgatcggcatggtctactatttctacgaatccggcaccgagttcggcaatgtctcggtgaactccatccgccacaactacgatgcggccacttcggacgccaagatcgacatctcccaggcccgcgaggtcaatcccgacggaaccatcaatgaaaaccgggggctgaattcccgcgtctatgccgaaggcatgggcggcgtggtgaccgagatgacctttacgccggagtttttcgcacggatggaagaggagatcgccgaagcgaacgaaaaggacggcaaggatttcaagacgctggcgttcggtcaaacgaaaatgtcggtctatttcaccgacagcaaatacgactgggaggagctgaccttcggcagcaagctgatcgacgaaatgaacgccttcccgagccgtctgggcatgtacaccaatttcaaggcgctgacgccgatttcggactacgcctattcctacgagcagaactacaacacgtcgctcgcttacggaggctacatcaaccgcagccgcgggtgttacgtgatggacatcacgggctacatgcaacagctgtggaacagctatatcaaggccaaagaggcggcgggcggcgtaatcggcgacatcgactgggacaaggtcgcaaaccgcacggtctacatcggccccgatgcgtacagcctttattccacgtcgttcggcgtattgcagggcatggccgccgacggcaacgaagccccgatccgtttcgaaatattttataacctgatcaaataa

SEQ ID NO: 1909 - DNA, 1965 bp, Unknown
  Artificiall/Consensus sequence
atgaacaaccgtaaattcagataccggatcgcaacgctcctctccgtgctggcgctcctgacggccggatgcagcgacgacacgacggagaacaccgcccaaagggaccggctcgtcaccgatctgctggtccccggatcgaccttctacacctcgaccaccaaggagctgaccattcagggcaagggcttcgccgaaggggatgcgctcgcgctggccgacgttgccacgggagcggagattccgctcacgctcaaagcgatcgaccacgcctacgtcaccttcgccgtaccgcaggagatcccgacgggctcctaccgcctcgtcgtgcaccgcgggcgggagagccaggtgctgggcatcctcaaattccgccgcagcctcgacatcgaaatccccgacaaggagggcatgaacgtcaagggcgtggtcttctgcggctcgctgcccgtcgcgggcgtggtcgtctccgacggcgaggtcgtcaccacgaccgacgacgcgggctgctactacctcgcctcgaagaaacaccacggctacgtcttcatgagcgtgccttcgggctacgaaccccagtcggaaaactccgtgcccctgatctggggtccggtgacccccggcgaggaggcgtgcgaacaggtcgatttcgagctggtcgaggccccgggacaagatgatttcgacctgctggtgctggccgacatccacctggccaaccgtctgggcgacatagcccagtacaaggagctgatgcttcccgaggtgaagaactacatcgccgcttcgccgagaaaggtctacatcatgaacgtcggcgacatgaccttcgacctctactggaattcgaacaagtacaacctgggcgactacaccaacacgctcaaggactcggccatcccggccctgatctaccacgtcccgggcaaccacgacaacgacgaatacgccaacgacgactacacggccgaacagccctacaaggacaatctcgggccgacctactattcgttcaacatcggcaaggcgcacttcatcatgctcgacaacacggtctacctcaacgccggggccgacgcctcgacccggactccgggcgaccactcctacaactccgccttcacggagatggagctcgcgtggctgaaagccgacctggcgaccgtcaaggacaagaacgccccgctggtgatcggcacccactgccaagtgttctactacaactcgtcgctcgacatcaccccgtcgatggcctacggacactcgacggtgctcgaccagctgctcgccgacttcacggacgtgcacatcatctcgggacacacccacaacaacacgacgatgaagatccgcaacggcctgatggagcacaacacgggcggttcgtgcgcgacgtggtggtggacgggctattacagcaacggccacatctgcaaggacggcgcgccgggcggcatgggggtctacgagttccgggacaccgacctcgaatggtactacaagggctacggcgaaccgcgcgatttccagctgcggacctacgacatgaacaacgtcaagaccttcttcgccaacaactcggtcatccgcaacatgatccgctactaccccgaccgcaacgactacgccaacgtgggcaacaacgtggtctacatcaacgtctggggctgggaccccgaatggaaggtctcggtgaaggagaacggcgtggagctcaaccccacgcgcgtctacatgaaagacccgctgcacacctacgcctacgacgccacgcgcgtctacaaaaactcgaacaacacctacaccgaggtgctgacttcgagcaacaactatcacctcttcgcagcgaacgcttcgagcgccacctcgacgctcacgatcgaggtgaccgaccgtttcggcaacaagtacaccgagacgatgtcgcgtcccaaggagttcgccgcgcagatcgagaacctgtaa

SEQ ID NO: 1910 - DNA, 2493 bp, Unknown
  Artificiall/Consensus sequence
atgacgcaaaggacgatcatcatgtttctgctcggaatcctctgggcggcaggagcttcggcacagaccacacgtgtccgcggacgggtgaccgacgccgccgacggaaagcccctgcaattcgtcagcgtcgtattccccggcaccacgacgggcatcaccaccgacgagcagggcatctacgccctcgaaacccgcgacacggtgagccgcgtgcaagcctcgatggtcggctacgccacgcagaccctcccggtgacgcccgggacgttcaaccacgtggatttcgccctcgaagccgtggagttcggcatcgggcaggtggtcatcacccccggcgagaaccccgcgcacccgatcctcgacggcgtgatccgcaacaagccgcagaacgaccccgaccgctacgacacgtacagctgccgcacctataccaagatggaactcgacctgaccaacatcaggccgcagttccggaacaagcgcctgcaacgcaacttcggattcgtgttcgactatgtggacacctcggcgctcacggggcaggcttaccttccggcgatgatctccgaatcgacggccgagctccaccgcagcagccgtccggagttcaagcgcgaggtgatcctcgccagccgcgtttcgggcgtcgaggacagtttcgccgtggcgcagttcacgggcgggatgcacggcgacgtgaatttctacgacaacttcatcgacatcttcaacgtgcgtttcgccagtccgctggccgacgggggccgctcgttctacaactatttcctcgtggacagcgtgatgcacgagggccgcaagacctacaaaatccgcttccatcccaagcgtctcacaaccccggtgctcgacggcgaggtcaatatcgactcggcgacctacgccctgcaatcggcgtcggcacgcatgcccaaaggggtcaacgtcaactggatcaggcacctgatgctcgaaaacgagaaccggcggaccgacggcggccgctggttccgcagccgcgaccgcgtgtcggcggagttctccgtctcgacggccgactcgtcgaagctcacgtcgttcatcggcacgcgcgaggtggcgtacagcgacgtgcggatcggcgaaccgattcccgacgaaatcctgcgcatggacaacaacgtcgtggtctgcgacgaccggcccgggcagcacgacgaagcctactgggagcgcatacgcccctactcgctgagcgaaaaggagaagggcatctattcgatggtcgattcggtgcagaacgtgcccctctaccgcaacatctacaccttcgtcaacaccgtcatcgtcggctactggaacacgaaatacatcggcataggcccctactacaaactcgccagcttcaacaaactcgaaggcttccgcatgcagctgggagggcgcacgaccaccaacgtcagccgcacggtgcgcgtcgggggctacgtggcctacggcacgcgcgacgaagacgtgaagggcggcggaagcgtcgaactggccttcaatcggcggctgacgcgcaagctgaccctctcggcccggcacgacgtgatgcagctgggcgccggacagaacgccctgaccgaaagcaacatcctctcgtcgatcctctcgcgcggcgaccagcggctctcgatggtcaaccgcggcgaagcggtctacgagcacgagtggcgccacggcgtgagtgcgttcgcgggggcgcgcatgcagcgcatcttcgccaaccgctacgtcccgatgctgaggcccgacggcacgccggtcaactccgtatcggatgtcgcggcgagcgtcggactgcgcctttcgaagaacgagacggtctaccgcatgcctttcgacaagcagtacctgggatcgacctaccctgtcctcacgctcggattcacggctgggatacgcgacgccctctccggcagtcccgaatactaccgtctcgacgccggcatccgctaccgccccgaactgccgcccgtgggctattcggacatcacggtgcagggcggccgcatcttcggcaaggttccctacctgctgctcaaactccacgagggcaacggcacctatttctacgatccctacgccttttcgtgcatgaatttttacgaattcgcctccgatacctgggtgtcgtggttttgggagcaccacttcaacggcatcctgctggggcgcctgccgctcatcaaaaaactcaaatggcgcgaggtgctggtctgcaaaggggtctggggcacgctgtcgaaagaaaacgacggctcgctggccggaacgcaggccgacctgctgttccccgtgggtatgacctcggtatcggacccctatgtggagatgggattcggcgtggagaacatcttcaggctcttccgcgtggactgcatctggaggctcacccaccgcgaccccacgcccgggcaggagacgcagaatttcgccgtcaacctcagcctgcggctcaaattctga

SEQ ID NO: 1911 - DNA, 1770 bp, Unknown
  Artificiall/Consensus sequence
atgtatatcaaacaattcaaacaatttcaatggctcttttgggtcgccgcagtctccatcgccgtctcgtgcgccaagtcgtcggccccggaagaggagaatccggtacccccggccccggtcctccggtctttcgatctcggaagggtcgattcgctcaacaaggtgtgcaattatgcgtcgagcgtcgtttccggcgaagacgggtctatgaaaatactcctcctgagagacgatgaatccatagacataaccccggaggatctgaaatccggcctgaaagtcgaggacaagggacgctacttcctattttccaagccgggggggggtgaacccgacgcgattctcggcagcgacatcccgatgccctacaatccgcccctgcgcaggatggaagagggccggacgctcaatattctctgtatcggcaacagcctcacggccgacgccgtggaacatcttccgagaatcctgaaagacatgggaatcggcaatgtcaatatcgacgtaatctatcacggaggatggtcgctcctgaaccactggaacaacttccgggacacgaaatgctcccgctacatctacgaggcgggcaaggacgactggacggagttcgatccgaatctgctggatgactgcgcggcggacgttctcgcgctgcgggaatacgacatcgtgactttgcaggacgacacgaggaccaattgcagcggatggtccgaggagggccgggcggcctttctcgaactggtcgatcacatacagcatgcgcagccgacgcaccgtccgagtatcgtctacttcgcccctcattgtcccgccgcaaagctctacggcacccataacaccattctgtgggagctcttcgacggagaccaggacaaatgctacgcagcgtttctcgcccaaatgcgggaagcgacctcccggacccccgtcgatctgttcttctcgaatgcgaccgccgtgcagaatctccgcacctcggaactcaacgagaaccacccgctcgacctcagccgcgacgggacccattccgactatggagtcacgcgcttctgcgaatcggccctgttcttccagtccattctgaaacccgctctcggggcggacatatcggagagccgctatcttttcggcaaaagcgacgaaaccccgggcaaatgctcgaccccggtcgatgaccggacccggccgatagcggtcgaagcggccctgaacgcccttaaaacgcccttcgagatcacgagaatgtccgaagagaagccccccgtcgagggttcggtgaattacgtcctgaaactttgcgattatccgatcacgctggaaaatgcgcccgaagacatctgcacgataaaaaaggccggcgctcccctcgggctcgactgggaaatttcgggagaggcccatgacaagttcgtgatcaccaacggcgctgccaacggacgctataagatcggggccaacgccgactacgtggacccgttcatcctgaaaacgaacggactcgcgggaaagaaaatctcgaaagtctccgtctggatgtcgagcggagtgaaggacaagctctcacgcgtgtccgtcagcgtaggggaccgggagtatctaccccttacggaggcggccgtcagcgtgacggccgtgaagaacacgggcttcgagtattcggccgactgcggcgcgtccacggaaggcgaggtcaagataacgatccgttcgaccgccgcattctacatctacaaaatctatatcgactacgagcaggagtag

SEQ ID NO: 1912 - DNA, 1593 bp, Unknown
  Artificiall/Consensus sequence
cgggacatccggtttttgtttttgttttcgccgggctggccggcgttttcggcgtgcggccgcttccgcgggcgttccgcacggctccgtccgtcctccgccggcggacggcgccgggtgaaaagtttcggccgggagctttctacgggtcgcatccggcaaactatttgtttcaaaatgccatctttgcggttacagcgaaaccagttaaaagaaggcattatgaacataggaaacgatccgaaaaaacgattgaacatgagtatcaagccgatgctcaacattcgccccggcagccccgacggacgctatacgctcgtcattcagctcatactcgaaagacgccgcggcgtgctcttcacgccgtaccgcctgctgccggaggaattcgatctccggaaacgcaaggcggtcgccgtcaaccagcgcaagacgcacatggcgcatatcagggatgtcaacgcctttctggagaaacagcgggaggagatcgcgcgcatcctcgccgaattcgaacgggacggaaaacccttcaccgtccacgatattacttcggcttaccgccggcgatacgacaaccgctacgtgcacacctttttccagcatcagatcgcggagctgatcaaggagggttcgcagggtacggcgaacaaatacaatgcgacgctggtggctttcgagaagttcgccggcagccgccgggtccacttcgacgacatcgacgagaacctgttgttggatttcgaacggtatctgcatcagattccgctgcaacccaacacggtatccttctacctgagcaatttccgggcgctgtataacaaagcccagaaacgcgggtatgtgacccgcagccggtcgcctttcgatgccgtgcccatccgcatcgggaagacccgcaagctggccgtcagcgaggagatgctccgcaaggtcgccgacgcccggttcccggattccgagaagctgacctgcgcccgggatctgttcatgttcagcttctactgccggggaatgtcgttcgtggatatggcctatctgcggcaggaggatattcacggagggatgatctactaccgccgccgcaagacggggcagacctatacggtcaagatcattccggaggtgcaggagatcctcgaccgctatcgggagcgctgctttccgtgggcgctgcccgtgatgctcgacttcgacggagagggccgtttgcggcctctcgtatacgagggcacgacggcggaggaccgcaagcgcttcgaagcgcggttgtatctgcgctataagtacaacctgtcgcattatctgcgcttttaccgggatatgagcaaaaaactggaactgcccgtcaaactgtcgttcaacgtcgcccgccacagttgggccagcctcgcgcgcaagcacggcgtctccgtttccgtgatcagcgcgggactggggcacacttccgaaaagaccacgcaaatttacctcgacgaactggacaacagcaccgtggacgctgcgaacgcgatggtggcgggactgctgaaagctccggctccggatcggggaaaaagggcggagaaaaagttgaaatcagcgaaaaaatag

SEQ ID NO: 1913 - DNA, 1884 bp, Unknown
  Artificiall/Consensus sequence
atgcgattttccatacttaataccggaaaaaaacgttatctttaccgaatgtatgtccggttctgcatattggtactgaccctgactgcggcggcgaccgcctctttcgcccgcgtcgcaggccccggtgcgcatatgcccgaccgtttcacccccgacagcgcccgggtgtcgaatcccgacgcctcggcccgcaaccagcgtctttacgacagcatcgagtcgaaaaccaaccgccgcgccgtgccgcgcatgctctacaagatgcttttcgtgaaacccgtcctcgacaccaccatgagcggccgcgtgaccgacgaaagccgcctgctgcaaccctactccgggaaaaccatcggagaaatcaccatcgaccgccggcagatcttcgaccccggaggcaactggctcgaacgcaccgccaacaagacccaccgcctcacccgcgaacgtgtcatccgccgcgacctgcttttcgaaccgggcgacacgctcgatccggaactgatcgtgcgcaacaaacagctgatccgctcacgcggctacatcgccgacatcgacatcgcggtgctgcccgacgccttcgactcgacgcgcgtcaacctggccatcaccacgcgcgacagctggaccatctcggttgacggaggatggtattccgaaagccggacgatggtcgggctctccgacgccaacatcctcggctggggcaacaagctcaaactcatgaccaacttcagccgcaaggacttctcctacggcggcaacatggtcgaatacgaaatccccaacgtgctggggagcttctacaccgcggagttcgccgccggacgcgacttctacaactcgacgctcgacatggggctgcgcaaggaattcatcaagcccaccgactacgagatcggcctcacgtacagcgacatcaaatccaaacgctacatggtcgagcaggacacctcgctgctggtcaaggagcggaacctcgacgcctggggcggctactcccgctacctgcggcggatcggttcgagcgtctacctcacgggacgctacaactaccgccgcgtcagccggcggcccctcgtgggaccgcatttcaacccggcgctgcacgatcaggacgccctgctggtcggggcgggactctaccgcgaaaaattctacacggccaacatgatctacggattcggacgccgcgagtacctggcgacgggctacaaagccgagctgacgacgggctattcgtggggcgaattcaacgatgccatgtacctgggaatgagctacgagaccggaggcttccgcggcgtgggctacatcatgggcggattcacgctgggaagctacatcgacctcaacgacggcatgtggcaccgcagtgccgtggatgtcgatctgcggtggttctccaacctgttcctcttccggcgcagccgcatccgccagttcctcgccttcaactacacccaggggtggaaccgcggcacgggcagcgacgaaagcatccgattcacccgcaccgacggattgcaggccctcgaagagcatatcatcggcaccaaccgcatgatcctcaacaccgaaacggtcgttttcaccccctatcagccgctgggattccgcatcgccgtcttcgggttcgccgacttcgggctgatcggctattcgcccaacatcttcaaaaacgactttttcacctcgctcggtctgggcgtgcggctgcgcaatgaacggctggtattcaacacgatccaaatccggctgggcatcgccttcggcaaaaacggactggtcgaaagcgagtatttccgcctctcgaactccacgcgcatggagcagtaccgctatcgcccgatacgtcccgagatcgtcgaattcaaatag

SEQ ID NO: 1914 - DNA, 1212 bp, Unknown
  Artificiall/Consensus sequence
atgaaaaacctcattttcgccgcattcgcgctctgtctcgcaggaggagccgcggcacaaacgcccgaaacggccgctccggagggctaccgtttcaccgacgttaagatcatgcccgtcacctccgtgaaggaccagagccgcagcggcacctgctggtgctactcgaccctgtcgttcctcgaaagcgagatcctccgcgccggaggtcccgaactggacctctcggagatgtggatcgtgcgcaacatctacttcgaaaaagcggtgaaatacgtccggctccacggttcgctgaacctcgccgtcggcggccaggcccacgacgtgaccggcggcatccagcgctacggcatcgtccccgaggaggtctatccgggactgaactacggctacgacaaacccaacttcgacgagatcgacgccgtgatcaaagcctatgccgacgcggtgatcgccgccgcctcgaaacaccgcgacggaagcaaactcacgaccgcctggcaggccgggctgaacggcatcctcgacgcctatttcggcgccatgcccgagaaattcacctatgagggcaaggagtacacccccgcatcgttcgccgcgtcgctgccgatcgacatgaacgactacatcgaattctcgtcgttcacccaccaccccttctacacggagttcgctatggagattcccgacaactggaactgggacaaggtgtggaacgtgcctctggacgagttcatgcggatcatcgacagctcgctggaaaagggctacaccatcgcctggggcaccgatgtcagcgaaaagggattcagccgcaccaaggggctgggcatcatccccgaggccgacctcgaaggcatggagggcaccgaagccgagaagtggggcaagctcacccagaaggagaaggaggccgcgctctacaacttcgaaaagcccggcaaggagcgcaccatcacgcaggaactccgtcaggagggatacgacaactacgagaccaccgacgaccacggcatgcagatcgtgggcacggccgtcgatcagaacggcacgccctactacaaggtcaagaactcgtgggctcaggtcggcccctacgacggctactggtatttctcgcgtccgttcgtcgcctacaagacgatgacggtgctggtcaacaaaaacggcgtgcccaaggagatcctcaaaaagatcggcctcaaataa

SEQ ID NO: 1915 - DNA, 1785 bp, Unknown
  Artificiall/Consensus sequence
atgaagactttttccatcatcctgacggcagccatcacggcgattctcttcgcggcaggctgcgtgaacgaggaaccggcctacaagaacgaacccggcaccacccctgcaccggaggacggcacgggctatctgtcgatggccggcatgacgatgcgcgtcatctacgacgaccagaccgacacgcagcccgacgacacgtcaagcgaaacggtcaagccccagacgcgcgccgaagaggcacagcccgatgtcgatgaattcatcgtcgagatcttcgacgccgaaggcacgacggtctacaaggacacgtatgccaatctgcaaaccaaaacggcggcgaccgacggcaagatggagcttccgacgggcagctacaaactggaggtccgttcggagaaaccctcctcggaactcgccgagtgggaccatccggtctatttcgcggcacgcgattttgcgatcgaaaaaaacgaggacaccgtcctcgaagagatcgtctgcacgctgagcaacatcaaagtgacgctcacgtgctcgaaagacctcgcggaccagttcaccgccgaaacgatctccacggtctcgctgggcgaaacgtcgatggtctttatcaagggtgagacgcgcgcggcctatttcacctccctcgcagagctcaacacgctcaagttcaacctgacgggagccttcgccgaaacgcccgaaacgccccttcagttcaacaaggagatccccaacgtcaaggccggacagtggcgcaagatcacgctcgtaatcacctatgccgacaagggcgggatcaaattcgacatcgacgttaagaatttcataatggacgaagagattcggatcgacggcacggcgaacgtctgggaaccggtcttcgaagagggtcccgaccccttggccccggcgatcgaatggcccgggcacgacctcacggaaccgttccggatcacctcctcgatgttcgacgccgacggcaagtgcaccgagcccttcgcgctgaatctgaccgcccccaacggcatcgaatcgctcgtgctgaccttctcatcgacgaactccgccttcatggacgctctcacggagattcagattccccattcgctcgacctctgcgccaccacgcagggccccgcctatgcgattctctcgggcttcgggcttccgctgggcgacaagctccgcggcgcgacctccaaacagttcgacatcgcgggacaaattccgatgctctacgccgatcccgggttcgaaggcacccacaccttcgcctgcacgctgaccgacgccaagggcctctcgacctcggcggagctccgcctcgtggtcagcaagagttcggcaaagccgaccgttgcctggccggggcacgacctcacccagcggcacgagatcttcggcggtgaaacgatcgacatcgacatcacggccgaagcgggcatccaatcgctggtcgtggagatcatctccgaaaaactgactcccgaagagttgctgagcgtaggcatccccgccgtattcgacctctgcaacgttcccgccgccggaagcaacagcccggaggaagtcgccgccatcctgagcggattcgggttcccggtcaacgaagaggttgcgggcaaaaccgtcttgccgacgatctccatcacgccattcgttgcgctgatgcagcaggtcgcctccgactgtaacaacgacttcaaactcacaattacggacaaggcgggacaaacgaccatcgcgacccttcagctctacgttcatcccctgccctaa

SEQ ID NO: 1916 - DNA, 1971 bp, Unknown
  Artificiall/Consensus sequence
atggaacccgcttcggacaggatatacgacacgctgaaacgctactggggcttcacggagttccgtcccgtgcaggagcggatcatccgctccgtcatggaaggacgcgacacgctggcgctgatgcccacgggcggcggaaagtcgctcacctatcaggttccgaccctcgcccgcgaaggcgtgtgcatcgtcgtcacgccgctcatcgccctgatgaaagaccaggtcgatcgtctccgggcacggcgcatcccggccgtggcgatccattcgggcctctcgccccgggccatcgacatcgcgctggacaactgcgtctacggcgacgtgaaattcctctacgttgcgcccgaacgactggccaccgaggcgttccgcctgcgcgtcgtgcggatgaacgtctcgcttctggccgttgacgaagcccactgcatctcgcagtggggctacgacttccgcccctcgtacctgcgcatcgccgaactgcgcgaaaagctccccggagtccccgtgctggcgctcaccgcctcggccacgaaaccggtggccgaggacatcatgcgccacctcaaattcgccgaaccgcacatcctgcgcagcagtttcgctcgccccaacctttcgtacagcgtccgccgcaccgacgataagaacggccagctgctgcggctggtgcacaacgttcccggctcgggcatcgtctacatgcgcacccgcgagggcaccgagcagaccgccgaattcctgcggcaggagggcatcccggccgcggcctaccacggcggactggggcacgctgaacgggcgctgcggcaggaggagtggctctcgggcaaggtccgcgtgatggtcgccacgaacgctttcggcatgggcatcgacaaacccgacgtgcggttcgtggtccactacgccatgtgcgactcgctcgaaagctactaccaggaggcgggccgcgcgggccgcgacggacagcgggcctacgccctgctgctggtggcttcggacgacagcgaccgcatcgcgcggcgcttcgaacaggagttccccccgctcgaaaaggtcaaagacatctacgaatcggtctgctcctacctgcaagtgggcgtcggcgacggcggcgaagcgtcgttcctgttcaacatccacgacttctgcgcccgcgagcacctctactcggggacggtcctgagcgccctgaaactgttgcagcagaacggctacatgaccctcaccgacgcgcaggacaaccccgcacgggtgatgttctgcgtcagccgcgacgagttgtacaaactccgcgtgcagcgcgacgagctcgaccacttcatccgcaccctgctgcggctctacaacggggtcttcaccgagttccggcccatcgacgaaggcgagctggccacgtggagcggctacaccgtcgagcgggtcaaggagttgctgaaacggctgtggcagctgcgcgtcatccgctacatcccgtcgaaccgctcaccgatcctcttcctgaacgaggagcgccttccgcgcgccgacctctacatcgcccccgaaacctaccggctgcggcagcagctgatgcgcgaacggttcgaacagatggtcgcctacgccgacaacgacgacgaatgccgcagcgcggtgctggaacgctatttcggcgagggcgatcctgcgccctgcggggtctgcgacgtgtgcctcgcgcgcaagcgggccgccaaggccgccggacgcaaagccgccggggatgccgatcccgattccgccgccctgcgcgaaaagctcctgcaacgcctcgccgactcccccgccgacccgcggcagctggccgacggcatggcctgcacgcccgaacggctggccggagaactccggacgctgctcgacaagggagagatccgaacgatgccggacggcaggctcgcactttccggagatcccgacagcctcggccgggcaaattag

SEQ ID NO: 1917 - DNA, 2985 bp, Unknown
  Artificiall/Consensus sequence
atgaacaaaagcctggaacaatatatgcccgacgggagcaaggtcccctaccggttcatgaaataccgcatccacaaaatcctgctcgtgtgttgcagctacgacggctacatcctcgaagaggacgggcacatcgaatcgcagatcaaccaggagtacatcgacctcaacatgtcgaacccgccgtcgctgacgcgcgtcagctcgacggccgaggcactggaggcgctggaccgggacgattcgttcgatttcatcctcacgatgtacaacgtcggcgaacccgacgtgttcgcgttcgcccggatcgtcaaggagcgccaccccaacacccccgtcgcgctgctgacctccttttcgaaggacatctaccgccgcatcgaggagcaggaccgttcgggactggactacatcttctcgtggcacggcaacacggacctcatcatcggtatcatcaagctcgtcgaggacaagatgaacgccgacgaggacatcctcgaaggcggcgtacaggccatcctgctggtcgaggactccatccgcttctattcgacctatctgcccgagctctataaactgcttctgctgcaaaacaccgagtttctgaaagacgccttcaacgaacagcagcaggtgcttcgcaagcgagcgcgtcccaaaatcctgctggcccgctgctacgaagaggccgtggagctgtacgaacgctacaaaaagaacctgctgggcgtgatctccgacgtggggttcgtcctccgccgcaacgacccgcccgagagcgagaagctcgacgccggaatcgacctctgccgccgcatcaagcaggacaatccgctgatgcccgtgctgttgcagtcgtcgcaggtggccttcggcaagcaggccgcggagttgggcgcagggttcatcgccaagaactccaagacgctcctttcgcagctgagcgaatacatcgccaaggagttcgccttcggggacttcgttttcaaggaccccgacacgggcgccgagatcggccgcgccaaggacctcacgcagatgcagcagatgatcgccacgatccccgacaaggcgttcgaataccacacttcgcaaaaccacctctcgaaatggctctactcgcggggcctgttcccgctcgcggcgtcgatccgccagtacaacaagagccacttcgcgtcggtcgaggatcaccgcaacgcgctggtgaacctgatccgcgactaccgcaccctgctggggcagggcgtcgtggcgcgtttcgacgccgagacctactccgacgccgtggccttcgcccgcatcggcgaaggttcgctgggcggcaaggcccgcggactggctttcatgaactcgatgcttatgaagcaccgccagtacgacaagtacgagaacgtgcgcatcatgatcccgcggtcggtggtgatcgccacggagtacttcgacgacttcatccgccacaacggactgaaatacatcatctcgcaggatttctccgacgaggagatcctttcggagttcgtcagctcggcactcccgtcccggctgcgcgacgccctgaagagctacatccgcacggtccgcacgccgctggccatccgctcgtcgtcgaagctcgaagactcccactaccagcctttcgccggcatctactcgacctacatgatcccctacgtcgataacgaggatcagatgctccgcctgctgctcaaagccgtcaagagcgtctatgcgtcggtctatttcgcggcgtcgagggcctacatccagacctcgcagaacctcatctcggaggagaagatggccgtcatcatccaggaggtgtgcggcacggagcaggaggggctcttcttccccacctgctcgggcgtggcgcggtcgatcaactactaccccatcggcgacgaacagcccgcggacggcgtctgcaacgtggcgatggggctcggcaagctggtcgtggacggaggacgcacgctgcgcttctcgcccagctatccgcaaaaggtgctccagacctcgacccccgaactggcgctgcgcgacacgcagaacgaggtgctgaccctgagcctgcgccccgaggagttccgcacgtcgatcgacgacgcggtgaacctgcaccgcctgagcctcacggagatcagccggttccgcaattcgaaatacgtctgctcggtctgggaccgcgagaacgaacgcatctccgacagtcccttcgacaccgggcgcaaggtcatcaccttcaacaacatactcaaatacaacaccttcccgctggcgaagatcgtctcggacatcctccgcatgggcgccgaggagatgcgctgccccgtggaggtggaattcgccgtcaacatggacgttgccccgggacagcagcagatcttcaacctgctgcaaatccgcccgatcatcgacaaccaggacaaccgcgccatcgactgggaggcggaagagacctcccgggcgctgatctacggcgaacaggctctcggcatcggcatgatggcggacatcgccgacatcatctacgtcaagtccgaggctttcgactcgctcgcaaccgagaagatcgccgacgaactgctgacgttcaacaaccgcatgcgcgacgaggggcgctcgtatatcctcgtgggtcccggacgctggggctcctcggacccgttcctcggcgtgccggtcaagtggaaccacatctccgaggcgaaggtgatcgtcgagtgcggcatcgagaaattcgatgtcgagccctcgcagggcacgcacttcttccagaacgtcacctcgctgggcgtgggatacctgacgatcaatcccttccgcggcgacggcatcttccgcgaagaggagctcgacgcccggcaggcactcttcgagggaacctacctgcggcaggtgcgtttcgaaaagccgctgtgggtctgcgccgacgggcgttcgaacaagggcatgatccgtgaagcgacggccgaagattaa

SEQ ID NO: 1918 - DNA, 1419 bp, Unknown
  Artificiall/Consensus sequence
atgaaaaaactgcttcttctgcccctgatgctctccgcggcggcggccgtcggcgcatccggccccgattacgggacatccaaccgtccggaagcctcggagcggctcttcacttcgcaggccgtcgaacggcagatcgaacgcatccggcagacggtcacggttcccaagctggcatggatgttcgaaaactgcttccccaacacgctcgacaccaccgtccactaccgtcaggacgaggagggcgaagacgacacctttgtatatacgggcgacatccacgccatgtggctgcgcgattcgggggcgcaggtgtggccctatctcccgctggcgcgcgaggacgaagccctgcgccggctgatccggggcgtcgtccgccgccagctgaaatgcctgctgacggacccctatgccaacgccttcaacgacggccccaccggaaccggctggcaggacgactggacggagatgaagccggagctgcacgaacgcaaatgggagctggactccccgtgttacgtgatccgactggcccacggctactggaaagccacgggcgacgcctcggtgttcgacgcacggtggaccgaagccatgcgcctcgtgctgaaaaccctgcgcgaccagcagcgccgcgaagggccgggggcgtaccgattccagcgcgtgaccgaagatgcactggacacccagctcaaaaacggatacggacatccggccagacccgtcggactcatcgcctcgtcgttccggccgtcggacgacgccacgacctttccgtttctgattccgtccaacttcttcgccgtctcgtcgctgcgcaaggctgcggagatcctgcgcacggtaaaccgcgacgaaaccctggcatccgcctgcgaaacgctcgccgacgaggtcgaacaggccctgaaaaagcatgccgtctgcgaccatccgcagttcgggaagatctacgctttcgaaacagacggcttcggcaaccgcctgctgatggacgatgccaacgtccccagcctgctcgccatgacctatctgggagacatcgcgcaggacgaccccgtctaccggaacacccggcgtttcgtatggagcgaatcgaacccctatttcttccggggcacggcggccgaagggatcggcgggccgcatatcggcgccgacatgatctggcccatgagcctgatcatgcgggctctgaccagcgatgacgatgcggagatcaaacgatgcgtcgagacgctcgtaaacaccgacgggggaaccggattcatgcacgaatcctttcacaaggacgacccttcgaacttcacccgcccttggttcgcgtgggccaacacgcttttcggcgagttgattctccggctggccgacgagggcaaaaccgacctgctgaacagcatcgaagtgcgttga

SEQ ID NO: 1919 - DNA, 1131 bp, Unknown
  Artificiall/Consensus sequence
atgaaaaaatctcttattttgctgtgtgcggccctgactgccgcatgcgcgggcggtccgcaggacgggccgacgctctccggcctgaaccggagcgatttccaaagcgaggcggacggaaagaaaaccgacctcttcgtcctgaagaatgacaacggcatggaggtgtgcgtcaccaacttcggcggacgcatcgtgtcggtgatggttcccggccgcgacggcgtgatgcgcgatgtcgtgctcggattcgacaaggtcgccgactatcagacggttccgagcgatttcggggccacgatcggccgctatgcgaaccgcatcgcccaggggcggatcacgctggacggcaccgaataccagctgccgcagaacaactacggccattgcctgcacggaggcccccggggattccagtaccgggttttcgacgccgtgcagaagagcgaccgcgaactggagctgacctatgcgtcgaaggacggcgaagagggtttcccggggaatttcgagtgccgggtgaccatgacgctgaccgacgataacgccatcgacatccgctatgccgccgagacggacaagaccacggtcgtgaacatgaccaaccactcctatttcaacctcgacggggaccccgcgaaggacaattcggaatggctgctgacggtgaacgccgacagctatacgccggtcgattcgaccttcatgaccaccggcgagatcgccccggtggagggcactccgatggatttccggaccccgacgcctgtcggcgaacgcatcgaccgggatttcgagcagcttcgcaacggccacggcatcgaccacaactgggtgctgaacacccggggcgacatcgccgaggcgtgcgcttcgctggagtcgcccgccacgggcatccggctggatgtctacaccaccgaacccggcattcaggtctactgcggcaatttcctcgacggaagcgtcaaggggaagaagggggccgtttacggattccggtcggccgtctgcctggagactcagaaatatcccgatacgccgaacaagcccgaatggccttcggccgtattgcgtcccggggagaagtacgagagccgctgcatctataaattctcggtcggcgagtga

SEQ ID NO: 1920 - DNA, 1473 bp, Unknown
  Artificiall/Consensus sequence
atgactactttcttggtgtgccttgcactgctggttgccgcctattttacctacggacgctatctggaacggctcgtcgatattgatccggcggccgaaactccctgtaaacgactttatgacggtgtggattacgtgcccctgccgcgttggcgcattttcctgatccagctgttgaatatcgcaggcctcggcccgatcttcggtgcggtgctcggtgccgcctacggccccgtggcgtttctgtggatcaccttcggaggcatcttcatgggcgcggcgcacgatttcatcgccggggtcatctcgctccgccacgacggcgcgagcctgcccgaaaccgcaggccactatcttggcagcgggatgaaggtcgtcatgcgcctcttttccgcggggctgatgatcctcgtgggggccgtgttcctctcgcagcccgcgtcgctcattgccaaccggctcgacgttccggcgctcgaaggcattgcgttcgggaatttctcgtggctgttgctcatcatcctgggcgtcatcctcgtctattacatcgctgccacgctgctgcccgtggacaagatcatcggccgcatctaccccgttttcggcttcgcgctgctgttcatggccctcggtatcctcgtggtgttgcttttcggcggtgaatacaccattccggagttcacctctttcgaaaactgtatagccgatgcgaagaacttcccgatcgtaccgatgctcttcacgaccatcgcctgcggggccatctcgggattccatgccacgcagtcgccgctgatggcccgctgcatgcgcagcgaaagcgagagccgttcggtcttctacggcgccatgatctccgaatcgatcatcgccctcatctgggccgccatcgctatggctttctggggcaatgtcgagggattgaacaacgccatcgccgaatacggcgggcaggccgccgtgttggtcgatgtgatcgccaacaagacgctgggtccggtgctcgcggcgttcgtcatcctcggcgtcgtggcctgcgctatcacttcgggcgatacggctttccgttcggcgcggctgatcgtcgccgacttcatgggcgtcgagcagcgctcgctgcgcaagcgcatctatatctgcgttccgttgtttgcattggggctgctcatcatcttcgggctgccgttccagaccatgtggagctatttcgcgtggatgaatcagaccctcgcggccgtgacgctctggatgatcgtcgcctacctgcgccgtcgcgggcgcaccgtttggccggggctgattccggcgctcatcatgacttacgtctgcgccagctatatcttcgtttcgccgctgatgttcggcatgcagaaccgcacggcggcctatctgctgggcggtgcggtgacgttggcggtccttgtcgcaatgatcttcaaactccggaacaacgatgcagaaagcctctcttaa

SEQ ID NO: 1921 - DNA, 2046 bp, Unknown
  Artificiall/Consensus sequence
gcgcagctgcccgaactggatatgtcgaatcccctgctggccgcatgggatacgcctcacgagaccccgccgttctccgagatcaaactctcggactacgaaccggcgttcgacgccgcgatcgcctgctcgcgcgccgaggtggaggcgatcgtcaagaaccccaagaagccgaccttcggcaacacgatcgtggcgctggagcgtcagggcgagttgctcaaccgcatctcggggctcttcttcaacttgctcgaagccgattcgtcggacgagatgcaggagatcgcgcagcgcgtacagcccaagctgacggagctgtcgaacgacatttcgctcgatcccgaactgttcgaccgcgtgaaatacgtctacgagcatccgggacgcctcaagaaagaggacaagaaactgctggagaacacctacaagggcttcgcccgcagcggtgcggccctgtccgacgccgataaggagctctaccgccagtactcctccgaactgtcggcgctgacgctgcaattcgggcagaatgccctggccgcgaccaacgcctttacgctcaacatcaccgatccgaaggtggtggccgagctgccggcgttcgtaaaggaggggatggccgccgaggccaaggcccgcggcgaaaagggctggacggtgacgcttcaataccccagctaccttcccttcatgacctactcgtcgaaccgtgccctgaaagagaaactctggcgggccagcggctccaaggcgctgggcggcgaatacgacaacaccgggatcgtgaagaagatcgtcaacacgcgcctgaagatggccaatctgctgggttacaaatgctatgcggattacgtgctcgaaaaccgcatggccgagaacacgaagaccgtcaacgacttcctcgccgaactgctcgccgagaccaagagctatgccgacgccgactaccgcatggtcgccgactatgccgcgtcgctcggcttcgaaggcgaactgatgccctgggactgggcctattacaccgagaaatacaaggatgagaaatacgccctgaacgacgagctggtgaaaccctacctgaaactcgaaaacgtgaagaagggcgtcttcatgctggccaacaaactctacgggctgaatttcacgcccaatgaaaagatcgcggtctaccatcccgacgtgacggcctacgacgtgacggatgccgacggccgtttcatggcggtgctttacctcgatttcttcccccgtgcctcgaagcgttcgggggcgtggatgaccgaattccgcggcacgaagatcgaggacggcaaggaaacccgcccgctggtgtcgctggtgatgaacttcaccaagcccaccgagacgacgccttcgctgctgactttcgacgagatggagaccttcctccacgagttcgggcacgccctccacggcatgctgggcgagggtaaatacgagtcgctgaccggcacgagcgtctaccgcgatttcgtggagctgccttcgcagatcatggagaactgggccaccgagaaggagttcctcgacctgtgggccgtgcattacgagaccggcgagccgattcccgccgagattgtggaccgcatcgtcgctgcgcagaactacctggcggcctacgccaacgtgcgccagctctcgttcggcatgaccgacatggcctggcatacgctcaccgagccgttcgacggcgacgtggagcagttcgaggtggcttcgatggccccgacacaggtgatgcccgtcattgcgggaaccgctatggcgccctcgttcggccacatcttctcgggcggctacgcggcgggttactacggttacaagtgggccgaagtgctcgaggccgacgctttctcgctcttcaaggagaagggtattttcagccgcgaggtggcttcgtcgttccgcgacaacatcctttcgaaaggcggcacggaacacccgatgaagctctacgagcgtttccggggccacaaacccgaaaccaaggccctgatcgagaagatggggctcggcaaatag

SEQ ID NO: 1922 - DNA, 2262 bp, Unknown
  Artificiall/Consensus sequence
gtgcaaaccgaacaaatttttattccaatgccaaacaatgttctgataaagacccttgccggggtgtgcgcccttgcggcggtggcctgcggcggggggcagcagccccggagcgatgtcgccgtctacctcgacgaatcgcagccgattgaaaaacgtgtcgaggacgccctttcgcgcatgaccctcgaagagaaggtcgccatcctccacgcgcagtcgaaattctcgtcggcgggagtcccgcgcctgggcattcccgaggtgtggtgcaccgacggtcctcacggcatccgccccgaggtgctgtgggacgagtgggagcaggccggctggacgaacgactcctgcacggccttcccggccctgacgtgtctcgccgcgacgtggaatcccgaaatgtcggccctctacggcaaatccatcggcgaggaggcccgctaccgcgagaaagacatcctgctgggccccggcgtgaacatctaccgcacgccgctcaacggccgcaatttcgagtatatgggcgaggaccccttcctctctgcgcggatggtcgttccctatgtccgggaggtgcagaagaacggcgtcgccgcctgcgtgaagcacttcgcgctgaataatcaggaggtgcaccgccacggcatcgacgttgaggtcggcgaccgggcgctgtacgagatttaccttccggccttcaaggcggccgtcgaggagggcggtgcctgggcgatcatgggctcctacaataaatataagggccagcattgctgccacaaccagtatctgctgaacgacattctcaaacgcgactgggcgttcgacggggtggtcgtctccgactggggcggcgtccacgacacgaagcaggccgccgagaacggtctcgacatggagttcgggtcgtggaccgacggtctgagctggggcgccagcaacgcctatgacaactactatctggccgctccctatctcgacatgctgcgcaagggcgaggcttcgacggccacgctcgacgacaaggcccgccgggtgctgcggctgattttccgcacggcgatgaatacgcagaaaccgttcgggtcgctcaattctcccgaacatctggccgccgcacgccgcattgcgggcgagggcatggtgctgctgaagaacgacggcggggtgctgccgatcgacctcgggaagacgaagcggatcgccgtcgtgggtgagaatgcgatcaagatgatgaccgtcggcggcggctcctcgtcgctcaaggtgcggcacgaatatacgccgctggagggcatccgcgccgctgcgggcgacaaggccgaggtggtctacgagcgcggttatgtcggcgacgtgacgggcgactacaacggcgtgaagacggggcaggacctctcggagaagcgttccgaggagcagctcatcgccgacgccgtggctgcggcgcgcgaggccgacgccgtgatcttcgtcggcggactcaacaagagcgaccatcaggactgcgagggtgccgaccgtctgcaatacggcctgccctatgcgcaggacaaggtgatcgaggcgctggccggggccaatcccaacctggccgtcgtgatcgtttcgggcaacgccgtggcaatgccgtggatcgaccgcgttccggccgttctggaggcgtggttttcgggttcggaagccggcaacgcactggccgacgtggtgttcggtgccgtgaacccctcgggcaagctgcccttcaccttcccggtgcgtctggaggacaacagcgcgcatgcgttgggtgagtaccccggtacggacaaggttgcctacaacgaagggattttcgtgggctaccgctggcacgacaaggagcggataaagccgctgttcgccttcggccacggcctgagctacacgacgttcgacattgcgaatgtgacggcggaccgcacggcccttgcggcgaacggccgtatccaggtttcggccgacgtgaccaacacgggttcgcgtccgggcgccgaggtcgtgcagctgtatatcggcgacgagcagtcgtcgctgccgcgtccggtgaaggagctgaaaggatttcagaaagtttcgctgaatcccggccagacacagacggtgactttcgagatcacgcccgatatgcttcgatactatgacgatgcgaagggcgcgtgggttgccgagccgggtgcgttcacggcctgcgtgggcgccgcgtcggacgatattcgcggcacggtggagttcgaattgaaatga

SEQ ID NO: 1923 - DNA, 1308 bp, Unknown
  Artificiall/Consensus sequence
atgttcggatgggagtttccgccccacattgcgggcggactgggaacggcctgctacggaatgacccgcggactggcgcgcaacggcgtcaacgtcacgttcgtcgtcccgcacgcctacggcgacgaggaccagcgcttcacgcacgtgctgaacgccagcgacgtggaagccatgtacggttcgacgggaagcggtgcggacgacattctggaaaagatgtcgttcatccacatcgactcgaacatggttccctacatctcgccggaggagtacgaagtctatcacgaaaaatatgtcaagtcgggagagcggacctggtcaatgaccgacgcctggaaacagcgctacaccttttcgggcaagtacggcgccaacctcatggaggaggtcgcccgctatgccgtggtcgctgcgcaggtggccaaggatctggaagggcagttcgacgtgatccacgcccacgactggctcacctactatgcgggcatcgccgccaagcgcgtctccggaaaaccgctcgtggtgcacatgcacgccacggaatacgaccgttcgggcgagaacgtcaacacgcaggtctacgccatcgaacgcgccggcatgcacgccgccgaccgagtgatcgccgtatcgaacctcacgcgaaacatcgtcatcaaccgctacggagtcccggccgacaaggtcgtgacggtgcacaacgccgtgcgcttcgccgagaacagcggcaaggttcccgaacggggcgtcaaggacaagatcgtgaccttcctgggacgcatcacctatcagaagggacccgactatttcgtggaggccgccgccaaggtgctgaagcgcgtgcccgacgtgcgcttcgtgatggccggctcgggcgacatgatgaaccatgtcatccgccgcgtggcgcggctcggcatcgccgaccggttccacttcacgggattcctccgcggagaggatgtgcacaagatgttccagctgtcggacgtatatgtgatgccttcggtgtcggagcccttcggcatttcgcccctcgaagcgatgcggtcgaacgttccggtcatcatctcgaagcagagcggcgtggccgaggtgctggactacgccgtgaaagtcgattactgggacgtggacgcccttgcggacgccatctacggactgatcaaataccccgccctctcgggcatgttcgcctcgaaggggctcgaagaggtcaccaatctcaaatggaacgacgctgcggcaaagatcaagacggtttacgaggccgtgatcgaagagaatgagaaacaatcaaaatag

SEQ ID NO: 1924 - DNA, 1932 bp, Unknown
  Artificiall/Consensus sequence
atgaaaaagattttgagaatcgggttgtccgccgcggcgttgttcgtctgcggcgtggctgccgcccagccgcccgtgctgatccattcgcacaacgattatgcccggcgggtgcccttctatcaggcttacgcccagcaggtcgcctcgatcgaggccgacgtgttcctgcgggacggaaagctgctcgtgggacacgaggtcggggagctgtcgcccgacatgaccttcgaggcgctctacgtggagcctgtcgtgacgcttttcaaacggaacggcggacgcgcctggagggattcggaccggcatctgcaactgatggtcgaactcaagtccgagaccggtccgacgctgcgcgccgtcgccgaggtgctggggcgctggcccgaggtgttcgatcccgcggtgaatcccgacgccgtgcgcgtcaccgtgacgggacgggttcccgagcctgcggatttcggcgattacccggcttacatccgtttcgacggagcctgggacgcggagtacacgcccgggcagctggagcgcgtagccctgataagcgccgatttcaaacggttctcccaatggaacggcaagggctccatcatccccgccgagcgcgagaagctcgaacgggtcatcgacaaggcccatgcgtgggacaagcccgtgcgcttctggggagctcccgagggggtgaccgtctactacacgttctacgacatgggcatcgactacatcaacaccgaccgtccggagctctgtgccgagttcttcaacgatttcggcaacaagaatttccagatcggcgagcgccgcgcggcctcttcgaccgtgacgggcacgaagcgtctggacaaggcgacccgcgatttcaagggcttccagagcgataagttgcagctttcgaagggcatcgacgtttatacgccgacctaccgcaacgacgggggcaagggaaaggtgaagaacgtgatcttcctgatcggcgacggcatggggctgtcgcagatcgtggcggccatgttcgccaacaaaaatctgacgctgatggggctgaagaacatcggcttgcagcagaacaatgcgctggacgcctttacgaccgattcggccgccggaggcagcgccctggctacgggcgaggtgcatgcgaaccgccatatatcggcaggggtggacggaacggcctatccttcgctgagcgacttcttctacgaccgcggccgtgccgtcggcgtcgtgacgctgggcgacatcgccgacgccacgccgacggcatttttcggccattcggtcgagcgcgacaattcggacgagttgaccgcgtggctgctgaaaggacgcctggacctgctctgcggcagcggcatccgcaaattcacgcaccgcgacgacggcatcgacctggtgggcgagctctcgaaacagtacgatttcgtccgttcggtggacgagctcaacgccgcgaagggcaaggtgatctgcatcgacgaggagatggacgaagccgccgaagagaagaacctcaccctgctggccgacgccacgcgcggggccatcgagaagctgcgggagcgcagcggcaagggcttcttcctgatggtcgagggtgccaaaatcgactatgcgggccattcgcgctgtctgcccggctccgtcatcgagacgctgagcttcgatcttgcggtcgccgaggcgctgaaattcgccgattcgaacggcgagacgctcgtcgtcgtcacggcggaccacgagacgggcggcctgacgctgatcgacggcgacgaggccacggggcggatcatgggcgtttacgtctccgacgaccacacgccggtcatgcttcccgtcttcgcctacgggccgggttccgaccgtttccgcggcacctaccgcaatacggagattccgcgcagaatcaaatcgcttgtaaaatag

SEQ ID NO: 1925 - DNA, 1908 bp, Unknown
  Artificiall/Consensus sequence
atgacacgtctgaattgcatcgcatggctgctgctgagcatctgcgcggcggccgtcgctccggcatcggggcagacgaaggtgaagacctccgtcgaaaaggtcaccctcttcatcgacggggcgcaggtgacgcgcaccaagcagatcgacctgccggccggcaactcgacgctcgtattcacggggctctcgccctacctcgacgacaagagcatgcaggtcgccgccaaggggcgattcaccgtgacggccgtcaaccggctcttcaaccatacggacagtctcgaacgctcggcccggcaaaaggcgttggagcaggaactcggccgaatccggctcgaacagcagcagcagaaagccgcacgcgaggtgatcgacgcggaaaccgatctgctgaaggtcaactgttcggtgggcaaccgcaatgcggcgacgccgctggcggccatcaaggagctcaacgaatattacgcctcccggatgcaggagctcaaacgccggacgctcgaactggacgggcggacgaaagcgctgggcgaacgcgaacggcaggtgctcgccgacctggcccagctgggcggcagacaatcggcgccgatgagcgaggtggaggtgcggatcgaggctccggcggcctgcaagggagccttcacgctgacctactatgtccgcaacgccgggtggttcccctcctacgacatccgctcgggcggattgtcggagcccgtggagatctcctacaaggccaatattttccagaacacccgggaggagtggaagaacgtcgggctgacgctctcttcgtcgaaccccacgacgggaaacatcgccccgcagctgaaaacctggtggctcgactacggaacgacaccgccccgctacgactccgacctgacgggcaacaccgtgtcgggaacggtattcgacgaacagcgcgaaccgctcataggcgccagcgtcctcgttccgggcaccaccgtcgggacttcgaccgacgcgcagggacgttattcggtcaccgtgcccgacggagcttcgagcctgcaattcagctacatcggctacaagtcccaaacccgcgccatcgcgggcagcacgatgaacgtcgtgatgcaggaggataacgcacggttggacgaagtcgtcgtcacggcatacggaagcgcaccgtccgcggctctcagcggcaaggcggcaggagtgcgggtgcgcggcaaagcggccccggcgatggaagcggagttcatagagctcgccgaagagagcgaagcgatggaggtggagcagacccagactcagctgggctacgaattcgagatcagacagccctacaccatcccctccgacggcaagagcgtggcggccgagatcggacgctaccggctcccggcgacatacacctaccgatcgacgccgaagatcgacaaggacgccttcctcgtggcggaggccaccgactgggcgaaactcaacctgctggagggcgaagccaacgtctatttcgagaacacgttcgtgggcaagagcatcctcagcccccgggaggccggcgacacgctccgcttctcgatgggccgcgaccggggcatccgcatcgaacgcacgaaggagagcgactactcggcccgccgggccatcggatcgaaccagactcagagcatgggatggaaactcgccgtccgcaacacccgcacggagcccgtgacgctgatactcacggaccagctgcccgtgtcgcgcaacagctcgatcaccgtcgccgaagaggagctgagcagcggaacgccggacaaaaacaccggaacggtcacctggcggctggagctgaaacccggcgaacagcgcgaactgcggctgcgctatgcggtgaaataccccaagggccggagcctgacgatcgaatga

SEQ ID NO: 1926 - DNA, 741 bp, Unknown
  Artificiall/Consensus sequence
atgcttaaatgtatcgccatcgacgacgagccgctggctctgcgtcagctgacaagctatatctcgaagattccctatctagaactcgcggcaacgttcaacaacgccctcgaagcgcagcagatgctgaccggacagagcgtggacctgatcttcgtggacatcaacatgcccgacctgaacggtgtggacttcgtccgcgggctgatcgaacgcccgatgatcatcttcacgacggcctattcggagtacgccgtcgagggcttcaagctcgacgccgtggactacctgctcaaacccttcggattcgccgacttcaaccgttcggccgccaaggccaactcgctctacgaactgcgccacaaccagcgcacaccccaggagggcgaatcggaagcgctgcccaaggacaaggaatacatctccgtcaaggccgactacaaggtgtcgctggtgaaaatatcggacatcgtctacctcgaaagcgaaggcgaatacgtgcgcatgcacctcatcgacggctcgaccatcaccacgctgttccggctcaaaaacatggaagcggcgctgccctcggaactgttcatgcgcgtacaccgctcgtatatcgtcaacctgcgcatgatcaaagcctacgtcaaggggcgcatcttcctgagcgacacggaatacgtgccgatcggcgagaattacaaagaggctttccaggggtatatcgacaagaatttcaagaacctctga

SEQ ID NO: 1927 - DNA, 2091 bp, Unknown
  Artificiall/Consensus sequence
gtgaaacagatctggaacattttccgcgccgactggaagcgcctgaccgccagcgtagtggccgtggtggtcatgctgggactgtgcctggtgccctgcctgtatgcgtggttcaacatcctgtccaactgggacccctacggcaccgcctccaccagccgcatcaaggtggccgtggccagcgaggacgacggctgcgatgtgctgggccttcatgtcaacatcggcgagctggtgctccgtgggctggagagcaacgaccagatgggctgggtctttgtggatggtgcccagacggcgctggacggcgtgaacgccggcgactactacgccgcgctgatcctgccgccggaattcaccggcgacttcgtcagtattctggagggagacctgcgccacccccagatacagtattacgaaaacgagaaaaagaacgccatcgcgcccaagatcaccagcaaggccaagaccgccgtgcaggagcagatcaacaccaccattctggagaaggtggccgatgctctgaccaccgccggttccgtattcaaggccatgggtctggacggccgcgacattgccgacggcctgctggagaagctgtccgccgcccagcgggacatggatgagctggcgcaggtgctccgctcgctgcaggatgtgatggacggggctgacagcctgctggccgcctctgccatcaccatcaccgacgcacgcagtaccctgggggacgcctccgagaccgtgggcagcaccgtccgccttatcggctccggccttgacgcggcggatgacgcctccgccgacctgctgcgggtgctggacgccgccgacgataccctgtccgatctggaggacatgctgggcgcggtggacatgggccccgcggatgacgccgcgcacgagaaggtcaacgcccgcatcgacaagatgatcgccgcgctggagacggccagagacctgacctccaacgaggacgtgcaggcccagctggacgccgccatctccggtctggaggagctgcgcaccgccgtggacggctccggcatctctcaggtgcaggatgagctgctggccacggtggcaaaggtccgtcagaccctgcgtaccgccgccgtcagcaccaaccggcaggtcagcgactacatccacgatgccggtgagcgggcgcagtcctccctccgcgccgtgcaggacctgctgaccgcctcctccggtacgctgggcagcgtctccgacacgctgcgctcctattccggcgctgtggcctcagcgcagcccacgcttgccgccggcgctgcgctggcgcagagtgtctccggctatctggccgatatggaggcggacgtccgccgcgtggcggacagcaccgcctttcagcggttcgtggagctgatggagagcgactccgacagcatggcggagtatctggcctcccccgtgcagatgaacacgcagatcatctatgagatcagggactacggctccgccatggcgccgtattacgtgatgctggcgctgttcgtaggcagcctgctgaccgcggtgatggtgaaggtccctgtgacgcagccggagttccggcagtgccgcggcgtccagcgctacttcggacgctttctgacctatttctgtatggccatggctcaggcactggtgacggccttcggctgcctgcacttcgtgggcatggagacggcggagcccgctctgttcgtgctgggctgctgcgtgtgtgccctgaacttcgccgccatgaactatgcgctggtctactctctggacaacgtgggcctggccgcctccgtcatcatcatggtgctgcaggtggccggttccggcggctcctatcccatcgatgtgctgcctcagctgttccggcgtctgtatcccttcatgcccttccactacggcatggatatgctccgcgagaccatcggcggcatgtacggccgcacatacctccgctgcgtcctgatcctgctgggcatgtgtgtgctgttcacgctattcggcctgctggtgtactaccctgcccgcaagctgaacgcggccatcgccgccagcaaggaaaaatccggcattatgtga

SEQ ID NO: 1928 - DNA, 1386 bp, Unknown
  Artificiall/Consensus sequence
atggggagatatttcgggacagacggcttccgtggtgaggccaatgtggacctgacggcggaccacgcctatcaggtgggacgttttctgggctggtattacggtgagaccaagcgccgcagcggcgacaccacgccggtgcgggtggtcatcggcaaggacacccgccgcagcagctacatgtttgagtacgcgctggcctcgggattggtggcctccggcgcggatgcctatctgctgcatgtgaccaccacgccctccgtgtcctttgtggcgcggacggacgggttcgactgcggcatcatgatctccgccagccacaacccctactacgacaacggcatcaagctcatcagcggcagcggcgagaagatggacgagggcaccatcgccttcatcgaggactatctggacggcaagctggaggtgttcggccagcgctggcagcagatccctctggcccggcgggaccacatcggccgcacggtggactatgtggcgggccgcaaccgctacgtgggctacctcatctctctggggctgttctcctttaagggcaagcgcgtgggattggactgcgccaacggcagcgcctggaccattgccaagagcgtctttgatgcactgggtgccaagacctacgtcatgggcgatgagcccgacggcttcaacatcaacaacggcgtgggctccacccatatcgaagccctgcgccgctttgtgctggccaacgggctggatgtgggcttcgcctacgatggcgatgccgaccgctgccttgccgtggatgagcagggcggcatcatcaccggcgaccatatcctctacgtctgcgggcggcacctgaagcagcagggcgagctgccccgcaacacggtggtgaccaccatcatgtccaacttcggcctgtaccgcgcctttgaccgcgaggggatttcctacgccaagaccgccgtgggcgataagtacgtctacgagtacatggccaggaacggctgcgctctgggcggcgagcagtcgggccacattatcttctccaagtacgcctccaccggcgacggcgtgctcaccagcctgaagctgatggaggtgatgctggagcagaagaagcccctcagcaagctgaccgagggcctcaccatctatccccaggtgctggagaacgtccgtgtccaggacaaaaaggcggcgcgggaggaccccgatgtgcaggccgcggtggatgccgtggcggcggagctgggggacaccggccgcgtgctggtgcgggaatccggcacagagccggtgctgcgggtcatggtggaagcgccggaggacgctatctgccgccagtgcgtggaccgcgtggtggacgtgatccggcggaacggccactgcgtgtaa

SEQ ID NO: 1929 - DNA, 2103 bp, Unknown
  Artificiall/Consensus sequence
atgtgtgagaaaaagatcaatgttcccgccctgttcggcgaaatggtgttcggagaacagcagatgcagcagcgtctccccgccgatgtgtaccgtgcatggcagcaatcactggcacagggaacggcgttggatcgttccgtagccggcgagatcgccggcgcgatgaaggactgggccattgaaaagggcgccacccactacacccactggtttcagcccatgaccggcttcaccgccgagaagcacgacagtttcatcacccgcgacggcaaggatggcgtgcggatggaactgagcgccaaggagctgaacaagggtgaggccgatgcctccagcttcccctccggcggcctgcgggccacctttgaggcccgaggctacacggcctgggaccccacttcctacgccttcgtgaaggacgacaccctgtacatccccaccatcttctgctcgtacagcggccagacgctggataagaagacccccctgctgcgctccatgcgggagctggaccgcgcatgcgtccgcatcctgcggctgtttggcaacacagaggtccagcatgtcacggcccaggtgggccccgagcaggagtattttctcatcgacaagagcgcctacgagcgccgcgaggacctgaagctgtgcggtcggacgctgttcggcgccaagcctcccaagggtcaggagctggacgaccactattacggcgccatcaagccccgcgtggccgcgttcatgcgggagctggatcaggagctgtggaagctgggtgtactggccaagacggagcacaacgaggtggctcccgcccagcatgagctggctcccatctatgctgatgccaacactgcctgcgacaagaaccagttgaccatggagatgctgaagaaggtggccgcccgccacggactggtgtgcctgctccacgaaaagcccttcgccggtgtcaacggctccggtaagcatgacaactggtcccttcagaccgacaccggtgagaacctgctgaagcccggcggtacccccagccagaacgcccagtttctgctgatcctggcggcttttatcaagggtgtggacgagtatcaggagatgctgcgctgctgcgtgtcatatcccggcaacgaccaccgtctgggcggcaacgaggcccctcctgccatcatctccatttttctgggtgatgagctgacggccattctggactctatcgttcagggcacggagtacgtggatatcaccaagaagaagctgcgcgttggcatcgatgccatgcccgacattccccaggacaccacggaccgcaaccgcacctctcctctggcctttaccggcaacaagttcgaattccgtatgctgggctcctcccagtccatcgccagccccaatgtggtgctgaacaccatcatgaccgaggaattgagccagttcgccgaccggctggagaaggccgagaacttccagtccgccctgcaggagctgctgcaggagacgtttaccgcccaccagcgcatcatcttcaacggcaacggctacgatgacgcctgggtggctgaggctgcccgccgcggccttgctaacctccgcgacaccgtggactgcatgcccgcctacatcgacaagaagaacgtggagctgttcacgaagcacgccgtcctgacggagacggagatgcgcgcccgctatgagatccatctggagaactactgcaaggtgtctgccatcgaggccaacaccctgctggatatggcgcagcgcagcatccttcctgtggcggcacggtactccggcgacctggccaagggcatggcacacaagcaggaggcgggcctggcctccacctgccgtctggaggagcatctgatccgtcggatcagtggactcagtgaccagctgctggatgtctgccaggagctctctcaggcactggagaaggctcccgccgccgacagcggcatcgaggccgcccactacttccgcggggagatcaacacccgcgtccggcaggccggcgacctcatcagtcagctggaatccctggtggacgccaagatgtggccttatcctacctatgccgacatcctgtttggggtgtaa

SEQ ID NO: 1930 - DNA, 1767 bp, Unknown
  Artificiall/Consensus sequence
atgagtatctttgatgtgctgacgatgatcggcggcctgtgcctgttcctgttcggcatggatctgatgggccagtcgctggagcgccgcgccggcggcaagctgcggacgctgctggaccggatgacgggccgcgtattcacgggttttctgacaggtcttgccatcacggcggtgatccagagctcatcggccaccacggtgatggtggtgggcttcgtcaactccggcctgatgaccctgcggcaggccataaatgtcatcatgggagcaaacgtgggcaccacggtgacggcgtggctgctgagtttagccggtattgatgggggaaatgtgtgggtaaatctgctgaaacccacctcttttacgccgatcctggccctgatcggtattttcttctacatgaacggcaaagatccgaaaaaacgggataccggcgccatcctgctgggcttcgctaccctgatgttcggcatggacaccatgagcggtgcggtggcgggcctgcgcgatgtgcccgccttttcacagctgtttctgctgttcaaaaatccgctgcttggcgtgctggccggcgccgtgctgaccggcatcatccagtccagctccgcctccgtgggtatcctgcaggccctggccgtcaccggtcaggtcagctatgccgccgccatccccatcatcatggggcagaacatcggcacctgcgtcaccgcacttttatcctccgtaggcaccagtaaaaacgcaaaacgagcggctgtggtacaccttttgttcaatgtcatcggcgtggcggtgctgctgacagggttctgcgtcgtcaaggccatattcgatcccggcatcctccacgacagtgccaccatgtacggcattgctatcgcccactcctgcttcaacgtcatctgcacggccatactgctgccctgcggtgggctgctggaaaaattagccatccgcatcgtgccggacggcccacaggagcaggcggaaaagccggtggagctggaccagcgcctgctggccacgccgccgctggcgctccagcgctgccgcgccgtggcggaggagatggcggcctgtgccgccggtgcgctggatgccgcactggacagctttgaccactatacgccggaactggcggagcgcatccgccgcgatgagcagcgctgtgaccactacgaggatgtactgggtacctacctggtgaagctcagcacgcagcagatgggcgcggaggagagcgaggaggccacggagatgctgaagaccatcggtgatttggagcgcatttccgaccacgcggtgaacgtgctggaatccgcagaggagctgcgggataaggggctgacgttcagcggcgcagcaaaggaggagctggcagtgctgtccggcgccgtgcaggatatcctgtccagcgccgtgcaggcgttccgcagcaacgatgtgtccgccgccgctcaggtggagccgctggagcaggtcatcgacgcactgaaggaacagatgcggacgcggcacatcctgcggatgcagcagggcggctgcagcatcgaggcgggcttcgtctggtgcgacctgctgacggatctggagcgtacctccgatcactgctccaacatcgccggctgcgttatcgacgcggcccagcacgacctgaacctccacgagacgctgcacaacgtgcgccacagcgatggcgactaccgccgccggttcaacgcctacgcggaaaaatacgccctgcccgcgccggagaaggcgtga

SEQ ID NO: 1931 - DNA, 1314 bp, Unknown
  Artificiall/Consensus sequence
atggaatggaaaaaggagatccctatggaaaactatgagcatggtctgctgtttgaccccgccctgtctgcggagatcaaggagcgcttctgctatgtggatgccgaccccgagttcggcaagcgtctgttctttgagaactccggcggctccctgcgcctgaaggcgtctgtggaggagcaggccaagtaccaggccttccccgattgcccggaacgcgtacacgcccgctccaaggagctcaagcgtatccagttgcggggcatcgatgatgtgatgcacgtggtgttcggcgcctccggcggcgcgctgctgacagagatgaccgcctcccagtgcatgttccagatggtgggcgccattctggagaactgcccgggtaccaacgccgtcacctccgtgctggagcatccctccgccttcgacgccgtgaagtactactgcgaaaagaccggcaaggagttccgcgtggctcaggccaatcccaagaccggcggcatcgaccccgaggagatccgccgcgtggtggacaaggacacctgcctgctgagcgtcatgtacgcctccaacatcaccggtaccatcatggacatggagggcatcgtccgcgccgcccgtgagatcaaccccgacatctacatcgtcaccgatgcggtgcagcacgcgccccacgcccccatggacgtggacaagctgggcttcgacggcgtgaactttgcgccctacaagttcttcggcacccgcggcatgggctacggctacgtgtccgaccgtgtggccaagctgccccaccgcaaggtgctgcagcgtcccgaggagatctgggagctgggttctcccacccccggcaacttcgcggccatgagcgccgtggtggactatgtttgctggctgggcggccacttcaccaaggagaccgatcgccgcaagctgtttctggtgggcatggagcacatccatctgcaggagcgggctctgctgtacaccatgctggagggcacggacaaggccgccggcctgcgccacatcccgggcgtccacgtctatgtggacaccgaggatctgacgcaccgtgacctgatcgtggccatgggtatcgacggcgtggatatgaccaagtgtgtggaggagtatcagaagcgcggcgtcaccgtgttcgagcgcgtgaacagcagcgtgtactccaagcgcatcgtggagggtgtgggcctcaccggcgccatccgtgtttccccgatgcactgccacacggtggaggatattgaggagtatctgcgcgtcaccaaggagctggcggaggagttcgccaagtaa

SEQ ID NO: 1932 - DNA, 1641 bp, Unknown
  Artificiall/Consensus sequence
atgaagcagaccgatctgattctgaaaaacggcatgatatacaccatggcccgggagggcgacgtggtggaggcattggccgtgcgtgacggtaagattgtatacacgggcaccacggaggaggtgctggctgcctgcgaagcgccgcaggtggtggatctggcgggcaagaccatgctcccgggcatgggtgattcccacctccacttctttgcctactgtcagacccacaccaccgtggacctgggcggctgtaccagcaaggcagaggccatcggcaagctggctgcccgggcagcggagacccccaagggccagtggatcaaaggctccaacttcgacgagtccaagtgggacgccgacaacgaccacctgcccaccaaagcggatctggacctggtgagtccggaccaccccgtgatgatgaagcgcgtgtgtctgcataccgccgtggccaacaccgcggcgctggccgccgccggtatcggcaagggctatgaatttggccccggcggtctggtggagctggacgcggacggtatgcccaacggcatcctgcgggagcaggccaccaagatcttcgacgagctgatccccgaccccgccaagatccccgaggtcaaggagaagatcatgcgcgaggcgctggcggaggcctctagtcagggtctcaccaccgtccacacctacgccgcggacatctggaagtacactgaggatcccgaggactacctgcttctggaccgcaaggggcagctgcccctgcgtgtggtgatctatctggataccctctatcagaagccctacctgacccgcagggagatggacgacccctatcgcaaggtgtgctacggcggccacaagatcttctccgatggctcgctgggctcccgctccgccaagctgctggtaccgtacagcgatgcgcccgataccgatggcatcctggtccagagccagcaggagctgaacgagcacatgctcaaagcctatgagatgggactccagcctgccacccactgcatcggcgacaagggtctggactgcgtgctcaccgccatcgagtacacactggagaagagccgtgagcacggcatgacagcccgggagcaggcggaccgtgacccgttccgcattatccacgcccagatggccaccgacgacatgatccgccgcatgcagaagctgccggtggtgctggatctgcagccggtttttctggagacggatatgcactgggctgtggagcgcatcggccctgagcgggcggcgtacagctaccgctgggagacgtaccgcaaggccggactgatcctcaccggcggctccgactgccccgtggagcccttctctccatggctgaacatctacaccgccgtggcccgcaaggacttccaccactgccccgagggcggctaccagccggaggaaaagatgagcgtctacgacgctgtatgcatgttcaccaagaacctgcattacgccgccggacaggacgcggtgctgggcacgctggagcccggcaagttcgctgacatggtggtcatcgaccgcgacattttcaagatccccgccgacgagatcatggatatccaggtggaaaagacgtatctggccggccgcgaagtatacagcaaataa

SEQ ID NO: 1933 - DNA, 1434 bp, Unknown
  Artificiall/Consensus sequence
atggataacgcaaaaaaggcggcactggctgccattgatgaaaagaacgagctgatcgcggaggtggcagattccatctgggactacgcggagctgtccatgcaggaggtaaagtccgccgccctgttcgtcaaggtcctgaaggaggagggctttcaggtggaggagggcatctgcggcatccccaccgccttctccgcgtcctacggcagcggcaagccggtcatcggctttctggcggagtatgacgccctgtcgggcctgtcccaggcggcgggcagcaccgagtaccacgagctggtgaagggagggagcggtcacggctgcggccacaatctgctgggcgccggcgccatggccgccgccatcggcctgaagcactacctggccgggaccggtaaaagcggcaccgtcattctgtacggctgccccggcgaggagggcgtggcctccaaggcctacatggcccgtgatggcttgtggtacaatctggatgcggccctgacctggcacgccggcgactgcaatgaggtggccaccggctccaccaactcctgcattcagatgctgtataccttccacggtctggcctctcaggcgtctaccgccccggagcgggggcgcagcgctctggacgccgtggagctgatgaacgtaggcgtgcagttcctgcgggagcacatgccccgggatgcccggatacactactccattctggacgccggcggcgccagccccaatgtggtgcagcatcaggccagtgtcctgtatatgatccggtccaacttcgtgaaggactgcatcaccctgcaccagcgggtggacaagatcgcccagggcgcggcgctgatgacggacaccaccatcgagcggcggttcgtggacggcctgtccgacaccgtgtgcaaccacgcgctggaaaaggtgctgtacgacaacttcgcggagctgggcgtaccggcgtgtacgccggaggagcacgccttcatggagaagctgtccgccacctacgccggcagcgacatccccagcggcgtaggcgcggagaacgatcccgccttcgccgagaaggtgcaggctctgcggaccggccacttcaacgactttctggtgccgctgtaccagggtcccgccttcaacgccggctccaccgacgtgggcgacgtcagctaccagtgccccacggcccagatccatatggcggtgtggcccaaccacgtgccctgccacagctggcaggtggtgtcctgcaacaagacgccgctggcccatcgggccaccgtccatgcaggcaaggtgctgtgcgccgcggccattgacctcatccagcagccggagctgctggagcaggccaaggcggagttccggaagcgcactgccggaggctacacctgccccatccctgccgacgccgtaccggcgccgctggactga

SEQ ID NO: 1934 - DNA, 1314 bp, Unknown
  Artificiall/Consensus sequence
atgcagaaaaaaaacagtctcgtccgagacatcatcgtggttggcttcgcgctgttttccatgtttttcggcgcgggcaacgtgatcttcccgccctttctgggcctggagtccggttcccagtgggtgtcgggcttcgctgcctatttcattgccgacattggcctggccatgctggccatgttcgccctgctgcgggtcggcagcagcgaggctgtggtcagccgcgtgggccagatacccgcagcggtactgatgtccgccattatcctgtgcgtgggtcccatggtggccatcccccgcacctccgccactacctatgagatggccatcgtgcccaacctgtccggcgtgagccccgtggtgttttccattctgttcttcgcgctgatcctggcgctgtgcatcagggaatccgccgtggtagacatcgtgggcaagatcctgacgccgctgctgctgctgggcctgtttgccatcatcatcaagggcgtcatcactccgctgggtgagccctccgccctgccccagatcgccaacgtggccgtcaccggcatcaaggccggctatcagaccatggatgcgctggccgccctgcccttcggcatcatcgtgctgcagagcgtcaccgccaagggctacgacagcggcagaaaacagttccgcgtggtgggcggctctgccgtgctggcaggtatcctgctgctggccgtgtacatggggctggcctatctgggcgccaccgtgtccgcccagtataccaacgatatcggccgcgcccagctgatcatggtcatcattgaggccctgatgggcaaggtgggcatggtgctgttcggcgtggtggtgggtctggcctgcgtcaccaccgccgtggccctgaccagctccgccgccgcctatttcaccgagctgtgccgcggcaaggtgagctacaaggtgttcgtcatcgccatctgcgtgttcagcgccgtggtgtccaatctgggtctggaccgcatcgtggccgtggccgcgccggtgctggatgtcatctatccccccacgctggtgctgatcttcatctccctgctggcgccccatctgccggaccgcatcagccgcggcgccgccatcggcgccctgctgaccagcgtactgtgtacccttaccgccaacggcgtggccatccccctggtggagagcctgctcctgtacgatctgggcctgagctggctgatccccgccgccgtgttcggtctggccgcctccctgctgcggggccatgcccgcaaagcggagaaggtcttttccaagcccaacgaagagctttga

SEQ ID NO: 1935 - DNA, 1173 bp, Unknown
  Artificiall/Consensus sequence
atgctggtgctgcgcacctggcatatcttaattgatgagactcatgtacgatcttggcattgtgcatgcagttttttgtgcatggacagcgcgccatgcgctttttttgtgcccgtggcaagtgaattcaggaggaaaagtatgggaagtattctgatatatgtactgttcgcggtgggcatcgtgctcatcgtgaagggcggcgactggttcgtggacggcgccgtgtgggccgcggagatcacccgcatccccaaatttatcatcggcgctaccatcatcagtgtggccaccaccctgccggagatcttcgtgtccaccatcgccgccgtggagggacacggcattctggtgtctcaggtgagcgactacatcgcggcgtcacaggacaaggtgggcatggccatcggcaacggcatcggctccgtcatctgcaacaccgccatgatcctggccatcagcatcatcttcatgcccatcgccgtggacaaaaggagcttcgcgcccaagggcatcctgctcatcgcggcggtgtgcgcgctgttcctgctctcccgcagcggcagcttctccattgcgggggcggcggtgctgctgttcatcttcctgctgtatatcacggagaacatccgctccgccaagcgggacgccggtgcggaggagaccgaggaggcccctgccagcgacaggaaatccattgtgctgaacattctgcgcatcgtgggcggcgcggcctgcatcgtagtgggctctcagctgctggtgagcaacggcagtctcattgccgcgtcctggggcgtgtccgaggccatcatcggcgtcaccatcgtggccatcggcacctccctgccggagctggtgacggctgtcacatccctcatcaagaagcagtcgtccatgtcagtgggcaacgtcatcggcgccaacgtcatcgacaccaccctcattctggcggtctgttccttcgtgtacggcggcaagctgccggtatccgcccagaacatctatctggacttccccgtggccatcgtggtaacgctgatcgccatcatccccaccatcgtctgccggaggttccagcggtggcagggcgtgctgatgctggcggtgtacgtcgcctatctggtggtcgtgaccacggggctggactggtatctggctctggtggcataa

SEQ ID NO: 1936 - DNA, 1947 bp, Unknown
  Artificiall/Consensus sequence
atgcgtgtgatactggcgaaatccgccggcttctgctacggcgtggagcgcgccgtgaagctggcggagcagacggcccgggacaagggcggctgcgtcatgctgggcagcatcatccacaacgcccacgtggtgcaggggctggccgcattgggtgcgcggcaggtggacgaccccgcgcaggtgcaggcgggggatacggtgatcatccgttcccacggcgagaaaaagcaggtttaccagcagctggaggccgccggcgcgtctatcgtggacgccacatgtcccaatgtccggcgcatccagcgtttggtggcgcaggcggaggagcagggccgcacgcccctcatcatcggcgagcagcaccatccggaggtgatcggcgcggccagctgggcggagaattccgtcattttagacgggccggaggccctggaaaactggctgtcgcagcggccggagcggcgtgagcggcccctgatggcagcggcccagaccacctgcattcgggttctctgggaaaactgcgtaaaaattttaaaaaaacagtgtacaaacgtagaaatctttgatacaatatgtgatgctacgcataagcgtcaatcggaagcggcagacattgccgccaaggtggacgtgatggtcgtggtcggagatcgtaagagtgccaacaccaaacatttaacggagatttgcagcgagaggtgccccgtggtctgtcagatcgagcgggcggaagaactcaagggtgactttcttaacggatgttctgtggcggggcttacagccggcgcgtccacgcctgcgggcatcattaaggaggtatatacaagaatgagcgacgagatcaagaacgtggaagctaccgaagagagcttcgaggaaatgctggaaaaatcttttaagactttgaatacaggagagaaggtaaccggtatcgtgactgccatcggtcccaccgaggtgcaggttgacctgggctgcaagcaggcaggttatatcaacatcgacgagctgtccgccgatcccagcgtgaagcctgaggatgtggtgaaggtcggcgacgagatcgagacctatatcatccgcgtcaacgacgtggagggctatgccatgctgtccaagaagcgtctggacgctgtcaaggtctgggaggacatcgagaaggcccgtgaggagaagactaccctggagggcaaggtcaccgaggagaacaagggcggcatcgtggtcaatgtcaagggcgtgcgcgtgttcgtgcccgcttcccagtccggcctgccccgcggcgctgagctcagcgctctgatcggccagaccgtctccctgcgcatcaccgaggtcaaccgtgcccgccgccgcgtggtgggctccatcaaggccgtgacctacgaggcccgtcaggctgcccaggccgagatctgggagaacattgaggtgggcaagcactacaccggcactgtcaagtctatgacctcctatggtgtgttcgtggatatcggcggcgtggatggtatggtacatatctccgagctgtcctggtcccgcatcaagaaccccgccgaggtggtttccgtgggcgacaccctggatgtatatgtcatctccttcgatcccgagaagcgcaagatctctctgggcgtgaaggatcgtacctgcaacccgtgggacaagttcatgtccacctacaaggtcggcgatgtggccaaggtccgcatcgtcaagctgatgaccttcggcgcctttgccgaggtagttcccggcgtggacggcctgatccacatctcccagatcgcggatcgccgcatcgagaagcccggcgacgtgctggctgagggcgacatcgtggacgccaagatcacggcgatcgacgaggagaagcagaagatctctctgtctatccgcgctctgctgacccccgccgctgacgagggtgacgacgagtaa

SEQ ID NO: 1937 - DNA, 1371 bp, Unknown
  Artificiall/Consensus sequence
atgcagaatgaaaacaagctgggcgttatgcccatttccaagctgatctggaacatgtccctgcccatcatcgcgtccatgctggtgcaggcgctttataacatcgtggacagcgtattcgtcagccgcgtcagcgaacaggcgctgaccgccgtatccctggccttccccgcccagaacctgatgatcggtcttgccaccggtaccgccgtgggcgtcaacgccctgatgggccgggctctgggcgcacagatgcgggaacgggccgaccgcgtggccaacaacggcgtctttctggccgtggtgggcttcctcatctccgccgtactgggcctgacctgcgcggatctgttcttccgctcccagacccaggtggagaacatcatccagatgggcagcgaatacctgcgcatcgtcaccatcggctcgctgggcatgttctgccagatcatgtacgagcggctgcttcagggcacaggccgctccctgctgagtatgtacactcagggtctgggcgctatcgtcaacatcgtgctggaccccgtgttcatcttcgtgctggacatgggcgtggcaggcgccgccgtggctaccatcatcggccagttctgcggctgtgcgctggccatatacttcaaccataagaagaacaccgacatcacactgtccatcaagggcttccgccccgactggtccctgatcggcgagatctacgccatcggcctgcccagcgtcatcatggtgggcatcggctcggtgatgaccttcctgatgaacaagatcctcatcacctaccactccgcccatgagacggcggccaccgccttcggcgtgtacttcaagctgaactccttcatctttatgccggtctttggcatgaacaacggcatcatccctatcgtggcgtataactacggcgcccagaaccgccgccgcatgatggagaccatcaagcgcggcacactgtacgcctcctgcatcatggtggcgggcaccatcctgtttcaggccatccccggccctctgctgagcatcttcgacgccaccgacaccatgatggccgtgggcatccccgccctgcgcatcatctccctgagcttctgcatggccggtgcgtgcatcgcgctgggcagctcgttccaggcactgggcaagtcactgtactccatggtcacgtccatcgtgcggcagctggtgtttctggtgcccatcgcctacgtgctggcccgctacggcgcgtccgtgggcaacgacgatctggtgtggtggtgctaccccatcgccgagatcgcgtccctgctgctgacactgtgcttcttccggcatgtgtacaagaccatgatcgcccagatccccgaggggcgggcgtaa

SEQ ID NO: 1938 - DNA, 852 bp, Unknown
  Artificiall/Consensus sequence
atgaaaaagatgatcgccatgctgctggcgctggtcatggccatgagcctgatggcctgcggcaagcagaacgacagcaataccaacgacaacaacgacgccaataccggcgacgaccagcctgcggccaagaccaccctggtggtgggcgtctccgccgactatgcccccttcgagttcatgtatcccgacgagaacggcaacatggtctacggcggcatcgacatctccgtggcccagtacgtggccgacgagctgggtctgaccctgcaggtggagaacatgagcttcaacaacctgctgacctctctggacaagggcgacttcgacatggtcctgtccgccatggaggccactcccgaccgtctggagaacgccgacttctccaccggctattacagcgataccccccccgccattctggtgaaggccgacaaggctgaccagtacaagacgctggccgacttcaacggcaaggccatgggcgcgcaggccgccaccaccaagctggacatggtcaacgacatcgagggcgtcaacgccgtctctctggaatccgtgctggatctggtgaacgagctggtgtatgacaaggtggacgccattctggtggacggcggcgtggcccagcagtacgctgacgccaaccccgacctggtcatctgcagcgcctcctccgagctgcccaccgccgagccttactgcattgccgtggccaagggcgaccccaagggcctgctggacggcatcaacgccgcgctggccaagatggcctctgagaacaagatcgagaccttcatcgccgatgctgacgctctggccagtgtggccgtggaagtctctgccgattaa

SEQ ID NO: 1939 - DNA, 1398 bp, Unknown
  Artificiall/Consensus sequence
atgcagtgggatattctgcgccctcacgggtgcatttccgcgcgtacacagaaaacacatcgcaggaaaggagagcttcctttgaaatcactgtcagatctgtgggacagtatcctcgcccgtctcagcggcgagctgtccgacatgactatcaagacctggttcgacgagatcaccgtggtgaccatggaggattcggcgctggtgctgcactgcagcaatccgttcaagaagaacacggtggaggcccggttcctcccccacatcaaggcggcgctgaaggacatcttctccaccgatctggaggtaaagatcctcagcgacgagcagctggcggcctatcacggcgtggcgccggaccggccgggaaacctgtttgattccgacgccttcacctttgagacctacgtggtgggcccccagaacaagctggcctacgccgcggccaaggcggtggcggaaaagccggcggagggcttcaaccccctgttcatttacggcgagtcgggactgggcaagacccacctgctctacgccattgcgcacctgatgcgcagccgccgtccagagtcccgcatcgtctatatcaagggcgatgactttaccaacgagctggtcagctccatccgggagaaccgcaacgccgagttccgcgagaagtaccggcaggccgacatcctgctggtggacgatatccagttcatcgccggcaagatccagacccaggaggaattcttccatacgttcaacacgctgtatgaatccggcaagcagatcgtgctgacctccgaccggccgccgcgggaaatgacacagctcagcgaccgcctgatgtcccgcttcgagtccggcctgatggtggacgtagccccgccggactttgagacacgtctggccatcatccacaacaaggcggcgctgctgggtgtgaagctgcccgacgaggtaatggactacatcgcggagaacgtcaccaccaacgtccggcagctggagggcaccctcaataaaatactggcctaccgcgatctgctgggagaccaggtggacgaggaatccgtgggccgcgccgtccgcgatatgctcaagcgcagcaacgagtacgttccttctcccaaggtcatcatcagctatatctgcagctactacaacatcgacgaggagacactgcggggacagagccgcagccgcgacgtggtggcagcccgtcagctggccatgtatctcatccggcggatgcacgccacgccgctggacggcatcggcaaggagttcggcaaccgcgaccactccaccatcctccactccctggacaaggtggaaaagcagatgcagaccgatcccaagttcgccgagcgggtcaaggagatcaccaccaacatcagcagcaagcgataa

SEQ ID NO: 1940 - DNA, 2553 bp, Unknown
  Artificiall/Consensus sequence
atgctttggcaatatattatacactgccgcggcagattttacaaggaggagtttcgggaaaccgccggaaggctcctctctccgcttttggcacatttttttcgattgcaggcggcaaaacccgctccggcaggagaacagggcttgacagagcgccatgccatcctgtacagtaaagggatgaactattcccgaaaagaggaacacttacatatgacgctgagagaattagaggcaggtaaaagcgccgtgattcgccgggtgggcggtgagggtgcgctgcggcagcactttctggatatgggcatgatccccggtgcagaggtaacggtggtaaagctggcccccatgggagaccccatggaggtgcaggtccatggctacgagctgacgctgcgtctggcggaggccgatcagatcgacatcgagccgatccggcagcgcagccgcagccatgtcggtgtggatcgcgcccgggaccccgaccatcccggtcttggtgagagcggcaagtaccacagcaaggaggacgagcatccgctgccggaggacaccgtcctgacctacgcgctggtgggcaatcagaactgcggcaagaccacactgttcaaccagctcaccggagcgagacagcacgtgggcaacttccccggcgtcacggtggaccgcaaaacgggtgtgatccgcggctatcccaacacggaggtcactgacctgccgggcatctactccatgtccccgttcagcagcgaggagatcgtgtcgcggaacttcgtgctgcaggacaagcccaaagccatcatcaacatcgtggacgccaccaacatcgagcgaaacctgtatctgaccatgcagctgctggaaatgggcattcccatggtggtggcgctgaacatgatggatgaactggtgggcaatcagggttccatcgacgtcaacgccatggaggccatgctgggtgttccggtcgtccctatctccgccgccaaggacgagggtgtggatgagctggtgcagcacgctgtccatgtggcaaaatatcaggagccgccgctgaagcaggacttctgcggcaaggatgaccacggcggcgcggtacaccgctgcatccacgcggtggtacatctcatcgaggatcacgccgtgcaggccggtctgccggtacgctttgccgccaccaaggccatcgagggcgacagccttattctggcgcagctggcgctggatgaaaacgagcgggaaatgctggagcacatcgtgctgcagatggaggcggagcgcggtctggatcgcagcgccgccatcgcagacatgcggttcgattttattgaacgcctctgcgagcagacggtcatcaagccccacgagagccgggagcgcgtgcgcagtgagaagatcgaccgcatcctgaccggccgctataccgcgatcccctgctttatcggcatcatgctgctgatgttctatctgaccttcaatgtcatcggggcgtggctccagtccctgctggcagccgggatcgacaagctgtccgccctgacagacagtgccctgacagggctggacgtgaaccccgccgtccacagtctggtcattgacggcattttcaccggcgtgggcagcgtgctgagcttcctgcccatcatcgtgacgctgttcttcttcctgtccctgatggaggacagcggctacatcgccagagtggcctttgtcatggacaagccgctgcggaagatcggcctgtccggcaagagcatcgttcccatgcttatcggcttcggctgcaccgtccccgcagtgatggccacccgcactctgaccagcgagcgggaccggaaaatgaccattctgctgacgccgttcatgagctgcacggccaagctgcccatctactcgttctttgtcagcgtgttctttcccggccggggcggccttatcatggcgggactgtacctgctggggatcctggtggggatcctggcggcactgctctataggggcacgctgttcagcggcgagcccattcccttcgtgatggagctgccaaactaccggctgcccagcgctaagaacgtggcgcagctgctgtgggaaaaggccaaggactttttgcagcgggccttctccgtcattctcatcgccacggtggtggtgtggttcctccagagctttgacctgcgcctgaacatggtgtccgactctgcggacagcatgctggccatggccgccggcgtacttgctccgttgttcgcgccgcttgggctgggcgactggcgcatctgcaccgccctcatcagcggcttcatggccaaggagagcgtggcgtctacgctggaggtactattcggaaacagcatcggcagcattctttctccgctggctgcggcgacgctgctggtgttcagcctgctgtacaccccttgtatcgcggcggtgacctccgtccggcgtgagctgggcggcaaatgggcggtcgggctggccgtatggcagtgtctcatcgcgtgggtggtggctttcgtggcccacggtatcgggagtgtgctgctatga

SEQ ID NO: 1941 - DNA, 1905 bp, Unknown
  Artificiall/Consensus sequence
atgatcgacattcgcgtagaggggctggtgaagtccttcgacctggaaaagaaaatactggacggcctgacgtttcaggtggacaccggcgagcgggtgggcctgctgggccgcaatggcgcaggcaagaccacgctgttcaaaatacttaccggcgagctggactacgacagcggcacggtgcagatcgcgtcgggccgccgcgtggggctgatctcccagatccccgtctatcccgagggctacacggtggaggatgtgctgcgcaccgcctttgcccgcatgtttcgcatgaaggacgagatggacgccctgaccctcgccatggagcagggcgcctccgacgacgccaccctccggcgttacggcgaactgaatgctcgcttcgagggactgggcggctgggataccgacaccgcagtgaacaaggtggccaacggcctgagcatctccgatgagatgcgcacccgcctcttcgaccgcctgtccggcggcgaaaagacccgtgtgaacctgggccgcctgattctggaggacacggacgttctgctgctggacgagcccaccaaccatctggacctgcaggccacggagtggctggaggactacctccgcaacttccgcggcaccgtggtcaccatcagccacgaccgttactttctggaccgcactgtcacccgcatcatcgagatacaggacggcaaggccgagttttacagcgggaattacagcttttacgccattgagaaggagcgccgctatcaggagcgcatgaagcagtacctgaaggagcaggccaagatccagcagctggaaaaggcggcggagcagatgcacctctgggcttttatgggcaacgatgctctgcacaaacgggccttctccatggaaaagcgcattgagcgtatgcgcaccacccgaaagcccaccaaggcccgccgactggaggcccgcttccagagccgggagttcaagggcgacgaggtcctgcagatcaagggcatctccaagtcctttggggagcgtagactctttgaggatgtgtacctccgcgtggagggaggggaacgcattgccctgctgggcgagaacggcaccggcaagaccaccctgctgaacatgatcgtggggctggacgggcccgacaccggtatgatccggctgggtccctccgtcaaggccgcctacctgccgcaggtcatccacttcgaccatccggagcgcagcattctggacaccatgctctacgagctggacatcacgccccagtcggcccgcaaccgtctggcagcgtatcagtttaccggcgaggatgtgttcaagcccgtctctgtgctgtccggcggcgagctcagccgtctgcggctgtgcatgctgatggacgagagcatcaacctcctgatcctggacgagccaaccaaccatctggacatcgactcccgcgagtggctggagcaggcagtggaggactttgacggcacgctgctgttcgtcagccacgaccgctatttcatcaatcgcttcgctacccgtgtctgggagctggaggaccgcgccgtcaccgactaccctatgggcttcatgcagtaccgccaggtgcgggaggaggcccgccgcgccgcgccgcccgccgccgtaccggcccagccgaagaagcccgcccctgtcggcaggggcagccgcagtcggcaggcggcccgtaagcagctgaccatctgcgagacggccatctcccgtctggaggcgtccgctgctgcgttggaccgcgacatggaagccgccgcctgcgacgcggagaagctgggcgagctgtaccggcagcgtcaggaggtggaatcccagctggagcaggagatgacccgctgggaggagctgagcctgcaactggaggaacaggagaactga

SEQ ID NO: 1942 - DNA, 1968 bp, Unknown
  Artificiall/Consensus sequence
atggactaccgacaggaaatgaaggagctgcgggacaccctgaatgcccacggctaccgctattacgtattggatgagcccaccatctccgactacgagtacgaccacatgctgcgccgtctggaggatctggaggcggcacatccggaggaaatcacaccggattcgcccacgcagcgcatcggtggccgcacgctgtccgagttccagcaggtgacgcatcccgtgccgctggagagtttgcaggacgtgttcaacgacgatgaggtgtgccagtttctggaaaagataccactggacgcgccgctgtggagcgtggagccaaaggtggacggcctgtccgtggccctggagtacagagacggcgtgttcgtccgcggcgccacacgcggcgatggacgggtgggggaggacgtgacggagaatctgcgcaccatccgctccattcctatgacgctgccggagaagctgccccgtctcatcgtccgcggcgaggtctacatggctcgcagcgtgttcgatgagatcaacgcccgccgcgagctggagggcaagcccctgatggccaacccccgcaacgctgccgccggctccctgcgccagctggaccccaagatcgcggcccagcgccgtctggacatcgccgtattcaatctccagctggcggagggacgggagtttaccacccacaccgaggccatcgactatctggcgtcccagcatttcaaggtcattccgcaccggcagctatccaaaaccgccgatattctggcggagatcgccgcgctgggcgactgtcgggagcgtttccccttcgacatcgacggcgcggtcattaagctggacaacctggcggagcgggaggtgcttggcagtactgccaagtgtccccgctgggccatcgcctacaagtacccgccagagaccaaggagacggtgctccgcgatatcgtggtgcaggtaggacgcactggcgtgctgactcccaaggcggagctggagccggtgcgtctggcgggcaccactgtgacctacgccaccctgcataatcaggactatatcgcccagaaggacatccgcatcggcgacacggtgctggtgcgcaaggcgggggagatcatccccgagatcgtggccgtggtgccggacaagcgtccggacggcgcacagccctacacgctgccggaccgctgccccgtctgcggcgcggaggtggtgcgggacgaggatggcgcggctctgcgctgcaccggcgcggagtgccctgcccagctgctgcggaatctgacccatttcgccagccgaaacgccatggacatcgacggtctgggtcccgccgtgatacagcagctggtggacagcggccttgtcaggactgccgccgacctgtacagcctgcggccggagcagatcgcggagctggaccgtatgggtcagaagtccgcccggaacgcggtggaggccatcgccagaagccgtgaggacgacctgtggcgcctcatctttgctctcggcatccggcaggtaggtgagaaggccgccaaggtgctggctgcacggttcggcagcatggacgcgctggccaccgccacggaggaggagctgaccgccattgatgacgtggggcccatcacggcgaaatacatccgccagtggatggacagcccacagtcccaggacctgctggcacgtctgaaggccgcaggactcaatatgacctgtaaagaggtaatggttgacagccgttttgctggaatgacttttgtccttaccggcgcactggagaagtttacccgcgatgaagcgggggagatgatcgagaagcggggcggcaaggtgtccggctccgtttccaaaaagaccacctacgtggtggcgggagagaacgccggcagcaagctgcaaaaggcgcagcagttgggcatccccgtcctcacggaagatgaatttctggagtttctgaaataa

SEQ ID NO: 1943 - DNA, 2010 bp, Unknown
  Artificiall/Consensus sequence
atgccgtttggcggcatctatcatcggacgggcagcacggctgtccgcaagggggaaatcaatgtgaaggagaaaaagaaccttcacaggagaatggagcggtgggaattcgtctcactgggcttgctcctgtacgacgcgctggcggtgaatgccgcctactttctggcgctgtggctgcgctatgacatgcggtacagcgccatcccgccggagtatctggccgcgttcctgcggttcgcgccggtgtacaccgccgtgtgtctggcggtgttcttcctgctgcggctgtataacagcctgtggcggttcgccagcttcaacgagctggcccgcagtctgggagccacggctatcacctgcgtgttccactgggtgggcatgaacgcctttgtgtgccggatgccggtggcctactacgtcatcggcgcgctgggacagttcctgatggtgacggccatccggttcgcctacgggttcatccggctgctgtccgccagccggcggaaaaacgccagggcagtacacaacgccatgatcatcggggcgggcgccgcgggacaggcggtgctgcgggagctgaaaaccagcgaggcggcggacgccgtgccccgctgcatcatcgacgacgatcccaacaagtggggccgcaccatcgacggcgtgccggtggtaggcggccgcgaggtcattgcggagatggcggagcgctacggcgtggaccagatcctcatcgccatccccaccctgtccatgcaggagcggggcaggctgctgacgctgtgcagcgagacggggtgccagctcaagacgctgccggcgctgtaccagctggccaacggcgaggtgtccttgaacaagctgcggccggtggcggtggaggacctgctggggcggccgcccatctccgtggagatgggggagatcttcgcccagatccagggcaagaccatcctggtgacaggcggcggcggcagcatcggcagcgagctgtgccgtcagatcgcggcccatgaccccaagcggcttatgatcttcgacatctacgagaacaacgcctacgccattcagcaggagctgcggcggaagtatccggcgctggagctgacggtgctcatcggctccgtgcgggacagcaggcgtattcaggcggtgtttcaggagtacaggccggaggtggtgttccacgcggcggcacacaagcacgtgccgctgatggagggcagccccaacgaggccatcaaaaataatgtgctgggcacgtataagacggcgttcgcggccctgaagtacggggcgcggcggtttgtgctcatcagcacggacaaggcggtgaaccccaccaacatcatgggcgccagcaagcggctgtgcgagatggtggtgcaggccatggatcgggtcagctgcaccggcgagtacggcctgctgccggagctggggcggggcgaggaatcccacagcgacatgcagggaggcacacggttcgtagcggtgcggttcggcaacgtgctgggcagcaacggctcggtggtgccgctgttcaagcgtcagatcgagaccggcgggccggtgacggtgacgcatcccgacatcatccggtactttatgaccattcccgaggcggtgagcctggtactgcaggcgggggtctatgccaagggcggcgagatcttcgtgctggacatgggcgagccggtgaagatcgacacgctggcgcggaaccttatccgcctgtcgggcctgcggccggacgaggacatccgcatcgaatacatcggcctgcggccgggggagaagctgtacgaggagaagctgatggcggaggagggactggagaaaacggccaacgacctcatccacatcggaaagccggtgccgttccggtacgagacgtttttcgacgggctcacggcgctgaaggaggcggcggaggccaactgcggcgacatcgaggagcgggtggcggccatagtcagcacttatcacccccagcgggaaagcgaataa

SEQ ID NO: 1944 - DNA, 1404 bp, Unknown
  Artificiall/Consensus sequence
ttggcctctgccaccaccaaagacatgacccatggcgtgccctggcggctcatcgccggattcgccattcccgttttcctgagccagctgtttcagcagctgtacaacaccgccgactctctgatcgtcagcaacttcctgggcgacaacgcgctggccgccgtcagcgcctccggccccctgatcttcctgcttatcagcttcttcgccggcgccgccagcggcgtgggcgtggccatcgcccgctatttcggcgcaggggactatgacaaggtgtcccgaaccgtccacaccgccgtgctgctgggcctcatcagcagcctgatcctcaccgtcatcggcgtactgttcacccctacgctgctgctgtggatggacacggatcccgaggtgctgcccgatgccatcggctacttccggtgctacttcgccggtgtgggcgcgggtgtgatgtacaacacctttaccggtatcatgaacgctctgggcgacagcaagcggcccctgtacttcctgatcgtctcgtccgtgaccaatgtgatcctggacctgctgttcgtggcggtgctgcggtggggcgtgtggtccgcggcgctggccaccatcatctcccaggcgctcagcgccgtgctgtgcgtcatccatctggccaagaagggcaccatctatcagctgaagctgtcggccctgcggttggacggcccgctgctgcgggagattttgcgctacggcctgcccgccggtatccagaactccgtgatcggccttgccaacgtggtggtgcagaccaacatcaactccttcggcaagatggccacggcggcctacggcgcgtattccaagatcgagggcttcgcgttcctgcccgtcaccagcttcaccatggccatcaccacctatgtgggccagaatctgggcgcgggcatgaagccccgtgccagaaagggcgccatcttcggcatcgcggcggcggctatcatcgccgagctcatcggtatcgccacctatctggcggcaccgtggctggtgcagctgttctcccgtaccccggaggtcattgagctgggcgtgctggagacacggatcatctgcctgttctactgcctgctggcattctcccacgccatcgccagcgtgtgccgcggcgcgggcaaggcctttgtgcccatgtccatcatgctgggcgtgtggtgcgtgttccgcattctctacatcaccgtgatgatgcagtggcggcacgagatcgtctacgtctactgggcctatcccatcacatgggccatcagctcggtgatctacctgttctacttcctgctttccaactggcaggacggattcgatccccagccggagggggagggccacaagcaccatcaccacttccatctgggacatcataagtga

SEQ ID NO: 1945 - DNA, 1839 bp, Unknown
  Artificiall/Consensus sequence
atgtttcctgtttttgatccgcgggacgccgcctgcaagtcccccttcggcgcggtagcctgcggcgctgaggtgtcctttaccctgcgggacggtgactactacgcctgtgagctgctggtacaccgcgaattcgcgggggtggacgaggtatgccccctcccccctgccgagggcggcttctccggcatatacactgctccgcaagagccggatctgtgctggtacgcctttcggttcacccgcgcggacggcagcaccgtgtgctacggccgcagcggctggtgcgggcaagacgcgctggtgcggtggcagctgacggtgtatgaggacacgcccactcccgcatggttcggacaaggcgtgacgtatcagatctttccggaccggttccggcgcacctctgtgccggatgtcggcggtatggtgggccggcggtgggtccatgacaactggagcgaccagcctgtgttcctgccggatgagcagggacagatcaccaaccgcgatttcttcggcggatcgctggcgggcatcacggaaaagctggactatctcaagagcctgtcggtgtccaccatctatctcaaccccatatttgaagcggacagcaaccaccgctacaacacggcagattaccacgccattgatcccatgctgggctctgaggaggacttccgcacgttgtgccgcgaggctcacgcacgagacatccgcattattctggacggtgtgttcaaccacaccggctccaacagccggtacttcaacgcggagggattctatcccgagccgggggcggcccagagcacggaatctccgtatttcagctggtacagcttccacccgtggcccacggactacgatgcctggtggggcgtacacaccctgccggcggtgaatgaggaacagccggactaccggcggttcatcatttcggacaaggattccgtggtgcggcactggctccgcgtcggggccgacggctggcggttggacgtggccgacgagctgccggatgactttatcgccgccatccgtgacgccatccaagcggagaagcccaacggctatctgctgggtgaggtgtgggaggacggcagcaacaagatcgcctactcccgacgcaggcgctatcttctgggtcgggagacccacgggctgatgaactatcccttccggacggcgctgttggcgtggctgggcggcggtgacgccgctgccttccgcgacgacatggagaccatacgggaaaactatccccccgcggcgttttacggggccatgaactttctggggacccacgacacgccccgtatcctgaccctgctgggtgtggaacggacgccggaggacaaggggcagcgggcggcataccgtctctcccccgccgagctggcgcggggacagaagaagctgcgtctggcggctatgctcctgtacagcttcccaggctcccccaccctgtactatggcgatgaggcgggaatgcaggggttcgaggacccgctgaaccgcgacacctatccctggggcggtgaggatggatcgctgctggccttcttccggcggctgggacagctgcgggcggaacggatatccatgcagtgcggcatcatccgctatctccacgctcagggcggcggactggtggtagagcggctccacgggacggagcgcaccgtgacggcattgaacgccggtgatacgccgctggagctgacgctgccgtgggacggacggctgtgcatcgacgccgtgacgggtcagcagttcctatcgcagaacggcacggtacgcttgacgctgcctccgctggatggcgtgatactggtgtga

SEQ ID NO: 1946 - DNA, 1116 bp, Unknown
  Artificiall/Consensus sequence
atgaatggaaaaagatggatggcgctgctgctggcactggtgatgtcgttctcactgtttgcctgcggtgcaaagcctgcggagaataccggtgacaacagccagaataccgccgcagatggcaccacgcgggtattcacggactcctgcggccgcgaggtcacagtacctgtgactgtggaaaaaattgctgtttccggcccactggcccagatcgtggttttcgccatggcaccggataagctggtgggtatcgccaatgcgtgggacgaaagcgctgcggagtttttggataagaaatactacaatctgccgattttgggccagctttatggtggaaaaggtgagctgaatcttgagacgctgctggccgctgcgccggacgtggtcatcgatgttggcgagcccaagggcagtattgcggaggatatggatgacctgcaggagcagaccggcattccctttgtccacatcgatgcctacctttcctctatggatgatacatacgccatgctgggagacctcctggcaatgcccaacgaggcgcaggggcgggcggactactgccgcttcgcctatgaccgcattgtatccattgccgacagcgtcgataaagtaaatctcctttacatcactggagatgagggacttaacgtcatcgcacagggctccttccatgccgaagtcatcgacctgctcagcaacaatctggctgtagtggacgagccctccagcaagggaaccggcaacgaggtggacatggaacagatcctcaactggaaccccgatgtgatcctgtttgccccgggcagcatctacgacaccgtggccggcaatgagaactggcagaccatctccgccatccagagcggcaaatactatgaggtccccatgggcccctataactggatgggattcccgcccagcgtccagcgcctgctgggtatgacgtggatggccaaggtcctgtatcccgaggcggcggattatgatctctataccgaggtcagcacctatttcgagctgttctaccactgtgacctgacccaggcacagtacgatgcgctggtggccaactctatccccgcagcatctgcggcgaatcaggcggcctga

SEQ ID NO: 1947 - DNA, 1281 bp, Unknown
  Artificiall/Consensus sequence
atgatgaagaagaattataaagagctgacaaagcctgagcggcaggcggaatacgcggctgtcaaggcggaattcgagggggcgaaggcccttcatctggaattgaacatggcgcggggcaagcccagccgccagcagctggacatggtgacgcccatgctgcaggtgctgacccagccggagcagtttgtatccgacggggtggagacccgcaactacggcgagggggcgggtattcccgcggcgcggaagctgttcgccgacatcctgggctgcaagccggagcaggtgttcgtgggcggcaatgccagcctgcagctgatgtacgatgccatctccaaggcgttcacccacggcctgctccacagcgagaagccctgggccaagctggatacggtgaagtggatctgccccgtccccggctacgaccggcactttaaggtgacgggcagcttcggtgtggagatgatcaacgtgcccatgaccgaccagggtcccgacatggacatggtggaggagcttatcaaggatcccgccgtgaagggtatgtggaacgtgcccaagtactccaatcccgagggcgtggtgtactctgatgagaccatccgccgtctggcggccatgaaacccgccgcaccggactttatgctgatgtgggacaacgcctactgcatccacgagttcgactgtgattttgtaccgttctccgatatcatcggcctgtgcgcccagtacggcaacgccgacatggtgtatgagttcgcgtccaccagcaaggtgacgttccccggcgcgggcgtggcggtgatggcggccagcgaggccaacatccagtatttctccaagctcatcaacatccagaccatcggctatgacaaggtgaaccagctgcggcacgtgctgtacctgcaggatcgggagcacacgctggcgctgatgaagcggcacgcggcggtgctggcgcccaagttccacgcggtgctgaacgcgctggacagtgagatcgcgccccgtggcatcgcggactacaagcggccggtgggcggctactttatcagcgtggacaccatgcacgggtgcgccaagcgcacgctggagctgtgcagggaggcgggtatcaccatgaccggtgcgggggccacgttcccctacggcaaggaccccaacgacagcaacatccgcattgcgccgtccctgccgccggtggcggagctggagcaggccatcgcggtgttctgcatctgcctgcgcctggcggcgctggaaaagctgggcgtgtaa

SEQ ID NO: 1948 - DNA, 1485 bp, Unknown
  Artificiall/Consensus sequence
atgagcatggatatgacctatttcgacgagatggaggcccgcatcccccgcggcaaggtccgcacccgtttcgccccctcgcccaccggctatatgcacgtgggcaacctgcgcacggcgctgtatacctggctcatcgcccgcagccacggcggcacgtttatcctccgtattgaggacacggaccagggccgtctggtggagggcgcggtggatgtcatctaccgcaccatggccgagtgcggcctggaccatgacgagggccccgatgtaggcggcccggtggcaccctacatccagtcccagcggcgggacacctacggcaggtatgcccaattgctggcggaaaaaggcggcgcatactactgcttctgcgaaaagtgcgcctccgaggaggacagcggcgagtttgaccgcgccgccgatccctgccgcgatctgccgctggaggacgccctgcgccgcgtggaggccggtgagccctacgtcatccggcagaagatcccccagacgggcaccaccacgttccacgatgccatcttcggagacatcaccgtggagaacagcacgctggacgatcaggtgctgctgaagcgggacggcctgcctacctacaatttcgccaacgtcatcgacgaccatctgatgggcatcacccatgtggtgcggggcagcgagtatctctcctccgcccccaagtacgacctgctgtaccatgccttcggctgggacgtgcccacctatgtccactgctctcccgtgatgcgggacgcccagaataagatgtccaagcgccatggcgatccatcctatgaggatctgaaggcggagggctatctcaccgaggccatcctgaactatgtggccctgctgggatggtcccccaagggcgagctggcagaacaggagatctttaccctgccggagttggtgaatgccttcgacatcaccggcatctccaagtcccctgccatctttgaccgtgccaagctggatcacttcaacgccgtgtatctgcggagcatggcccccgaggcgtttgccaaggtggcggagccctacatccgccagacggtgaagggtaacttcgatgtggccgccatcgcgggactgcttcaggcccgctgcgagaagctgacggagatccccgagaaggtggatttcttcgacacctgccccgactacggcgtagagttcttcaccaataagaaatccaaaacgaaccccgaggtctgcaagactatgctggaggccgccattcccatgctggaggcgctgcctcagtggacggacgagaccatccacgacgggctggtagcactggcggagacactgggtgtcaagaacgccacgctgatgtggccggtgcgcatcgccgccgccggcaagctggtgaccccgggcggcgctgtggagatctgccgcatcctgggccgcgacgagacgctgcgccgtctccgcgccggtctggagaagctggcatga

SEQ ID NO: 1949 - DNA, 1128 bp, Unknown
  Artificiall/Consensus sequence
gtggataagaaagcctatcgggaccggctgcgcagccaggataagcgggagcgcaccgcggccagtctgggtctgccctactccggacgggatctggccatcgccttcgggctgtatttggcggcggtgctgctgtgcctgttcctgcggaacatcgacctgcaccgggacaccagctacgtggcggtgatcttcctgctggacgtgttcctgacggcctactggaccaacggttatatcctgggtatcatcaccgccgtggccggtgtgttcagcgtggactacatattcacgtatccctactggcacatcagcttcacgctgaccggatttccgctgacgtttctggtgatgatgaccatctccgtgctgacggcggctgtcaccagccgcgccaagcagacggagaccgtccgccgcgaggcggaacgggagaagatgtacgccgacctgctgcgggcggtgtcccacgacatccgcaccccgctgaccggcatcgtgggagctaccaacgttttgctggagcaggacggcgagctgacgcaggagcagcggcagcagctgctgcgctccaccaacgaggacgcccagtggctcatccgcatcgtggagaacctgctgtccatcacgcgcattcacaattccgaggaggcgcgggtcaagaaggcgccggaggcggcggaggaggtcatcggcagcgccgtggccaagacgcagaagcactaccctgacgtggaggtacatgtgtcggtgccccatgagctgatgatggtgcccatggacccgctgctcatcgagcaggtgctggtgaacctgatggaaaacgccgtgatccacggcggcaccagccgtatcgatgtgacgctgtcccagcaggggggcgatgcggtgttcaccgtggccgacaacggcaggggcatcccgctgcaccttctgaataagttgttcgacggagcggcccgcagtgaccgcagcagcgacggcaaacgcagcatgggcatcggcctgtccgtgtgccggacggtggtgctggcccacggcgggacgatacggggggagaataaaaaagacggcggcgcgtgctttaccgtgacgctgcccatgaaaggagacgacgatgaagattaa

SEQ ID NO: 1950 - DNA, 2637 bp, Unknown
  Artificiall/Consensus sequence
gtgaacaacaccaaacgaacccgcctccagtggcgaatcggctctatcatcttcgccggcatcctgctgttcctcctgaccctggacctgtccggccggaacggcctcagccgcactcaggccctgacggacaacacgctggacaccctgcgccggcagtgcatcagcttccacaagctggaatcggcggacggcaccaagagcctgttccgtctggccgacagcgtacaggagctcagccgccatctggagctggaccccaccctggcctccaacgcttatctggaggacttcgtggacgagatacggctcagcggcatcgccctcctcaacgcggacctgcagctggaggcctccggctacacccgtcagtacgcgggcatgccctggccggacggcgcatcctccgcccggctggagagtctcattggctccgccaagatctacacccagcgtgtggagaaggacggcgtctcctatgatatctgcgccgtggcgcggcgggacgttcccggcgtggtcatcggcttctaccagcagcccaacggccttctcgccgacacggaggtcgacatggccaccctgctcaccggcctgcatctggaccgcaagggcgcctacctcatcacccgtgacggcgcggtgctggcctccggcaacgccggcatcgacgatgacagcgccgtgctggactgcctgaaccgtctggagtacggcggcgccctgcaaccgttccgctgcggcggacatctgtattacggcgcccgctccgcctgcgaggattacggcctgtacatctatttccccgccttgtccgtcttttcctccaccctcaccgccgccgcagtgttcatcgctctgtacggcggcttctgggtactgctgttcggcctcaagaccctggagctgtccgacagccagcgggagctgcgccgcagcaacagccagctgcaaaagacggtgaacatgctccattctctggagaacatctacttcaccattttctatgtggatctggagctgaaccgcttcgacaccgtgttcctggccccatggctggacggcttcctgccggaggatctcagctactccaagctgaaggaccgcttcacccatctgctggtgctggagcagtaccgcgatgagctcgaccgtcagatgagcagtgccgccatccgtgaaacactccgccgggacaacctctccgatgtgcaccgcagcttctacatcgactatcaggcctaccgcggcgatgccgtcaactggtgccgcgtcaccgtgacggcggtggacttcgatgaggagggtacccccctccacgttctggtggtgctccaggacatcaaccgcgaaaagacaaaggaggctgagtatcaggcccagatcatggaggaggcccagtccgcccgtctggccaacatggccaagagcgagttcctccgccgcatcagccacgacatccgtacccccgtcaacggcattcagggctacctggccatggccgctcaggctcccgatgatatggagcttcaggccagatgccgccagcgggccggcaccgctctgaacaccctgctggatctggtaaacaacgttctggatatgagcaagctggaaagcggccagctccagctggagcataagtccttcgctctggcggacattctgaatgaggtccgcgtcaccaacgagccctacgccgccgagcacggcatcgcctacaccgtggagtgcctgtgggacaccgataacgcgccccgtctcatcggcagtccctcccacctccgccagatcctgatgaatctggtgagcaacgccatcaagtatggccgcagcggcggctgcatccggctcaccggccgcgcgctccccgccgacggcgacagcgccgtctaccagttcacctgcgccgataacggcatcggcatgagcgaggagttccagcagcacatcttcgagcccttcatgcaggagtccgacgatgcccgcacccgctatcagggcacggggctgggcctgtccatcgtgaagcgtctggtggaggccatgggcggccagatcaccttcaccagccggaagggcgtgggcaccaccttctgcgtcaccctgccctttgagatcgaccgccactacgcccccgaccccgatgaggaggagacgaagggttcctcctggctggagggcatccacgtcctgctggcggaggacaacgagctgaacatggagatcgccgagttcctgctgctggaccgcggtgcctccgtcacccgcgcctggaacggcaaggaggcgctggacgccttcgccgatgcgccggagggtgcctttgacgtgatactcatggacatcatgatgccggtgatgaacggtctggacaccgtgcgggccatccgcgcgctggaccgtcccgacgctgcggagatccccatcatcgccatgtccgccaacgccttctccgatgatatccagcagagtctggacgccggcttcaacgcccatgtcgccaagccggtagacgcgtccctgctggcgcagacgttacgaaaatttctctcccccccccccgtgtccgtaagaagaaagcatccatcccccacgcgcagactccctgagacggagccgccatcggaagcgtaa

SEQ ID NO: 1951 - DNA, 1680 bp, Unknown
  Artificiall/Consensus sequence
atggaagaaaacatcgtgtcctctgtgaaaacgacagaagcagccgacggcgcacggccggaacagattgcgccggagaagccgccggtctccggcggcagaaaggcgggcttgatcgtcggcatcgtcgtgggcgtgctggcactggcctacatagccgcctgcgcggtggtgcagttcctgtataacgacaccgcgctgccccacacggatgtgctgggggtggacgtgtcgggacaggctgcccagcagatcgaagcgctgtgggagcagcagggcgagcgggtcctccatgacaccgccgtgaccctgacggagagcggtgagagcatcggcgccgtcacgctggaggagctgggcgtcaccgtgacgccccaggcggcggctgtggccgccggtgcgtcccggcggtacgaaagctggggcggcggggcgctggcatggctccgcggcgggtatgagctgatccgcagctggtttgtccagacctccgccgtaccggcgctggacgtggatcagtcggcgctggatgccgcctgcgagaagttggcggcatcgctgaactgcacggtggtggacggcggctaccgtctggaaaagggcgagggcctgtatatcaccaagcccgctgatggccgcatgctggacgcgccgcagctggagagcgaccttgccgccatgctgcaaagcggggagctgacgccggtggcctgcgtctatgaggagaaaaaggcccagaccgtggacgtgcaggcgatacacgaccagctggcgggagagaaggtggaggccgtctgcgacaaggagacggggaagcccaccgagtcccgcgtgggcctttccttcgatgtgacggcggtgcaggctcagctggatgccgcaccggcgggtacggaattcctggccgatgcggaggtggagttccccaccgtgtccaccgaggaactggaggagtgcatgttccgcgacgtgctgggcacctacaccaccaagtgtgcgggaccctggggccgtcaccagaacatcaagctggcggcggcggccatcaacggcaggatctataaccccggtgaggagttctggtataactccgcggtgggccagcgcacggcggcccgcggctaccaggaggccggcgtctacgagggcgggcgcaccaccaccggcatcggcggcggcatctgccaggtgtcctccacgctgtactacgcggtactgctcagcgatctggatatcgtgctgcgctactgccacatgttcaacccgggctatatgcccattggctgcgacgccacggtgagctggggcgggccggacttcgccttccgcaacagccgcgactatcctatcaagatcgtcacgtcctacaacgacaataccaacgaggtgacgtgtaccattctgggcaccaaggtggatgaccactacgtggtgatgaccaacgccgtgctgggcgtcacggactatcagacggtgtatcaggagtcgccggacgtggccccgggcgaggaggtcatcgaccagtatggccataccggctactacgtccggacgtggcgcaacatctacgatggcgacggcaacctgctgtccagccgcgtggaggccgacagccactacgacgtgggcaacaagatcattctggtggcgcctgggtatctgccgggcgacagcgaataa

SEQ ID NO: 1952 - DNA, 1260 bp, Unknown
  Artificiall/Consensus sequence
atgcgcccgctggcagacgaaatacggccccagacgctggacgaggtggcggggcagaagcacctgctggggcagggggctctgctgcgccgtctcatcgagaacggtaccgacaccaacctgatcttctacggcccttccggcaccggcaagaccactgtggccaacatcatcgccaagcaggcgaaaaagaccctgtactacctgaacgccaccaccgcgtcgctgcaggatgtgaaaaacgtcatcggcgatgtgggtaccatgatggcgcctaacggcgtgctgctgtatctggacgagatccagtacttcaataagaagcagcagcagagcctgctggaattcctggagaacggtaagatcaccatgatcgcctctaccacggagaatccgtatttctacatttacaacgccctgctgtcccgaagcaccgtgttcgagttcaagcccctgacggtggaggagaccattcccgccgtggagcgggcactgcgcatcgagcaggagcggagcccgctgccatttacgtgggaggacgccgtgccacgcaccgtggccagcggctgcggcggcgacgtgcgcaaggccatcaatgccgtggagctgctgtaccgaggagcgcggactgtcgacggtggactgtatgtgacaagggatgatgctttacaactcagccagcgcagcgccatgcgctacgacagggaaggagatgaccactacgacctgttgtcggcgctgcaaaagtccatccgtggctccgaccctgacgcggcggtgtactatctgggacggctgctggtggcgggggatctgctgtcgccctgtcgccggctgttggtcatcgcggcagaggatatcggcctggcctacccccagggcattgtggtgacgaaggcctgcgtggatgcggcgctgcagctgggactgccggaggcgcggctgccgctggcggaggccgctgtgctgctggccactgcacccaagtccaacagtgcccacaatgccatcatcgccgctatggcggacatccagaacggcgcggtgggggagatcccgcggcatctgaagaacgttcacgccgacagtgccggctccgccaggcccgacgcctacaagtacccgcacaattatccaaatcactatgtaaagcaaagatacttgccggaggcgatgggcgataagacatattatgagtacgggcccaacaagacggaacaggcggctaagcgctattgggacgacatcaaggggacgtga

SEQ ID NO: 1953 - DNA, 2031 bp, Unknown
  Artificiall/Consensus sequence
atgatgcagaacccacatccggccaagcggagggtcatcgccctgctggcgtttttcggcgcgttcctgctgctgttcgcggcggtgctgtacgacgcccagatcctccacggcggcgaaaaccgcgccaaatccatctccagtaatgccgccagtgagacggtgacggcctcccgcggcatcatcaccgaccgcaacggcaaggtgctggtgtctaatcggctggcctatacgctggtgttcgaccgcagcggctttgacgatgatgcggcgctgaacgccgccatcctgcggctggtgcagctgtgcgaggagacggggaccggctggaacgacaccctgcccattgggcgggtgggcaacttcctgcggtactccaacgcgcggtcggagacctttgacaagtttatcgaaaaaaacgatctgacctccggcgccagcgggcggcagctcctctcggagctgcgggagctgtaccacgtggacgaaagcctgtcggagcgggaggcgcggctcatcgtaggcgtgcggtatgagctgcacagccgcgacagctacaccttcgccgaggatgtgtccacggaggtgctgagtctcatcaccgatggacggtacgagggtgtcaccatccgcaccgcttcagcgcgcgtatacaacactgcgctggcggcccacattctgggcactatcggccccatctggcaggaggagtggagcagcaacgaggacaccgactatgtggggtacgccgacaaggggtactccatgaacgatctggtgggtaaggacggcgtggagaaggcatttgagtcctacctgcggggcacggacgggcggcggctcatcaccaccgacgagaccggcaagatcaccggtgagctttacacccgtgagccgcagccgggcggcacggtggcgctgacgctggatatcgatctccaggccgatgtggaggcggcgctggcggagaccatctccggcatgatcgacaaggacagcaacgaacgcggcggtgcggccgccgtggtgagtgtgggaaccggcgaggtgctggcgctggccagctaccccacctacgacctgtccacgttcaacgaggactacgatgagctggtgaacgaccagcgtctgcccatgttcaaccgcgctacccagggcatctatgccccaggctccacattcaagatggtgacggcggtggcggcactggagagcggcatcatcacgccgtcctccatcatccaggaccgcggtatctacacctattacaaggacccgcagcccatgtgctggatctacagtcagaccggctccacccacggacgcatcaatgtgtctcaggccatcaccgactcctgcaactactttttctatgaggtgggacggctcaccggtatccggacactggacagctacgcctctcagttcgggctggggcagtccaccggcattgaaattggcgactccagcggcgtgctggcctcccccgagtgggcggaaagccacgatcaggagtggaccgacggccagaccattaccgccgccatcggccagtcctacaacctgtttacgccgctgcagctggccaactacgtggccacgctggtgggcggcggcgaccattatcaggctcatctgctgaagaacgtcaaagcctacgacaactcgcggctgctgtacatgtacggcgataaaccgatgaatacagtcgaaatatccgattctacgttgagcgctgtgaccaggggcatgcacgagctgacggtgtccggctccgtggcctacgccttcgaaaactgcgtggtatccgccggcgcaaaaaccggttcggctcaggtgggtaccgacatcgccaacggcgtgttcgtggcctatgcgccctacgaaaaacccgagatcgccgtggccatcgtcatcgagaagggcggcagcggcgcggcgctggccaacacggcggtggagatcatcaactcctggttcagccgcgcccaggacggcactgccataggcgaaaatacccttttaaagtaa

SEQ ID NO: 1954 - DNA, 1467 bp, Unknown
  Artificiall/Consensus sequence
atggcagaaaaaaagacacatatgcagctattccagccggtggacctgacgcagggaacgtgctggaaaaccattctggtgttctcgctgccggtgatactgtcctatctgctccagcagatctacaccatcagcgacgcggccatcgtgggacagaccctgacggctcaggaggtggcgggcgtcaacgacaccagctcactggtgttcatctttttgcagtttgccttcggcgtcagcgcgggcttctgtgtggtgacatcctgccacgtgggggcgcaggacgaccggggcgtccgccgcagtctgaccacccagatcgtgctgtcggcggtactgacggtggtgctgacggcgctggctctggcgctgctgaaccccatgctggcgtggatcaacgtgacgccggcagaccccgaggtctatcacgccgcctatacctactgcttcatcatcttcgtgggcatcggcgctcagatgttctacaactttatctgctcgttcctgcggagcatgggcgactctgtgacgccgctgatattcctgctgttctccacggtgctgaacgtggggctggacctgctgtttatcctgaagttccactggggcgtggcaggggccgccgcggccaccgtgtccgcccagctcatcagtaccgtgggctgcttctgctacgcctttgcccactatcccaacatccggctgaagaaggaagactggcacatcaccatgcacgatgtgcgccgccacgtgagccgcggcatcccgctgggactccagttttccgtgctggcggtgggcatcatcgtcatgcagggcggcgtggtgcagttcgatatgctggatggccgcatggtgtccaacgccgcccagaacggctttggcgcggccaacaagctcaacagtctggtgatgacgcccatgaacgcgctgggcacggccatgaccagcttcacagcccagaatctgggcgcggggcggtatgaccgtatcaaaaagggcaccctgcagggcatggcactgatgggcgtcataatggctctggccgtgggcatcggcatgctgctgaccatcgatcagatgtacctccacgtgttcctcagcgccgacaaggtgacggaggagaccatccgcttcggcaactcctccctgtatgtggattttgccctgtatccgtttctgggcggcatcttcctgttccgcaactgcgcccagggcatcggacagtcgcccttcgtgctgggcgcgggcgcggcggagctgttggcccgcatcgcggtgtgctccctgctgcccgccgccgtggccggaggcgctgtcagtacccaggctcccgcgctggcgttctacgcgctgtgcgctgcggaccccatggcgtggatcgccgccgacgcggtgctgtgtgtgccgctgatccggaacatcctgcgcatgaactacgggtatctccacagctcccgtatgtaa

SEQ ID NO: 1955 - DNA, 1338 bp, Unknown
  Artificiall/Consensus sequence
atgagcgatatgcagcgaagcagcgcccgtgatactgcgctggaggtgctgatgcaggtcagccgggccaacgcctggtcggacggcagtctgaaacgcaccattgccaaaaacaagctggacagccgggaggcggcgctctgcacgcgtcttgcctacggtgtcatccaaaaccgcggtctgctggactactatatcggctgctggtgcagccagaagcctaaccggctggagccagtgattttgaatatcctgcgcatcggagggtatcagatcctgttcatggataagatcccccaccgcgccgccgtcaacgaggcagtggagatgaccaagcgctggggccgtcccaaggccgcaggcatggtcaatgcggtgctgcggaagtttgtgaccaactggatggacatgcccgcgctgccccagggcaccacagcggactatctgtccgtgcggtacagccatcccaagtggctggtgcgccgcctgatcgacgtgatcggggcggaggagacggaggactacctgcggatgaacaacgagatcgtccccaccaccatccagaccaatacgctgaaatgtacggcggaggagctggagaaggagctgcgcaccgccggcgtgacggtgaacgctcacccatggctggagggctgcttcgaagtgtcggccaccggcgatctggagcgcctgcccgcctttacggaggggcacttcacggtgcaggacgccgcggcccgattggtggccacagcggcagcgccgcagccggagactcgtgcgctggacatgtgcgccgcgcccggaggcaagtcctttgcgctggccatcgacatgggggacaggggcgatatcctgtcctgtgacatccatccccacaagctggcgctcatcgaaaagggcgcggcgcgattgggcatccgatccatccggacggcgctggccgatgggcgggagcaccacgcggcgtgggaaaacgccgcagacctggtggtggctgatgtgccctgctcgggactgggcatcatccgcaagaagccggatatccgctacaaggaccccaaggagctggcggagctgccggccattcaggccgccatattggacaacgcggccacctacgtgcggccgggcggcgtgctgctctactccacctgcacggtgctgccggaggaaaatgagggcgtcaccacggcgtttctggacacgcaccctgaatttgcactggaaccgtttaccctgccgcggcccatcggcggctgctgcggacagctgacgctgtggccgcagcggtacggcacggacggcttctatatctgccggatgcgcagaaaataa

SEQ ID NO: 1956 - DNA, 1491 bp, Unknown
  Artificiall/Consensus sequence
gtgtttttttgcgcggacgggcaagaaacagtggaaaacggcggaaagctctgctataatgtttccgctgaaatgggcgcggcggtacggcgcgccgaaattggagatcataccggcacaggccgcagaaaggatgatacgatgtactgcacgagaaaggtcaacgatgattatacatgggtgggcgccgactgccggcgtctggcgatgtttgagggcgtgtacgacgtgccccggggcatcagcttcaacagctatctgctgacagacgaaaagaccgtgctgttcgacacagtggacagcgcggtgcgccatacgtttcgggagaacctgacccacgcgctggcgggacgggagctggactacgtggtggtacaccacatggagccggaccacgcggcggagctggctgacctgctgcgggactatccccggacgcaggtgctgtgcagcgccatggccaagaccatgatcggccagttcttcgggccggagctggcggggcgcatcaccgttatcaaggagggggagacgctgtccaccggacggcacaccctgcactttgtggcggcgcccatggtccactggccggaggtgatgctgacctacgatgccacggacaagctgctgctgtcggcggacgccttcggctgcttcggcgccctgaacggcgcgctgttcgccgatgaggtgaacttcgaccgcgactatctggacgaggcgcggcgctactacactaacattgtgggcaagtacggcccccaggtgcaggcggtgctgaagaaggcggagacgctggacatccagatgctgctgccgctccacggcttcgtgtggcgggaggaactgggctatctgctgggcaagtatgacctgtggagccggtacgagccggaggtgcggggcgtcatgatcgcctacgcctcggtgtacggcggcacggagaacgccgccaacgtgctggcctgccgtctggcagagcagggcgtgcaggtgaagatgttcgacgtgtcggtgacgccggcaccctatgtcgtgtccgacgctttcaagtacagccatctggtgttcgcgtccgccacgtacaacatgggcatcttcgtgaccatggaggacctgctccacgacatcgcggcccacgccctggcggaccggcggtacgccctgatcgagaacggcacctggtcgccggccagcggtaagaagatggatgcgctgctgtccccgctgaagggctggtccgcggtggaaccggtgctgacggtgaagtcggcgctgcggccggatcaggcggcccagatgcagcgtctggccgatgccattgccgccgacgtgaaggcggagcagacggaggaggacgcctccggcgagggaaagcaccgctacgtgtgcaaggtgtgcggctacgtttacgagggcgacgagctgccggcagactacaaatgcccgctgtgcggcgccggtccggagtatttccggcaggaggcctga

SEQ ID NO: 1957 - DNA, 1113 bp, Unknown
  Artificiall/Consensus sequence
ctttcaggcgctccgccgcctgaggatgtgcgtcggcaatatgccacttttgaaatttcacggcggatcacctccttcttccggcggcaggggctatgccgccaatttaacttaataatactttattatatcaaatgtaagggaaaaggtaaagggcaaaatatcccgctgcgcaattgggttgcaatcggaggcgatatggtctacaatagtcataattcagacagaatcgaggacctgcccatgcgccctgacggaacgagagtcaaagacctgccgcccatcgtggcggcggtgccctacatcatgcccaagcgatacgatgcctggaactccatcaccgagtacatcgacgaggaggccattaagtcctacatccgcgaaaagcgccgcagcggcgtgcgcatcaaccacatggccgtcatcatcgccgcatactacaaggcgatacagacaaaccccaagctgaactacttcgtggtgaacagccacatctaccggcgcaaccacttcagcgtgtccttcgtcatcctgaagaagctggcggacggctcgccggacgagacgacgctgaagatctatctcgagcccagcgacaccgtgttcaccatccagcagaagatcaccgatgccgtcgaggccaaccgacacacggagcagaaaaacagcaccgacaagttcgcacggatgatgttctccgtgcccgggctgcccaaattcgtggtgtggctggcgtaccatctggacaagcacgggctgctgccccgcaagatcatcgacctgagcccgttccacaccagcctgttcatcaccaatctggcgtctatcaagaccagccacatctaccaccactgctacgaattcggcaccaccagcgtgttcgtctgcatgggaaagccggtgcccaactatatgagcggagacctcagcaagaagatgatgccgctgggcatcgtcatggatgagcgcatcgccaccggctatgagtacgcctccttctacaatgatttccggaagcacatccggaggccggagctgctggagacaccctttgacggcagcgccgcgccggagacagcgaaagcggacacagaggagcccgcagcggtgtga

SEQ ID NO: 1958 - DNA, 1269 bp, Unknown
  Artificiall/Consensus sequence
atgtccccgccccgcagcgaaaagcggcgcggggcgctggcctgcgcggtgctgctggtggtgctgataggagcggtactgtgggcgaccctcggcggccgcgctgcccagaccccgccccggaccgacggtgcccagacgctggagcccgccgatccaacggagcctaccggcctttccggcaactaccagagcggcggctgccagacctggtacgacggcgcagatgggcggatgtaccacctgtacgtctgcttcagccctcagtctgacggcggagggcttcctgccagccaccgctcggagctgcttccggccgacgcgtccggtaccagcccgctctgcctgttcgtggaggacgcggaggatccctctctggacgtgcgggaggatttcagcgccctgctggcctaccacacggtggaggccgtggctgccgagggcagcgatacctgcaccatcctgggggagacggattcctattacaacgcgggggccctgctggcccacgagcatgaggtcaccagtgcctgcacctataatgacatcatctggacgctgcacatgaagaccggcgacaagatcaccctccgccaggtggaggagtgcagcgaaaagcagcgccgtaccgtcagctgggaggatacccccatggacaccacggcggatctgcaggcgctgctggacgatctgacgctgaatctgagcgcggagacggagctggtggtggaactgcccagcgtgacctacacggagccgctgaccatccgccgcgccatgacgctgcaggctcacgcggacggcacggagttcaccgcccccatcacggtgaaccatatggcatacagcgaggtcacggacatccacgtagtgctgtcgggcctgcgcctttgcggcgcgggggacatgaccggtaccggcgtcaccgccaaggcccctacttacctgaacaactgctggatcaccaactgggacgtaggcgcgctggcggcggacggcggctggatctgggtggagaaaagcagcttcacccgcaacgccacggctctgcgcatcgacaccacggagagctcctcctggggcggtgatctccacggcgggaactttatccgcaacggtacggcgctggatatccaacgcatgcccggggagtggatgacctactacgtacacaacagcacctttaccgacaacgacacagtgatcgccggccctctggcggatcaagtccggctggaggacggcaactacgtgcagcagagcgcctga

SEQ ID NO: 1959 - DNA, 1170 bp, Unknown
  Artificiall/Consensus sequence
atgatcgaactgctggcccgctggtgcataccggatcgggacaatgtaacatcgccgtcggtgcggcgggcctacggcacgctgtgcggcatcgtgggcatcgccctgaatatcctgctgtttgcggggaagttcttcgcgggacagctgtccggctccatcgccgtgacggcggacgccttcaataacctgtcggacgcgggctcctcggcagtgacgctgctgggtttccggctggcgggacggaagccggacacggaccaccccttcggccacgggcgcatcgagtacatctcgggtcttgcggtggcgggcctgatcctgctgatgggcgtggagctggccaagtcctccgtcgataaggtcctccatccggaggaggtgacgttctcgctgctggcgctgggtatcctggcggcgtcggtgtgcgtgaagctgtatatgtggctctacaaccggcgcatcgggaagaagatcaagtccgcggccatggaggccacggccatggacagcctgtccgataccgcggctacggcggcggtgctgctggccatgctcgtcggcaggtggacgggactggcggtggatggctatgtgggccttgtggtggcgctgttcatcctggcctccgcctgcaaggcggcgaaggagacgctgtcgcccctgctggggcaggcacccgacccggagctggtacaggagatacgggatatcgtcatggcccacagcaccgtacagggtatccacgatctggtggtccacgactacggcccggggcggtgtatgatctccctccacgcggaggtgccggctcacggggacattatggagatgcacgacgtcatcgacaacatcgagaaggaactggcggagcggctgcactgtcaggcagtgatccacatggaccccatcgtcaccgacgacgcatccgtgggtgcgctgcgccggcagatcgccgaagtggtgaagcaggtggacccccgtatgaccatccacgattttcgggtggtgcggggtactacccataccaacctgatctttgacgcggtattgccgttctcctccggcaggacgccggagcaggcggcggaggagatccggaagctggtgcgggagctggacagcacatatttcgccgtggtgacggtggagcacagctatacggattga

SEQ ID NO: 1960 - DNA, 777 bp, Unknown
  Artificiall/Consensus sequence
atgaacaacgaagaacactacacagagatcgacctgacagcactgctgaaggcgctctggcggcatatctggctgatcgcggcgtccgtgatcgtcatcggtgcgatagctttttcctacgcccgctttttcgtcacgcccatgtacacggccagtgcgctgatgtacgtcaacaataattccctgtcggtgggcagcaccaaggtgagcctgagcgccggcgacctgtccgccgccaagagcctggtgaacacctacgtggtcatcctgaacgcgcggaccacgatgaacgaagtgattcgcgaggccggtgtggactatacctacacggatatgcaggggatgatctccgccggcgccgtgaactccacggaggtggtgcagatcgatgtcaccatgcccgacccgcaggaggcggcgctggtggccaactccgtcaccaaagtgctgccggagcgtatcgccgccatcatggacggctcctccgcccgcgtggtggacaccgccgtagtcccgtccacacgctcctcccccagctacaccagctatacggcgcggggcatgctgctgggactggtgctgagctgcgcctgtgtggcgctgcgccagctgctggacgatcgggtgcaggacgaggactacctgatccagaactatcccgacattcccgttctggcggtgatacccgacctgaaccagacgaagcatagctcctatggctattatgagggctatggcagcgcatcggcctgcggtggaaaggaggcggcgcgatga

SEQ ID NO: 1961 - DNA, 1026 bp, Unknown
  Artificiall/Consensus sequence
gtgccgccggtgccgggaggcggcggaatgaggcggctcctggcgtttttactggcgctgacggtggcggcggggctgtgcggctgcggccggaagcccttgcaggacaacggaaagctccgggtggtatgcacgctgttcccctactacgacttcgtgcggcagatcggcggggacgacgtggacgtgacgctggtggtgcccgcagggcgggagacacacagctttgagcccacgccgctggatgtcatccgcatcagcgaggcggacgtgttcgtctacaacggcggcgagagcgagcagtgggtggagaacattctggacgccgcaggggaaaatatcccgtatgtcctgtcgatgatgggggcggcggaactgcatgaggaagaattttccgagggcatgcagggacaggacgcaaacgcccacgagcacagcgatcacgaccacggccacggcgaaaacggcgggggcgatgatgcggaagatgaagaaaccgagtacgacgagcacatctggacatcgccggtgacggccatggccctgtgccgcgccatcggggagactctgtgtcaggccgatcccgaccacgccgacagctaccgccagcggctgacggactatctgacggagctggagtcgctggatcagtcgttccgcgacgtggtggccggcggcagccggaggctgctggtgttcggcgaccggttcccgcttttgtatttctgccgcgagtacgggctggactaccgcgcggcgtttcacggctgcgccggcgacaccgagccgtcgctggccacattgaagtatctcatcgatctggtaaacgaggagcacatccccgtggtatacaccatcgagctcagcagccggaaggtggcggaggccatcgccgagaccaccggcgcggcggtgcggacgttccagtcctgccagacggtgagccgcgcggattttgataacggcgtcacgtatctccaattgatggaggccaacgtggacgcattgagggaggggctggcctga

SEQ ID NO: 1962 - DNA, 1095 bp, Unknown
  Artificiall/Consensus sequence
atgaagaagaagcttttggccgcgctgctggccctgggagtgctggcatccctcaccgcctgcggcgggaagcagaagacccagcaggatgccgccgccgacggcgacaccggctacgccgattccatcaacattctggtctaccccgactatgtgtccgaggatgtgctggccgcctttgaacaggagtacggcattcaggtgaacgtcacctacctgtcctatgaggaggacaacatcacccgcgtggagaccggtgacgacttcgacatcatcaatccctgtcaggaaacggtacaccagatgctgcaggaaaacctgctgcagaagatcgacaagagcaagatccccaatctggtcaacctgtacgatgaattcaacacctatgactaccacggcgaggaggattacagcgttccctacatgtgcggctccatgtccatcatcgtgaacaaggatacctgccccatcgagatcaccaagtggtctgatctggcggaccccgccctgaaggggcagatcgtctccacagacatcgaccgccggttcgtggccaccactctggcggagaatggctttgaccccaacagcgagaaccgggcggatctggacgccgtgttcgattggctgtgccagttcaacagcaacgtgaaggtctatgacaacggcgcgccccgtacctctctggaaaacggcgactgcagcgtggccttcacctataccaccgactatgtgctggtcaagcaggaggaccccgatggcaattatgagctgatcaccctgcccgatggctggtactccagaggcgagtggatgctggccattccggcctccagcaccaaggccgaggaggctgagctgctcatcaactatatccacgacgccaagaactacgccgacaatgtcatgaagtaccccggcgtgccggtgaacgaggcctgcatcgcctacctgaccgacgagtacaaggagctgttcaaggcgtttgacatccccgagagcgcgaatttcttcacactgtcctctctgtcctccgagagcctggagatgtacgacctgttcatctccaacgtgatggccagctccaacagctga

SEQ ID NO: 1963 - DNA, 1737 bp, Unknown
  Artificiall/Consensus sequence
atgctgaaaaagcttgccccgtatacaaggggctaccggtggtatatcctgctgggcgtattgtgctcggtgggtgagtctgtgctggagctggagctgccccgtgccatgagtgagatcgtggacgtgggcatcgccaacggcgaccgcggctatatcctgctgacgggcctgaaaatgttcctgatggccatggcggcgctgctgtgcggcgggggtgcggcggcgctggccgctaaagcggccatgggtttcggcgccaacctgcgccaggcggagtatgagcaggtgcagcgcttctccttcgccaacatcgagcgcttctccaccgccagcctcatcacccgcctgaccaacgacgtgtcatcggtgcagatgaccatgttcatgggcatgcgcatgtgtgtgcgtgcgccggtgatgctggtgacggcgctgataaagaccatgcagatcagtctggacctgagccgggtgttcctggtggcagtgccgctgctgatcctcgcggtggtcatcgtcatccgctacgtggggccgtttttcacggcgctgcagaacgccaccgatgatctgaatctggtggtgcaggagaatctgaacgccgtccgcgtggtgaaatccttcgtccgcgaggagcgggaggagcaaaaattccagagccgcagcaataagctccgcgacacggcggagagggcctttgggttcgtggtgatgttcatgcccatcatgatcatgatcatgggcggcaccacggtggcgctgatgtggctgggcggtcacgacgtggcggagggcaccctgctctccggcgacctgatggcgttcttcacctattccagcgagatcctgatgtccctgatgatggtgtccatggtgctgatgttcctgacccgtgccatcgcctgcggcaggcgcatcgtggaggtgctggacgaacagccccagatcaccgatgcccaggccgatgccgcattgactgtggacaacggcgatatccggttcgatcacgtgtatttcaagtatcaccccacggcggagagctggaacctgacggacatcgacctgcacatcgaaagcggtatgactgtgggcattctgggcggcaccggcagcgccaagaccacgctggtcagcatgatcccccgcctgtacgaggtgaatgagggcgccgtctccgtgggcggccgcaacgtaaaggactacaccatggaggcgctgcgcgacggctgcgccatggtgctgcagaagaacaccctgttctccggtaccattcgggagaacctgcgctggggccgtgaggacgccaccgatcaggagatcgaggaggcctgccgcatggcctgcgccgacgaattcattcagcggatgcccgacggctacgacacctatatcgagcagggcggcaccaacgtctccggcggccagaagcagcgcctgtgcatcgcccgggccattctgcggcagcccaaggtactgatcctggacgactctaccagcgcggtggacaccgccaccgacgccaagatccgcggcgctctgaaaacggcgctgcccggcgctaccaagctcatcatcgcccagcgcatcacctccgttatggacgcggatatgatcctggtgctggacgacggccgcgtggtgggacagggcacccatgagcagctgatggacagctgtgagatctaccgcgaggtctatgaatcccagcaggaaggggtgagcatcgatggctga

SEQ ID NO: 1964 - DNA, 3564 bp, Unknown
  Artificiall/Consensus sequence
atgggtgagctgaagctgacggagcagcagcacgcggcggtatttgaccgcggcggaagtctgctggtgtctgccgcagccggttccggcaagacgaaggtactggtggagcgggtgttctcctatctgacgcaggagcgcgccaatgtggacgactttctcatcatcacctacacccgcgcggcggcggcggagctgcgggcgcggctggcctcggagctggcggcgcgggtggcggagacaccggaggaccggcacctgcggcggcagatgttccgcgtgtatcaggcggatatcaagacggtggacggcttctgcgcatcgctgctgcgggagcacatccacctgctggagccggtggacgggcggtgtctgacgccggacttccgtgtattggacgaggctgaggcacagctgctgcgggagcgggcgctggagcggaccatggagacgttctatcaggacatcgaaaacggcgatgaagaggcggcgcagctggcgggtacgctgggcgcgggacgggatgacagggccctgaccgcgctggtgctggagctgcacagcaagatccagagccatccctaccccgagaagtggctgcgggccgcggcggagagctggcggcagctgccctcatcgctggcagacagcgactacggcaggacggtgatggaggacacagtgcggcgggccttgttctgggcggggcagctggaacgggctgtggccgccatggaggactgcgagccggtatacaaggccaacgcggcccagtttctggcggcggcggcagagctgcgccggtacgagcaggcgtctcaggagggctgggacgccatgggccgtgtgcagccggtgctgcagcgggccggtgcggtgaaaaacggcgagaacgacgaggccaaggcggcggccaaggccgtgcgggagaaatacaagaaggccaaggaggagatgactgcgccctacctcgtgacggagcgggagcatctggaggatctgcaggcagcagcgccgtccatgctggcgctgctgcgtctgacggagcggttctcccagcgctaccaggcggagaaggtgcggcgcaatgccatggatttctccgaccaggagcactacgccgtgacgctgctgtgcggtcaggacgatgaaccaacggatctggcgcggcaggtgtcccagcggtatcaggagatcatggtggacgagtatcaggataccaacgaggtgcaggactgcattttccgggctatctcccgcgcagggcggaacctgttcaccgtgggcgatgtgaagcaaagcatctaccggttccggctggcggaccccaccatctttatgggtaagtaccggcagttcgccgacgcggcggatgccgaggaggggcagccccgccgcatggtgctcagccgcaacttccgatcccgcggggaggtgctggaggccactaacttcgtcttttcggacatcatgtcccaggaaatgggggagatggactacaccgatcaggagaagctgtacttcggcgcggcgtactataccccagcagcggggcgggagacggaactgcacgtggtcagtgtggaggacacaccggaccaggcgctggaccgcactgaggcggaggcccgctttacagcgcggcgcatccggcagctgctggatgagaagttccccgtgcaggcgggggagggcgcaatgcggccggtacggccggaggacatcgttatcctcatgcggtcgccccgctcgcggatgcagacgttcacccgtgcgctggcgcgggagggcatcccttgcggcagcggggagagcgaggactttttcagcgccatggagatcgcggtgacggtgtcgctgctggagatcgtggacaatccgcggcaggacgtgccgctcatcggcgtactgcgctcgccgctggtggggttgtctcccaatcagctggcggccatccgcgccgtgctgccggagggagactactacgatgcgctgtgtcaggacgagagcaacgcggcacgggagttcctgacgctgctgaatgagctgcggcaggcggcgcgggagatgccggcggacgacctgctgtggtacatctacgaccggtgccatgtcatggctattttcggagccatggaagatggggcaatgcggcaggcgcggctgacggcgctgtacgactacgcgcggcagctggtgcagagcgggaaggcggggctattcgacttcatcagtcatctgcggcagctgctggaaaacggcgacgcaccgacgctggggacagcccaggcggcggagggcgtgcagatcatgagtatccaccggtccaagggactggagttccctgtggtgatcctggcggacctccagcgcagcttcaaccggcaggacctgaaccggccggtgctggtgcatccggagctggggcttggcacggatcgggtggatcgggaaagacacatccgctacgccaccatctccaaggaggcgctggcgctgcggctggaacgggaggccaaggccgaggagatgcgcatcctctatgtggccatgacccgggccaaagagaagctcatcctcatcgactgccgcaaggggatggagaagaagctgcgggatctgacggccatgaccggtataccggtgccgccggaggcggtggccgatgcggactcgcctggggagtgggtgctgctgtcgctgctgcacacgacgcaggcagcggcgctccacggtatggcaggcgtgcggccggaggtgctgacgcaggcaccggacagctggtccatccggctgtggcacgaaaacggcgaggcatcggggacggcggtagaggacacggaggaggctggcgtgcctcgggacttcacggaaccggatcgggcggcgctggacttcgtatatccccacgcagcggtgaccacggtgcccaccaagatcacggccacccagttgaaggggcgggagctggatcaggaggtggcggggggcgcaggcactgtccgcaggccctcggagccggaaaagccccgctttttgcaggaaatacacggactgtccgccgcagagcggggtacggccatccatctcgtgatgcagtacctgccgatggacacggcggcggaggagcagtccgtggcggctcaggtacaggcgctggagcagcggcgactattgacgccggcccaggcggaggcggtggacaagcgggccatcgcggcgtttctgcggtcgccgctggcggatcgcatccgcggcgcagagcaggtatggcgggaataccgcttcgccctgctgatgccagcagagcggtatgcaggcggcgcagagggcgaggagatgctcttacagggtgtggcggattgtgtgttccggaaggatggcgcgctgacggtggtggacttcaagaccgaccgcgtcacggcggaggaagctcccgcccgagccgagatataccgcgggcagctccaggcgtacagcgacgcactgagccgcatcatggaaatgccggtggagcggcgggtattgtactttttccggtgcgggcaggaaatttctttgtag

SEQ ID NO: 1965 - DNA, 1221 bp, Unknown
  Artificiall/Consensus sequence
atgattatacatcggcacacccgccgcgtcaacaataaactgaatgattcggcgaaattaatttgtcatgccgagacattgcaggggttgacgaaatccgccgcatcgcatacactggatagacgtgtattttttcatgaggtgaaagagatgaaagagatcaaaacgtggtcgctggcctttacatatgtgggatgcttcctgggggccggctttatctcggggcaggagctgtggcagtttttcggcagcttcggcaacttgggctatgtgggttttctgctggcagtggtgctgttctccgccattggtatcctgttcgtgcggctgacccagatgacccagtgttccgacatggatcgcctgctggtaccctggaacgtcaagtggctgcgggcggcctccggtgcggtgggcgcggtattcctgttttttgtggtggtgtccatgtccgccggtgtgggcgctatgctggcccagctgttcgatgtgtcggcgtggctgggcagcgccgtgtttatggcactggtgttcgcggtggcgctgctgggcgtgacgggaatggtcaatgccttctccgcactgatacccgtgctgatcacggccaccgtggccttcgccgtgggagcctacgccaccttcggcacggagggggtcttccagctgcggaacgtgaacaacaacccgctgatgcccaactggttcatcgcagcgctgaccttcgtctcctataatattctgggcggtatcggtatcatgtcgccggtagggcagtacgtccggcggaagcgccacatctacggcggcatcattctggccggtgtgatgctgctggcggtggcgggcagtattctcaccagtctggcgtcataccccgaggcggtggcggcggagctgcccatggtggcgctggccagccgtctcaacgggacgctgggcacagtgtacggcctgatgctgctgctggccatgttctgcaacgcgctggccagtctggtgggactcatcgcctatctggagcagaaggcccgcttcgtgcgggaaaaaaagaagccggtgttggtggggctgtgcgtactggcgtggtgtgccagtctgctgggctttggtgagatcatcgccgtggtgtatccgatcttcggctatctgagcatcgtgttcatcgtgtgcatggtggtacccttcgtacagtgccgaaaaaaggagaaggccagcgcctga

SEQ ID NO: 1966 - DNA, 1935 bp, Unknown
  Artificiall/Consensus sequence
atgctggatgatcgctatgaaattctggagctgatcgggtccggcggcatggcaaatgtgtataaggccagatgtcatcggctgaaccgactggtggcggtgaagatactcaagagcgatctggcggaaaacgccgacttccgccggcgttttcgggacgagtcacgggccgtggctcagctgtcccacgccaacatcgtgtcggtgtatgatgtgtccaccagcggtgagacggagtacatcgtcatggagctcatcgacggcattaccctgaagcagtatatggagcggcggggccgcatggactggcgggagtcgctgcacttcatcagccagatcatgcggggcctgagccacgcccacagccgcggcatcattcaccgcgacatcaagccccagaacatcatggttctgcgggacggcagcgtgaaggtggccgatttcggcatcgcatgcctggcaaacgccagccagaccctgacccaggaggcgctgggctccgtccattacatctcgccggagcaggcacggggcgaccgcatcgatgcacgttccgacatctactccgccggcgtggtgctgtatgagatgctgacgggacggctgccctttgagggcgactccgctgtgtccgtggccatccagcacctgagctccgtgccgctggcgccgcgggacatcgaccatagcatccctgagccgctggagctgatctgcatgaaggccatgaacagcgatcccgacaagcgctatcccacggcggacgccatgctggaggatctggagaagttccgcaaggaccccgccgtggatatggactacatccgcaaggaactggcatcggtgcagccggacaacgagcccaccatgtccattcccaccgcgcaggtggccaccgccgtgaaaaagcgggccgaccagatgcggcgcgaccagccggaggacgacatccggccccgcgacaagaagtccatcgccatcatgggcggtatcttcgcagcggctctggtgctggtgttcctgctgttcaagctgattttgggcgattttggccccgccggcaacaacaagagctacgatgttcccaatgtgctgggcaagaccgtggaggaggcccagctgatggacggcgtcaaggatatttttgaaatcgtggtgaagggcacccagcgctccgacacctatgagccggggcagatcatccagcaatcgccggatgccggacgcagccgcaagagcaacttcgtcatcaaggtctacgtggcggcggaggaggagaaggtgcccatgccgaatgttaccggccaggagtaccggcaggcacgcatccaattgcaggagctgaatctgaacctgaaattcgacttccagagccagaattccgacacggtccataaggatatggtcatctccacgaagcccgccgccggggaggacctgaccgagggtcagcaggtgacagtgtacgtcagcaccggccccaagacggtgacggtgccctcgttcatcgggcaggacattgccatcgccatcaagaatgctcaggacatgggcctcaccgtgggccagccggagttcgacccgtacagtctggtggagacgggccgtgtcactgagcagaacatcgacccaaacgaggtggtagatggcggcacccagatcgtctttaccatcagcggcagcggcgaggaggacatcgtgacccgcaccaaggtggcggagttcgccctgccggaggacatgggcggcatgatcaaggtggagtttgagcaggacggcgccattgtggacagccagtacatcagcgccaacctccagactgtgacatacactttcaccggtcaggtggggcagacatcactggtgcgggcttacttcacctgcatcaacgacaactctgcggtatcttcacccacgcaggagatcgtcttttga

SEQ ID NO: 1967 - DNA, 2562 bp, Unknown
  Artificiall/Consensus sequence
atggatgaacgcagacgcagacaggctgccggccgcacggaccggacgcagagcgcccgagagatagacaataacggacaggagcgtgctccccgccgccgcggctggcacaccgccggccgcgtcatcggcacgatcctgctggtgatggtgctgaccatggccatttttgccggtattttcagcgcctacatcaacagcagcatgcgcgggaacgtcgaggtctatctggacgagtttgagtcgaaggtatccacagagctgtattatcaggagccatccactgaggaatggaccatgtaccagacactgtttctggattccgagaaccgcatctgggccaacctggaccagatccccaagaacctgcaggaggctgtggtggccattgaggacaagcgcttttacaagcaccacggcgtggactggtacggcaccgcccgcgccatcctcagcaccctgttcggcggaaatgtccagggcggctccaccatcacccagcagctggtgaagaacgtcaccggcgacaaccagaacaccgtgaagcgcaaggtcacggagatctaccgcgctctggatctggagaagcgctacgaaaaggacgagattttggaggcgtacctcaacgaggtgtacttcggccgcagctgctacggcgtggtgacggcgtctctgacctacttcgataaggacgtgtcggagctgacgctggcggagtgtgccagtctgatctccatcaccaacaacccctcgctgtacgatcccctgcgggcggactggagccgtgagaacaaccgcgagcgccagctgctggtgctgggcgccctgtatgagcagggtaccatcgaccagaccacctacgaggccgccaaggccgaggaggtggtgtttgccgacggctacaccattcagggcaactatgtgggcagcgatgagagcaagaagaacaccaccggcgacaccaccggcgacaccaccggcgacaccgccggcggcgatacccaggaggatacccaggagtccaccgccaccgccagccagtcctacttcaccgacgcggtcatcaacgacgtggcctccgctctggtggagaagtacggccttaccgacatcaccgatgccaacggcaaggtgaccaccgcctttgagcagggcgtcaacatggtctacggcaagggctacaagatctacaccacccagaaccccacctaccagaagatcgcggaggaggtctgctccgatacgtccaacctgccctacaccaccacgtacaccgattcctacggtgagacgaagacggagcagctgcaggtgggcatgaccatcgtagacccctacaccggctatgtggtggccatggtgggcggcgccggcgtcaagcaggtggaccgcggctggaactgggccaccagcgcacggcagtgcggttctgccatcaagcccgtgtccgtctacgcccccgccctggatgacggcaccatcaacggcgccagcgccatcgacgactatccggtgatggtgctcaacggctccgcttaccccaagaattccaacggccgctacatgggactgaccccgctgcacaccgccatcgcacgatccaccaacacctgcgccgtccgcgtggtgcaggagtacggcaccggccggtcctatgacttcatgaccaacaagctgggcttcaccaccctgacgtatcaggattcccagcaggtgggcaacatgggtctgggcggtctggaccgcggcgtcaccactgaggagatggccgccgccttcggcgctttcaccaaccagggcgtctacaccgcgccccgcaccttcatccgcgtggaggattccgacggcaacgtggtgctggagaacgaggccgagtcctccgtggccatgaaggacaccactgccgcgctgatgaacagcctcctgcaggaggtagtcaacggcggtaccggctatgagggccggatcagcggtatgcacgtggccggtaagaccggtaccaccaacaacgatcaggaccgctatttcgtgggctacaccccgtattacagctgcgccgtgtgggtgggctacgtccacaaccagcgcatcgtggccagcggcaaccccgcggcctccatgtggcagaaggtgatgagccgcgtccacgaggggctggaggacaaggacttcttcagctgctccggcctgacctacgtgtccgtctgtgccgacagcggcctgctggccaccgaggactgcgccctggactgccgcggcagccgcgtctactcggcgctggtggcggcggacaacgcgccctccgcaagctgcaacctgcacaccagtcccgattataccgtggccttcgtggatgaaaacggcgagaccaccatggccagcggctccatcctgaactacgagcgccagcgcctgcccggctacgaggatctggaggccgaggacgacttcatgctcctctacggcggcaccagcggcggcgatgatgattggggcggcttcttcggcggctccgatgacgacgaggatgatgacgatgttcacaccagctggtggggataa

SEQ ID NO: 1968 - DNA, 1863 bp, Unknown
  Artificiall/Consensus sequence
atgccgcgaaagacatcctgctgtaacgggacgctgctgcgcagcgacgtgcgtcactactggcccgccggctttctctatgtgctggtgtggctgatgatcctgcccatccccctgctgcagacagcccgggattatctgcgtttccagtctgagcagacggtccagctggcagcgcagctgcacaaccacgtctatgccgccatgaccggctcgctggtgctggcggtgctggcgggcgcggtaatacccatggcggtgtatgcctatctgatgacgccccgggctgtggggctgatgcacaccctgcccgtcacccgcacatcccagtttttcacccactttctcagcggcttcggcctgttgacagcgggaaatctgctgatcttcctgctgtcagcgctggcgatgatgccctccggcagcgtggactgggccgcgctgggcctgtggctgctggtgacggagctgctggagctgttcttcctgtctctgggtactctgtgcgccatggccaccggctggctgctggccataccggtgctgtacggcgcggccaactgcattgttttgttggtatgcgtcgtggtgcagttccttcagcgctggttctacttcggctttgagagcaccaccttccccatggcggtgatctggctgacgcccatcgcccgcctgtccaccgccgtttgcggctacgccgacgttctggtaccgcgagagggggaggaggtctacctccgcgtcctgccggagggcggcatgacctccttgctggtctataccatcgtgggactggcgctgctggctctgggctggcttctgtaccgcagacggcccagtgaggccgccggtgacgccatcgccttccgctggctgcggcccatcgtccggtggaccgtgggtctgtgcggcggtctgggcctgggcctgttcctcagcgtagcgctgctgggcggtctggtcggcggcatagtgcagctcctgctgtgccaggcggtcatgggcctgttgtgcttcttcgccgctcaaatgctgctgcaaaagtcgttccgcgtcttccgccgcagctggaaggaggcgctggcgctggtgatcgcactggccgccatcaccctgtgcatccggcaggacttcttcgacgtccagaaccgcatacccggcgcgtcccaggtggacaccgtgtcggtccagctctacgccggtgacagcagctactgcgaaacggacgatcccgccgtgctggagcgggtgcaggcgctgcaccgcgccgccctggctcagggcgaggatatgaccggttcctcggaccgctatatgagcatccgcctgcgctatgagctgaaaaacggcgacgccgtccggcgggattacaccattgcctgcgtctccggcacggagacgtaccgcctgaccaaccagctgctgaatatgccccagttccgccgctctgccatgggcatcgactggttggagacctccgggctggacgccgtccgcagcggctacgtggaggactaccacaccggcgccacggtggacctgacccgtgagcaggccgcggagctgtgccgtctggcccagcaggacgccaacgatgtctccgacagtgatgtgctggccgccatggccgcgaacagcgatgatgtctacgccgccgcggctaaggaggataccctttcggcggagacggaggcatgggacgtataccgttacaacatcgtcatctacgtcacggtggatggccgcgatgtcagccgcagcctgactccgatgggctattgcacccgtatgcagtccttcatcggcagcctggacttcaccaacaccaccacggtggacacagaggaggccgtgtcatga

SEQ ID NO: 1969 - DNA, 2757 bp, Unknown
  Artificiall/Consensus sequence
atgaacaggtacggaaggacaggactgcgggtactgggcggcctgctggcgctggtgctggcggccacgctgctgcccgccgcagtatacgccgcaggcggtgcgtatcaggtggacgaggacagcgtctatatgaacatggaggacagccgccctgcggccttggcggcgcaggcatcgatggccgcggcggacaacgtgaccatgcagctgttcaactacacgggggccatcaacggacagggaccgctggagttctatcacagctggggcgcctcggtggacggagacgccagcggaagcggagcgcggcccagcatgtcccccacgctggaggacaacaagtggccctacgtcaccggcatccccggcagtaaagccagcggcagtctgggctatctgttcagcgacagcgccgtccccggcaagaccgtctattccgtggggcgcggcggcagcacggggctgttccagcgggacagcaagggctatctctactatgactctctgcggaatgccgccagctatgacgcggccagcgggcggttccagctgtatgacggcatcgtgcggccctggtacaccggctatgtggagcctgacggcaagacggtattcgacgacaggacgatcgcctttaacggaaacttcctgccgttcaacgacctgaccggcgccacagaggcccccaggggcaggagtcccgccgcctaccgcctgccggatggcaaggtggacctgtggttcggcatgtccatgtcctttgacttctatatgcccgccgacggaaagatcaacggcgaggatatgatcttccagtttctgggggacgacgacgtgttcgtctacatcgacggcgtgctggtgctggacattggcggcacccacggtgccaacagcggctccatcaactttgctaccggtgatgtgacccatcccagggagggtgtgtccggtgcggcggaggccgatgactacgtcaccactacgctggcaaaaaagttccagaccgccggtatgaccggcagctttgacggcagcacctttggggactacaccaagcacacgctgcagttcttctatctggagcggggcggcaatgtgtcctactgctatctgcggttcaacacgcctaccctgcccaacaactccctgaccgtggccaaggagctgtccggcggcgagcaggagctgaaccgctatctcaccggtgccatggactatcggttccgcgtgctgcggccggacggcagcctgtacgtgccggagggcacggcgtatcagctgctggagaacagcaccgctgtgggcagcggcgccgtggaggcaggcgggtacttcaccctgaaggcggggcagatggcccagttcaccgacatgctgacgctgggcggcgggagctatgactatctggtggaggagaccatgccggaccggctgacgggacagtaccggcaggtgcagtacaccgtgggcagcggcaccggcaccaccgtcagccccacggcggaggaggatttcaccggcttccgcaccgatcccctcaccgccgcggccacccagctggtgacgtaccgcaacgtggtggataccagcgctctgggcgagctgcgggtgacgaaacaggtggcggagggctccgacgccgcggcggggcgggcgttcgacattggcgtggccctgggcggcgaggcggtgccggcgggcacgccctacacggtgaacggtgaggagcggacggtggagacggcgggcatcgtgcccctgacccatggagagacagctgtgttcaccggactgctggcgggcacggcctacgccgtgacggaaacaccgccggagggctggcgcgccgcttttgacgccgccgtcacggcggagggcgtcacctcccccacaagagccgacggtgaggtgccggtgggcggcagcgtggccgtcaccgtcaccaacgccacctatgactacgccatctccctgccgctgaccaagacgctgctgggcgcggcggcagcccagtgccagacgttccggttcctgctggaggagacggacgcggaggggaatgtactgcggcaggtccacgaaacgggcatcaccgtcaccggtgaggaagctgccaatgggcggctggtcatcggcctggccgccggcgacaccgcgccccgctactaccgcatccgcgaggcggaggccgacggcttctggtgcggcggcgagatgtaccgcgtaacggtgctgcccaacggtgtggacggtgcggtgcgcatcaccgtcaacggcagcgtgtgggacgacagtgcgctggcctttgtaaaccgcgcttcccggagcctgaccgtccgcaagacggtggagggcgagatgggcgaccggtcgaagacatttccctttacggcggtgctgacggtggacgggcaggccgttcccttcccagtcggcgagggctacaccgtgtccggcgggcaggcggtctttgccctgcgccacggggagagcctgaccttcaccggactgccttacggcggggtcgtgacggtgacggagacggagcacgccggttacaccgtcaccaacagcggccgcagcggcgacagcggcgcggtgacgctgggggacggcggggagctggtgttcgtcaacacgaagcgggccgtccccgatctgggcgtagccggaggcaccctgctgccggcaggagcgctggtatgctgcggcggcgggctgctgctgtggagtcggaagcgccgcgcctga

SEQ ID NO: 1970 - DNA, 2361 bp, Unknown
  Artificiall/Consensus sequence
atggcaaaagcaaagaatctggtgatcgtggagtcgcccgccaaagccaagaccatcggcaagtatctgggccccgattatcaggtgaaggccagtatgggccacctgcgggacctgcccaagagcacgctgggcgtggacgtggacggggatttcacccccaattaccggcccatcaagggcaaagaggatatcatcaaggagctcaagacggcggcaaaggggagccagaccgtctacctcgccaccgacccggaccgcgagggcgaggccatcagctggcatctgaagcatcttctggacctgccggacgagaaggcgcggcgggtcacgttcaatgagatcaccaaaaaggtggtgacggacagcatccgtcacccccgcgacatcgatcaggatctggtggacgcccagcaggcccgccgcgtgctggaccgcatcgtgggctatcagctgtcgccgctgctgtggaagaagatccgccgcggcctgtcggcaggccgtgtccagtccgtggccatgcgtctggtggcccagcgggaaaaggagatcgcggatttcgtacctcaggagtattggacgctggacgccagcctgaaaaaccacgccggcgccctgtttaccgcccactactacggcaaggacggcaagaaatacgagcccgccagtcaggccgatacccaggcggtgatggacgaactgaagggcctgccctttgcggtgaagtccgtaaagcgggcggacaagcagcgctctcccgcaccgccgttcaccacctctactttacagcaggaggcgtcacgcaagctgaacatgaccccccgccgcaccatggccatcgcccagcagctgtacgagggcgtggacatcaccggcgagggcactgtgggcctcatcacctacatgcgtaccgactccctccgcatctctgcggaggctcagacccaggccagagatgtcatctgctcccgctacggccagagctattaccccgcgtccccccgcgtctataagaccaaggccggagcgcaggacgcccacgaggccatccgcccctccgatccgtccctgacgccggagcaggtgaagggcgacctcaccggcgagcagtaccggctgtaccgcctgatctggagccgcttcctgtccagccagatggccaatgccgtctacgacagcatcagcgtggagatcggcgcgggcacccacagcttccgctgctccgccagcaacctgaagttcgccggctacaccgccgtgtacgaggagagccgcgacgatgagaaggaggagaaggagtccccgctgccggagctgaccgagggcgagaccgtgacgctggagagcttcgcgccgtcccagcatttcacccagcctcccgcgcggtacaccgatgccaccctcatccgcaccatggaggaaaacggcatcggccgtccctccacctacgcccccaccgtgtccaccattctggaccgtgagtacgtcatcaaggagggcaaatacctgcgcatcaccccgctgggtcaggtggtcaacgacctgatgtgccagcgcttccccgatattgtggacgtgaagttcaccgcccgcatggagaaaaagctggatgatgtggagtccggcgatgtccggtggaaggacctgatccgccagttctacgtaccgttccacgagaatctggaaaaggtggaaaaggacatggagggcgtgtacctgaaggtgcccgacgaggtgacggaggagaagtgcgacctgtgcggccgcaacatggtcatcaagtccgggcgttttggccgatttctggcctgccccggctatccggagtgcaagttcaccaagccgctggtggtggagatgcccggacgctgccccaagtgcggcggacgcatcctgaaaaagaccagccgcaacggctacacctactacggctgcgacaagtttcccgcctgcgacttcatgacgtgggacgtgccggtaaaggacgactgccccgtctgcggacagaccatgttcaaaaaggcgggccgcggcttcaataagcccttctgcgccaatcccgcgtgcagcaacttcctgccggaggataagcggggctatcgccgccgcaagcccgccgaggacggcgaaaacgccgccgagaagacggcggaaggcgctcagcccgccgagacggccgccgagaagcctgccaaggcggccaagaccacgagggcggccaagaccaccaagaccaccaagaccaccagaactgcggcggccaaaaagcctgccgcgaagaagcccgccgcaaaaaaaacggcggctaagaccaccgccgccaaaaagaccacaaagaaggctgcggagaaaacggagtaa

SEQ ID NO: 1971 - DNA, 2091 bp, Unknown
  Artificiall/Consensus sequence
gtgaaatttcagaagtggcatattgctgacgcacatcctcaggcggcggagcgcctgaaagcggcaggctatccctgtctggtgtcagaggtgctggcctcccgcggcattgagacggcggagcaggccgccgcgtttctggagcatgagcagcgtctgacgtacagcccgttcctgatggccgacatggataaggccgtggcgcggctgcagcaggcgctggccgcgggagagcgaatggccgtgttcggcgactacgacgtggacggcatcaccgccacctgcatcttagtggactatctccagagccgcggcgccgacgtgctgcactatatcccccgccgcatcgaggatggctacggactgagccgtgatgccatcgagaacctgtaccgccagggcgcccgcctgctgatcaccgtggactgcggcatcaccggcgtggaggaggtggacttcgccaactctctgggcatggatgtgatcatcaccgaccaccacgagtgcaaggagacgttgccccatgccgccgcggtggtggacccccaccggcccgactgcggctatcccttcaagcatctggccggctgcggcgtggcgctgaagctggtgctggctctgggcgggccggacagggaggaggccctgttctcccgctactgcacgctggccgccatcggcaccgtggccgacgtgatgcagatgtccggcgagaaccgtaccatcgtgtcccggggccttgccgccatcgaccactcctattttatcgggctccacgcccttttgaaggaggccggcctggccggccgggagatcacctccgtgcagatcggcttcgtgctggcgccccgcatcaacgcggcgggccgcatgggcgccgccgacaaggcggcggagctgctgctgtgtaccgatccggcggaggcggagcgcatggcccgtgagctgtgcgctctgaaccgcgagcgccagaacgtggagcagaccatctactcccaggcggaggagatgatcgcccacctgcccgaccgcgaccgcagcgcgctggtgctggagagcagccgctggcatcagggcgtggtgggcatcgtggccagccgcctttccgagaagtattcccgccccagctttatgatccacctgaacggcgccaccggcaagggctcctgccgcagctggggcggcttcaacctgtttgctgcgctggagagctgcaaggacctgctgctgggcttcggcggccacgagctggccgcgggcttcaccatccaggaggagaatatccccgccttccgccagcgcatgaacgactatgcccgcagcttccgcggcgggcaggctcccgtgtccgagctggacgtggatgtggccatcacccacccctccgcggtgacgctggaggagctggaggctctgtccgcgctggagccctacggcagcggcaatgcccgccccgtattctgcctgctgggcgccacgctgctgcgcacccagaacgtgggccagaaccgccacctgaagctgcgcctcggcaagggaagcgcccagtttgacggcatctttttctccaccgtggccgaggactgcggctgccgcgccggtgaccgcgtggatgccgccttctatttgcagatcaacgagttccgcggcagccggacggtgcagctccagatggtggacctgcggccgtccctgtaccccagcggacgggagcaggaggggcttgcccttgcggaccgctgcacggcccatcagtccctgacgatacgagacgcccgccgcctgctgcctacgcgggatcagttcgccgccgcatggcgctttctggagcacacggtaccggagcccggcctcaccaccggctatctcccgctgctgcgggcggtggcggcggagctgggcaaaaccgagccgttcccccgggcgtccctgtgtctggaggtatttgccgagcggggacttttgaccatggagcatcaggacgataacgtgaccatccgcctgcaccgcgggaagaaagtggtgctgtcggagtcaccccatctgctgtggctccgccagatgacggagaagggaggcactgtacaatga

SEQ ID NO: 1972 - DNA, 1101 bp, Unknown
  Artificiall/Consensus sequence
atgaaacgaaatatgctggccccgcttatcgccatctgcgtcattctgctgggactgtcggtggggagcttcttcttcacgccggatcgggctttttccgagaatgagaaccgctatctccagaccacgccggagctgacggcggacaatgtgctgtccggcaagttcatgacggaggtggagaactacaccagcgaccagatcctgctgcgggacttctggaccggcgcacgctccgccctccagcggctggaggggcggcaggacatcagcggcacatatctgggagcggatggccgctactttgccaaggtgacggacgataccttcaactgggacaactaccagaagaatctggcggcggtggagacgtttttcaccgccaacgatggtaagcgctgtacggcgctgatcgtgcccagccccgccggtgtgctgcgggacagtctgcccgaggacgcgccgtattacgacgaggacagggcgtttgccatgctggaggagcatctggggacggcgtttgccgatgcgcgtcaggcgctggccggtgtggccgacccctactaccatacggatcaccactggaccacggcgggagcacaggcggcctaccatatctgggcggaggccacggggcacaccgcccgcagctatgcgctggtgcaggccacggaccggttccgcgggacgctgtactccaaggtgctgctgccggacagcgtgtacgacgaggtggactactgtcccgacatcaccatcgagtccgccgactgcgacgggacggtgacggattcgctgtacgacatgacggcgctggagaagaaggacaagtacgagctgtttttaggcggcaactatgccaaggcggtgcttcgcaccggcgtggagaacgggaagcacctgctgctcatcaaggactcgtttgccaacagccttgtgccgttcctgtgcggcgactacgagaccatcaccatggtggacctgcggtactgccgcgagaagatacagccgctggccgatgaggccgacgatgtgctggtgctgtacgagatcaccaacttcgccgccgacggcaatctgttcaagctgaatctgaaatga

SEQ ID NO: 1973 - DNA, 1080 bp, Unknown
  Artificiall/Consensus sequence
atgaagatcacgattctgggcgccggcaatatgggctgcgccaacgcggctgacctgacactgaagggccacgaggttacgttggtcaaaacttcccactccatgcacaacgagacgttcgactacgtctgtgcccacaacaacgagatcaccctctggcaggagggagaggagcagacggcgcgcatccacgccgtcaccactgacctgtcctctgtcaccacggcggacctggtctatatcaccacccagaccaacgtccacgagcagctgatccagcgcatcgcgccgctgctgcggaagggccaggtggtgcttatctccccgggctacttctccaccgcctacttcctgagacactgccccgataaggatctgaccatcatcgagggcgagagctccaccatcgactgccgcgtggacgataccggcttcgtgcgggtgggcttccgcaacgtccgcaaccccgtgggtgtgtaccccgtggagaacctgcccaaggtcagggacatgctggagtccatgcagttccactatgtctacctgtcctccgtggtggaggccgccctgcataaccccaacatgatggtccacacggtgggtgcggtgatgagcatcccccgcatcgaaaagacaaagggcgactactgcatgtactgggaggtctggactcccagcgtttaccgtattctggatcagctggacaaggagaagatggacgtgctggagcatctgggctacgagcgcctgaactacttcgacgcctgcaagtaccgcaacagtctggacgattccatcgacgcccgcgccgtgttcgaggagtacgccgcctcgccgtaccgcgctaagggccccgtggtggtggattcccgctacatctccgaggacgtgccccagggtctggtgatgctggaatctctgggccggcacctgagcatccccacgccggtgtgtaccgccctcatcgagatcgcctccgccgcactgggccgcgacctgcgggccgagggccgctccatcgagcgtctgggcgcggagaacatccagaaggtctttgccaactgccaccacacgttctga

SEQ ID NO: 1974 - DNA, 1044 bp, Unknown
  Artificiall/Consensus sequence
atgggcaagatcatcctcaccggcgaccgtcctaccggacgcctccacgtaggccactatgtgggctccctgcgcaaccgcgtcgtgctccagaacagcggccgcttcgagaagctgttcttcatgatcgccgacgcgcaggccctcaccgacaacttcgaccatccccagaaggtccgcgacaacatcatggaggtggcgctggactatctggcctgcggcatcgaccccgccaagtccaccattttcgtgcagtcccatgtcagcgagctgacggagatgacgttttactacatgaatctggtgacgctggcccgcctggagcggaaccccaccgtcaaggcggagatccagctccgcggcttcaaccacagcattcccatgggctttttgacctaccccgtcagccagacggcggacatcaccgcctttatggccgacacggtgcctgtgggtgaggaccagctgcccatgctggagcaggcccgtgagatcgtccggcgcttcaacgagctgtacggtgagacgctggtggagcccacggcgctgctgccggataacgccgcctgcctgcgcctgccgggtaccgatggcaaggccaagatgagcaagtctctgggcaactgcatttatctggccgacgagcccgatgacatccgcaccaagatcatgggcatgtacaccgaccccaatcacctgatggtgtccgacccgggcaacaccaaggataaccccgtgtttatctatctggacgccttctgcaccgacgagcactttgcccgctacctgccggagtacgccaatctgggtgagctgaaggctcactacgaacggggcggtctgggcgatgtgaaggtgaagaagttcctgaacaacgtgatgcaggagacgctggagcccatccgcacccgccgccaggagctggccagagaccccgacgccatcatggagatcctgcgcgccggcagcgagaccgccaaggccgcagcggcccagacgctggacaagatgaagcacgccatgatgatcgactatttcgcataa

SEQ ID NO: 1975 - DNA, 1368 bp, Unknown
  Artificiall/Consensus sequence
atggaaaatcaaaagaagatgcagttctatggcggccccttcggcgcgtgcctgccgctgttggtgttcatggcactgatgatcaccattgcagccctgcagaaggtctctctggtcctgttctgcatggcgggcttcgccggtctgtgcacagccttcctgcttgccaaggacaagaaggagtttgagaaggcagtggtcgcgggcctgaagaacgataccctgtgcgtcattatctttgcctttctgctggccggcgtcctgtctcaggagctgcgccagagcggtctgatccagggcctgacctggctggtgacggagctgggcctcagcgccggcttcctgccgctggtgggctttatcatctgcgcactgatctccacggcctgcggcacctccaacggcgccattgtggcggttctgccggtgctgctgcccgtggccaccaccgtgggcgccaatcctgccgttgtggtgggcgctatcgtcagcggcgccatcttcggcgacaacctggcccccatttccgataccaccattgcctctgccctgactcagggcgctgaggtccgcgacgtggtccgcacccgtctgccctactccctgatcgccggcgtggtttccgccgtcctgttcgtcatcatcggcttccgcacctccgaggccgtgaccctgccggagctggtggacgcctcctacgccaagaccctgatcatgctggtgatccccgtcatcatgatcatcctgatgctcaagggctggaacctcatcggcactctgatcgtctgcgacctggtgggcttcgtgctgtgcctggtgttcggcttcatcgagcccgccaagatggtggacgccgccggccccatcggcgccggcctcaccggcatgctgaacgtcatctgcttcagcttcttcatgttcgccctgctggagatgcttacccgcagcggtgtgtttgacatcatgctgggcaagctgcacaacgccagcaagaccccgcgtcaggcggagctggtcaccatcctgatctgcttcgtgggcagcgtggctatcggcgcggcctccatcaccatcctgtttgtgggcccgctggtccgcaagctgctggagacccacaacatcgagcgtacccgcggctccaacctgatggacggcatcagcaccggtttcgccggtctggtcccctacaaccccgtgtgcctgaacgcggtgagtctggccatcgccagcggtgtggtgggtgagtccttctccttcctggacttcatcccctacaacttccagagcatcatgctgatcgtcctgttcaccctcagcgccatcaccggcgtgggccgccgcttcgacaagccccaggctgccaagtaa

SEQ ID NO: 1976 - DNA, 1467 bp, Unknown
  Artificiall/Consensus sequence
atgctgtaccatagtacccgtaacgccgacctgaccgctccctccacccacgcggtgctggagggcatcgcccccgacggcggcctgtatatctgtgatcccgcccagctgcactttgactggcagggcgctctgaagctggacaccatggacatggccgcgaagatcctgtccgcactgctgccggacttctccgatatggatgacattgtccgtcggagctatgccggcaagttccccaccatggacctgaccccgctggtgcccgtgggcggcagctatgtgctggagctgtaccacggtcccacctccgccttcaaggatgtggccctgtcggtgctgccccgcctcatcggcgccgccgccagggccgagggcatgaccggcgacgtggtcatcctcaccgccacctccggcgacaccggcaaggccgcgctggagggtttccacgacgtgaagggtacccgcatcatcgtgttctaccccgagggcggcgtctccgccgtccagcaggcccagatggccacccagacaggtgacaacgtgaaggtctgcgccgtccgcggcaacttcgacgacgcccagaccggcgtgaagcaggtgtttgccgcctgtcagggcaaggatcttcacggagccatgctctcctccgccaactccatcaacatcggccgtctggccccccaggtggtgtactatttccgctcctacgcggatctggtcaaaagcggccgtatccgggtgggcgacaaggtgaactacgtggtgcccaccggcaacttcggcgacattctggcgggttattttgccaagtgcatgggcctgcccgtgggccgtctggtctgcgccagcaacgccaatgacgtgctgacggagttcatctccaccggccgctacgaccgccgccgccccttctacaagaccacctccccctccatggacattctggtgtccagcaatctggagcggctgctgttcctgctgtcccgcgaccccgcctatgtggcggagctgatgcgtcagctgcgggaggacggcgtctaccagctgtctgaccggctgctggcccagctgaagcaggacttctcctgcggctgctgcgacgacaagggtgccgccgatgtcatcggccgcctgtggcgggagcagcactatctctgcgacccccacaccgccgtggcctggtccgtggcggagcagctcagcgaagaactgcatgataccggtgccccgacggtggtgctgtccaccgcctcgccctacaaattccctgctgcggtgctgtctgcgctgggccgggagacgggcgaaaatgagttcttcatgatgaacgagctttgccgcatttccggcgtccccatcccccggaatctggcagggctggagggccgtcccgtgctgcacaaggacgtgatcgacaaggatgccatgctggactatgtgctggcagaagtactgaaaaagtga

SEQ ID NO: 1977 - DNA, 1035 bp, Unknown
  Artificiall/Consensus sequence
atgaaacgaattaccatttatgatgttgccaaagaagccgatgtctcattggcaactgtatcacgtgttattaatgatagtaatgtagtgcgtgaagatacacgtatgcgtgttcaacaagcaattgaaaaattgggttataaaccaaatgcgattgcgcaaggtttggcattgtctaaaactacgacaatttcaatcgtcatgagcgaaaaattgtttgcgtacaacgcaaaaatcttgaatggtttgatggatgtcgcaaaaatctataactacaatatcatgttccatacaacaagtaagggaatttcaaaaatgcaggatgtgattgaatctattattaaatcacgtgtcgatggtgtcatcttgtttaacgacaacttctcagaagatgaaatggaagttttacatgaataccaaattccaatggttgtagttggaagtaaattaaaaggccaaaagattggtaacgttggaaatgtatatatcaacttcgaacgtatggcttatgaatttgtgaatgaatgcttcgaaaagggcattgatgatatctctatggtagaagataaattgaatctttctatgatggaacaattaaaagcgggtgtagatcgtgcttatgcagaaaaaggaatggtatttgataagtatgttacatacgatgatagctacaaatcaagctacacattcttatccgactactacaagaaccacaaaccaagtcgtatggtcattacattccgtgactctcaggccatcgctttaatgaacgcatgtaaagaaagcggatattcaattccagatgatacagaacttgtatgtatcttgaactcaaaatatttgacaatgatgcgtccaacaatttcaacttacaacattcctgaatacgatctaggagctgttgcgatgcgtttactaactaagatgttagtggaagatgagtctgttaaacagaacaaagatattgaaatttcattctcaaaattatttagagaaactacaaagggcgcaataaatttggatggggttaggtga

SEQ ID NO: 1978 - DNA, 738 bp, Unknown
  Artificiall/Consensus sequence
atgaaagtttttgcgaatacagatgtaggtcttgtaagacaattaaatgaagatgattattgcatcgctcataatgccaatgatgaatggatggccattgtctgcgatggtattggtggtgcaaaagcaggagaagtggcgagccatacagcggtaatgacgatgtatgaagcatttatgaagtctcctgtatttaaaaaagatcgtcaagtcgacaactggattcgtgaaaatttaaatcaggcgaatgatttcatttattcaaaaagcttaaagaatcccaatgaaagaggtatggggactacggcagtaggtgtcatcaaagctcatattgggacatttatttttaatgtgggagactcaagaatctatgcagattataataatgaactgattcaaatgagtgaagatcatagtgtcattgcccaattattaaaagagggtaagatcactttagatcaggcaaagtctcatccacaaaaaaatacattaacaaatgccttaggcgtatggcatgttttccgtattgatatcaataagattgaaaatacatacaaatatttgttggtttcaagtgatggattacatggatatgttgaaaagaaagtgatttcggatattgtacatgattcgagtctttctttacaggaaaaaacagaaacactgattgccagagccaatcaatcaggtggttatgataactgtacagttatcttaatggagaatgatggagaataa

SEQ ID NO: 1979 - DNA, 1356 bp, Unknown
  Artificiall/Consensus sequence
tgcagtaggtattcctgcaagaattatagagaagaaataggtggttgtatgtggaaatatcgttgtaaatcccatttaatagctttagttgtagcttttttagttggactttgtttaagtgcggttgtatttgcgagtggtatagacatgagttcggatatgttgtcgagttcattaagttctgtgccaggtgtagatacagaatcactgaaacaggttttaacgtatctacaaaataatatgtggatcttatatgtaggtgatgccttattgatttcaggaatcatcaatatcatttatattggacaatatgtaacatcgcgatttaacatcagcccatggatcgttatgtgtttgattttctttttacctgaatacatgatctatataggtgccatcttggttgtgcctgcatttgttgtatgtatttatggaatgttaagtttgcgcaaaagcatttcgaaagaacgtcgcgaatttaattttacaagtgatgatgaattggttcgtatatataagattcatcatgaattggatgagtcttataaggatctcgcaaagacttgtcgtaaaaatgtgcgtaaattaacaggtatttatgcgttaggtattgttgccctatttgcgattttaattgccgtaaataacatgatgcttctagctgtattgttgatgttctacttatttgcgtttaatttagtgttacgttatcgtgctgtatcacttttaccaatcacaaaattattatatgaagattgtaatcctgaggcttgtgcgagtgccattatttactattgcacaaattcaaagggacatacacgcttgagccagcacacattgcttgcacaatgcttgatttatttaaatgatgctgaacttgctcaagatgtattgatcagttatccgcgtaaggatgcatcgagttctttacaatattggtcattgatgtcttacatctattatatgttgaaggatgaagaggctttatctcgttgtaaagaagaggcacaaaatattcgtcttcattatggacgtgcgggtgtcatgattcaaagtgaagaaatggcggccattgaaaataaaatccatctaatggatggggatttgaatacttgtaagaaatattatttacaaggtctacaaagagcaaattttcctttccagcaagtagattcatgttactacattgctctgatttcatttgtagaagaagattataaattggctcgcttgtattttgaaaaagtacttgagctcggaaatcgtatgtattttgtgaaaaaagcgaaaaactacttagataagattgaaaagatcaatcctgaaacatccagtgatgaagtagaatattcgtag

SEQ ID NO: 1980 - DNA, 561 bp, Unknown
  Artificiall/Consensus sequence
atgaaaattattattggattagggaatattggtagagaatatgaaaatacgcgtcataatgcaggctttatggcgattgataaattggcacaaatgctagaaatggattttaatcaggaaaagttttcggcttattttgcgaaaaagaaaattgatggagaagacataattttattaaaaccaaccacatatatgaataatagtggtatcgcattaagacaatgcatggatttctataaagtgccttctgaagatatccttgtattatatgatgatatggatatgcctgttggaaaacttcgtttgcgtcaaaaaggtagtgctggtgggcataacggaatcaagagtattatttctcatattggcacacaggaatttgatcgtattcgcataggaattggtaaagataaattaattccagttgtagactgggtactgggtaaattccctcaagaacaacaagaggatttaaatcatgctttagaacaagccgcgaaagcagctaaattttcaataaaacactcttttagtgacacaatgaataggtataataagaagtag

SEQ ID NO: 1981 - DNA, 1614 bp, Unknown
  Artificiall/Consensus sequence
atgaaacaaaaaattaaagttgcagatttagcaaaagctttacagggcattgaaacagatcgtcaattaacgaaagaaattgttgaagatgctttaaaagaagctttgacaaaggcttaccgcaaacacatcgaaattccagatgcttatgttcgtgtggatgttgaggatggaacgattcacatttatcacgagcgtatggttgttgaagaagtggaagatgatgaattagaaatcgaattggaagaagcgcaaaaagaaaatccaaacattcaattaggtgatatggttggagaagaagtagattttacggattttgatcgtgcggctgttgtacttgccaaaaacgtaatgaaacaaaagattcgtgaagccgaaaaagcattggtttacgaagaatattgtgacaaagtggatgaaatggttttaggaacgattgaaacagttgaagaaaaattcgtcattgtaaatattggtaaaacatttgcgatgatgaaaaaatcagctcagattccaacagaacattataaggaaggcgacaacatcttagttgtgattactgaagtcaacaaagaaacaaagggtgctcaagttttagtttctcgtgcaactccagtatttgttcgtcgtttatttgaacgtgaagttccagaaatctacaatggaattattgaaattaaagccattgctcgtgatcctggtgaaagatgtaagattgccgtttattcacacaatgaaaatattgacccaattggagcatgtattggtcctcgtggaagtcgtgtacaaacaatcattgaagaattgaatggtgaaaaaatcgatattttcgaatggtctgacaacattagtgagttaattgcgaatgcattaagccctagtgtgggtgttgcggtgattccaaatgaaaatgtaaaagatggattgattgttgttgttccagataaccaattgtcattagcgattggtaagcgtggtaaaaatgcgcgtttggctgttaaattaacaaatcacaagattgatatcaaatctgaaagtgaaatgcaggaattgggtattgattacatggctattagtgcaaaaatgcaagaagaatacgaagaaaagaaagccaaagaacgtgcttataagcaacaacagaagattgaagaattaaagtcaaatgaaactgaaatcgaaaatattgatgtagctgattttacttatgaagatgaagaagtggatgctgctgaagaacattctcaagatactttatttgaaaaagaaaatacagttgaagaaaaagaagtcgatgaaatggaagaattggctcgtattgcgaaacaaaatcgtaaagaaaagacagctgccgatgtcaaagaatacacttctaaatttgaatctttggcggatgcttcaaataaacaagaggagcctcaagtttctaaacctaaaaaagaaaagattgaggaagaaaagaaaccagttgaagtaaaaaaattcaactacgaagatatgaaaccaatctattcggaagaagagttggctgaaatcgaagaacaggaatatgaagatgaaaatgcctgggatgatgatgttgactatgaagaatatgacgaatattatgatgactag

SEQ ID NO: 1982 - DNA, 795 bp, Unknown
  Artificiall/Consensus sequence
gtgaacggcgatagtatagcttgtcaaaatctaagtcttgaatataaggcgctcgcttctaggcctctatcttcaaaaaatccgacaattaatgaaaggcaatatcgcatcgcaaaagaaataatggatattgcgaattatttatcgaagagcgcatctttaattgagtcttgcgagtacaaacaaagtgcttggaaacctggaaaggtgaatttgatcaagtatacaaacttgaatttagtttcacaattgacaaaacagagtcgctattcgtacggttcgattcgttatacaaagtcatttaaagaatggaataaaaattacacaaagccttatttccatgtaggggccaatgccacacttcttgatggagaaattaaatcgagtatcagtgcaagaatatggaagaacaagaaatttgatccgcgtatagtattaaatgcagagtcaagtctagcgttattatcttctacagtaaatgcgcgtattggaaattcaaaagtctatgcgagcgctcgagcaacagggcaagttggtgttgcgtatgcgtcttgtaaagctgctttttctaggaaagaacagtcgtttgaagctggagttggtgttgcagccttacgaggcgaaacacgttgtgtattgaacattcttggggcgaaagtcactttaacggcacaaggaagtgtaggtagtgcagaggctaatttctcttatcatttttctagcagggagtgggaaatcggctcaaaacttggctttattgcgggactgggctttaaaatcaacgtaagttattag

SEQ ID NO: 1983 - DNA, 1737 bp, Unknown
  Artificiall/Consensus sequence
atgaatggtctattattattagctatcgctgctgcattattacttacagcttacttagtttatggacgttatttagttaaaacatggggaattgatccaaaagctaagacacctgcttatgaaaaagaagatggagttgattatgttccaagtaataaatgggaagtatttggacaccaattctcttcaattgccggagccggtccagtaacaggtccagtacttgcgatggtatttggatggttacctgcatttttatgggtaatggttggaggaatcttctttggtgctgtacaagattttggcgctctatacgcatctgttaaatctcacggtaaatcaatgggacaaatcattgaaacatacattggtaaaacaggacgtaaattattcttcttgttctgctggttatttactttattagttattgctgcatttgctgacatggttgcaggatcattaaacggatacaatgctgctggtgcacaatctttacctagtggagctgctagttcaatcacaattctatatgtatttgttgcgatcgcatttggtttcttcttaaagaaaacggggctttctggatggaaacaagcttttttaggcattgcactaatcgtcgctatgttagcattaggaatcgcattccctgtttacttcactaaacaaacttgggtatatctagtattcgtttatatcttctttgcgagtgttacaccaatctgggtattaaaacaaccacgtgactatttgactacattcttattcatcggaatgatcgttgctgcagttgttggtgtatttgtatcaaatcctacaatcacatcacctgcattcacaggatttaaatctgcaacaggaagctatatcttcccaacattattcgttacagttgcttgtggtgctgttagtggattccactcacttgtatctagtgaaacaagttctaaacagattcgcaacgaaagtgatatgttacaagttggatacggaagtatgttgcttgaatcattacttgctgtacttgtaatcgttgttgttggatctttaactagcttagctagcaaaggcgtattaaatgaaacattatcttctatggcctttgctgatactgcaactccatttattaaattttcagttggtgttactggattgatttcccaatttggatttcctcaagaatggggtctatgcatcatgacaatgttcgtttctgctttggcattaacttcattagatgctgttgctagaatcggacgtttatcattccaagaattatttgaagtcaatgaagaagctgaaacaaacagtgttgccgctttcttaacaaataaatatgttgctacattgatcacattagccggtggttacctattaagcttaggaggatatttaaatatctggccattattcggtagtgctaaccaattattagctgcgatggtattagtttcattatctgtattcttaaaagttacaggacgtaaaggatatatgttatatgtaccaatggttatgatgttagttgtaacaatgacaagcttaggaatgtcagtatacaacatctgcttaaagttattcgttactggcggattcgtatttatgacagacggactacaattattctttgctgttctattaatggcattaggattgatgatcttcattggttctggaaagaaattagttcaacctgttgaaaaggcaaaacttcaagaacaagaacaaaacgcataa

SEQ ID NO: 1984 - DNA, 732 bp, Unknown
  Artificiall/Consensus sequence
atgaaagtagtttggatgtatcatgatatcatggatctttatggtgataagggaaatatgatggttctaaagaagcgttgtttagatcgtggtattccttttgtactcgatacttgtggtattggtgaagaaaaagatttaagtgaatatgatttgattttcttaggtggtggtgcagataaggaacaaattagtttaattccagatttattatctcgtaaagaaaatataacgaaggccatagatgaaaagacctttgtgcttttgatttgtggtggttatcaattgtttggtcaatattatattgcggccaacaatgagaagatttctggtttacagttctatgattattatacggatacgggaaaagctggtagtcgttgtattggaaatgttgtgattgatgcaaatttagatggtttaaaaacgcgtatcgttggttttgaaaatcatgggggtcaaacattaaatgtaacgcatcctttaggaaaggttgtgaagggttgtggtaacagctttaatgcaggttatgaaggattctatgatggaaagattctaggtacctatttgcatggtcctttacttccaaaaaatcctgaggtggctgattttgtgatttcaaaagcactacaaaaaagaaatccggattttaaatatagtgatttaaagccattggaagataagtttgaaaaaatggctcgtgaggctgtatttaagaaattagagatataa

SEQ ID NO: 1985 - DNA, 543 bp, Unknown
  Artificiall/Consensus sequence
atgaatgacatggatgaaaaacaattaattgatgatttagaaaaagaatcgatgctagagcttgaagtaatgcatgaatccgaaaatacagataatgaaagaattattgaggatgccaagagcaaaatcgaaaaattattcgatgatgtgcgtgacttattaaaggatgcttcagatcctgaaaaggttaaggaagcattatcgcaggcaaaagaagatgcgaaagatattctttcttcgacaaaggataaagtggttgaagtaagtgaaagtgaacaatttaaacagacaatgtcagctggaaaagaattcttacagggtacagctggattggttgttgagggctttaaatatggaaaagaaacattaagaaaaaatgattctttgcgcaaggtaattgataaggctgatgaaaaagtcgatgaaattcgtacgaatgattctgttattcgtgccgttgataaagcagaagaagtaacgggtaaagctaccgaagcattgtttagtggattaaagaagatttttaataagggggacgaatag

SEQ ID NO: 1986 - DNA, 1365 bp, Unknown
  Artificiall/Consensus sequence
atgataaaatacactaagaaagaaaggatgttaacaatgtttgaaaatacaattgcagccatctccacttctttgcaggatggtgccatttccatcattcgtttaagtggtgacaaggctattgaaatcacgcaaaaaatatttgaccgtaatatcatgaatgcgaaaagtcataccattcattatggttttattatagataccgataaaaatcctgttgatgaagttttaatttctatctttagagctccaaaaacatatacacgcgaagacattgtcgaaatcaattgtcatggtggtacttttattactcgtaaaatcttatcgatggtattaagtgctggagcagatctggcaaaacctggagaatttacgcaacgcgccttctatcatggaagaatagatttatcgcaggctgaagccgttcaagatatgattgaagcaagtaataataccgcagctagtatggctattcatggaattaaaggaagtgtaaaaaagctactacagcctttgattgatgatttaatggatattattgcgcagatcgaagtcaatattgattatcctgaatatgaagatgtcgaacaattaacgacgaatgatttacttccaaaaactaacgaatggttaaccaagattgatcgtattcttgctcgtgtacagacgggacaaatgttaaaaaaaggtattgatacaatcattgtcggtaagccaaatgttggtaaatccagcttattaaatgcacttcttgaagaagataaagccatcgttacagatattgcggggaccacaagagacttggtggagggtcaaattcatattggcagtgttcaattgaatttaattgatacagctggtattcgtgaatccagcgataagattgaacagattggcattgagaagagtcaagaaaaattaaaagatgccaagttggttcttttagttttcgatggttcaaaagagttggatgaagaagataaacaattgttagaactgacaaaagataagatgcgtttaattatctacaataaattagataaagccagccccaatgaagatggtatttggatttcagctgccaataaagagatccaacctttgattgatgccttggaaaacttgtatcatgaagatttattaaaggaagatccactactttcaaatgagcgtcaaattggtttattgaatcaagccaaagaagatatgttaagggcgaaagaagccatggatatgatggtagaacctgatttaattgagattgacattcaggctgctcatgatcatttaaaagaaatcttaggtgaagttcatagagaagacttgttggatacattattttctaaattttgtttaggtaaataa

SEQ ID NO: 1987 - DNA, 948 bp, Unknown
  Artificiall/Consensus sequence
atgaaaaaaatagtcgtaattggtggaggtacaggtctttcaagcatgttaaagggtatgaaacgtttggaagatgttgatttaacggccattgttacagtagccgatgatggtggcagtacgggacgaattcgtgatatatacaatattcctgcagttggagatattcgacatgttttatgtgctatggccgatgaagaagatgaaggctttttctcggatttgctgaattatcgttttgaaggaagcgaagatgtgggtggtcataatttaggaaacttgattttcttggcaatgatcaatactacaggctcatttatgggagctattgaatcaatttcaagagtattaaatgtgaagggaaatattcttcctagtacattggatgttgttacattatatgcaatgatgaaagatggcacgctggttcgtggagaaaaaaatatcccaacggtatacaacagtatcgatcatgttttttatcagaagtatgtgcatgcatataaaccggctattgaagctattaaaaatgccgatttgattatttatggaattggatctttatatacttcaattatgccgaatctaattatttcggatatctcgaaagctattgaaaagaacccttgtaagaaaatctatttttgtaatgccatgtctcagcctggagaaacagatggatatacggttcaggatcatattcatgcaattgaaaaacattcatttaaacatccagtagatttagtggtggttaatcagtcgatgttacctaaggaagttttagatatgtatgcttcacaaaatagttatccaatttgtattggaaatgaagcaacagactatgctattatacaaagagatttgttggcgttggatacaaaaggtcgtattcgtcataatccaatggctgtcaaagaagttgtagaagaattgatcaagggggtatag

SEQ ID NO: 1988 - DNA, 765 bp, Unknown
  Artificiall/Consensus sequence
atgaatggttatttttttgatatggatggaacactttataataacaggttccatgaagtgagtgagaaaacttttaaaatgttaaatgaactacaaagccaaggacactttgtagctttatcaacgagtcgttgtcaatctgaattaaagaatcttccttcttgtatgcgttcatttcaatttgattgtatgatcagtgatggtggcgctttgattttgaataaacaaaaagagattcttgaaatgaattgcattccaaaagaaacaatgagaagtatagatcaattttgtaaggaacgaaacttggaatatcgttacagtacgcgagggggaaattattttggtacgccatattctagttttgcgcataatatatactttgaattgtatctgaacagtccagtttataaaccttataaagaggatgaagtgttgaatgttttacttttttgccaaggagaaacaaaagaggcgttaagacctttgatcaaggatttagggtatgttgaatatccggattgttttgaattgcgtgcgaatcaagtagataaggcaacggctgtgaaaaaaatcatagatgctcatgcttttgaaacaacgtattgttttggggatggaaccaatgacattgatatgttgaagcttgccgacgtgggtgttgcgatgggcaatgcgtgtgatgcattaaaagaagttagtgatgttgtgattggaagagtggatgaggatggcatctacaattacttaatggaaaataaaagctga

SEQ ID NO: 1989 - DNA, 1059 bp, Unknown
  Artificiall/Consensus sequence
gtgcgtgaggtacttattttgattagtaaaaaagaattgcgagcacgtattttattgattgtggtttgtctagcggtgggcttatattgtctatatagcatggataaatcgtatgatcctttagctcgatatccttatacaaccgatgaaaatcgtgatgttttattaaaatatctagatagtgatgatattgattatttggtaaatcaacatatttcaccggataaatttatggattttatagagttaaaagatttcaatttaaaaaatacgttatattataaagaagccaaggaaacgcaggatgcagataatgaatatatcgtcaattttgtgaatcgttttcgaaagaatttttcgtatgattctttaaaacaattgttgatgcactattcatatattgatttaacgacgttctatgaaaacgaagctgtgttgtattcggatttaagattgattgctgatccaaccaatccgtatgtcgtattaaatcaggaaaatacggtatataagtatataccagaaaagattacgacatttaatactatcttagttcaaacatgtatggtcgaagatctaacgaatatgttagattcgtatgcgtctgttatggatgggcaggatcatttgaatttggtcagtggttatttgaattatgaacaaattctagatcaatatgtcaacgcatccaaagaatatgagggtgttgaccactatatgtttagtgccggtaaaaatgagcagcagctcgggtatacgattgtattagagggtcataatgaatggatcaatctatgtaggcaatatgtcgatgatgaatatgattattcaaaagtcgaagaagaattgtctgaagaaagtaaaaagcgtatggaatggattgaagaaaatgcgtatcgctatggttttgtagttcgttaccaacaagaacaagaaaagaagacgggacattggtatcagccttttatgcttcgttatgtgggtgtaaaaaccgcaaaaatcatgcatgatagtggtaagggcatggaacaaatgtcatttccggatgaattggagtaa

SEQ ID NO: 1990 - DNA, 642 bp, Unknown
  Artificiall/Consensus sequence
atgtttaatttatcaaatattatttatcttgtcattgccgttgttctttccatgtcgattcatgaaacggcacatggacttgtgtcctattggatgggagatcctacggctaagatggaaggtagattgagcttaaatccttttaaacatgttgactggattggacttgtctgtctattagtatgtggatttggctgggcaaaaccagtacccgtggatgcacgttactacaaagatgcgaagacaggaatcatatggacaagttttgcgggtccaatcgcaaactttctattaagctttatttgtatatttttattttatgcactctataaatttgctccatattttatgatgtctagtgtaggatattttatatcgaatacattgacatatacaggattgatttcaactggatttggcatttttaacttgattccagtaccaccattagatggctcaaaagtattgttttcgtttttacccgacgataaatactataaatttattgatggtgcaccatggatgaatctattatttatcttattgattttttcaggtttattagattatccgttgggtatgttacgttcaaatatgattcaattttttgagatgattgcaaagatgattttaggtttctaa

SEQ ID NO: 1991 - DNA, 792 bp, Unknown
  Artificiall/Consensus sequence
cattttatgaacattctattttcaattaacgcaaaattcatagatttgacaaagacatgtatacgttccatcattcggtttgacaaaaatattgatttctatattttgcatcatgacttaaatcaaaaacacatggatgatttaagacgttcttttttggaatgtacttttcattttatagaagtaaaggaagaagaatttaaggggtttcctatttcatctcgatatcctctagaaatttattatcgattattcgcttcagatttgttgcctaagacattggatcgaattctttacttggatgtggatattgttgtgattcaaagtttaagggaattgtataacatggattttgaaagtaatctttatatcgcttcgagtcatgtaaatgagcgtatgacgcatttaaatgcgaaaagattagggctaaaagaagatgtgccatatatcaatactggggtcttgttgatgaatttagaattattgcgtaagcaattaaataagcaagatattttaaattatgtgaatgcatataagaaaaatcttgtactttttgatcaagatgtattgacggcattatatggagataagacaaaactagtagattatcgtaaatataatttgagtgagagaatgatgaatttctataatctaagaaatccaagaagtaggatagatcttgattgggtgaaaaagaatagtgttatcatacattattgcggaagaatgaagccttggaaaggtaaatatataggatgtttagattgtttttatagggagttggaaaaatga

SEQ ID NO: 1992 - DNA, 564 bp, Unknown
  Artificiall/Consensus sequence
aacatgattagttcaaatgatttaaaaccaggtcttacaattttagtggatggcgaaatctatacggttttagaagcatcacaaaataaaacagctcgtagtgccatggttgttaaggcaaaagttcgtaatgttcgtactggaagtaatgttgaattgtcttggggtggtggcgaaaaggttgaaccagctcagattgaaaaaagagaaatgcagtatttatatgatacagatgaagctatggtatttatggataatgaaacatatgaccaggttgaaattcctatggatcgtttaaaatgggaaagaaactttattgttccaaattcaaacgtaaatatttctagctatgaaggtgaaatcttaggtgttattttaccggataaggcaacattgaaagttgttgaatgcgaacaggcagtaaagggtgatacagctacaagtgctagtaaaaatgctgtattagaaactggattagaagttaaagttcctttattcatcaaccaagatgaaatgatcgttgttaacacaaacgacggaaaatattcaggacgtgcaaaatag

SEQ ID NO: 1993 - DNA, 870 bp, Unknown
  Artificiall/Consensus sequence
atgaaacaggcgattgcgacagtaaaaaagacaaaagagattcaagaaaagtataaggttttcacaaagaaaagctttggacagaattttattattgaacagggtgttgttgaaaagattgccaatgcagcaattcaatcaagagatgaattggtttttgagattggtcctggaattggggctttaacacagtttttatgtgaaaaaagtaatcaggttgtagcttttgagattgatgaaagattgccggttgtattagagaatgagattggttttgatcatttacagatagtattagaagacatcttaaaggtggatattgatgaaaagattcgtgaatttagaaagcctggtcaaaaggtagttttcgcgtcgaatcttccttactacatcacgacgccgatcttatttaaattgtttgaggcaaatgaagagattgaaagaattacggttatgatgcaaaaagaagtgggagaacgtttcttggcacacgaaaatgataaggaatacaatgcgttgagcgtaattacgcaatatcgttgtgatgtgaaaaaagtcatggacgtatcaagaagagtattttggccaagtcccaatgtagattcgatggtcattcagttttctttccatcacaagtatcatttagaagatgagaattatttcttcgatttggtaaaagcttgttttacacaaagaagaaaaactatttataataactttcagaattttgtgaaagataaggctctggcaaaagaattgttagaaaaagtaaatattgatcctagtacgcgtgcgcaacagtgtacgttagaagattttattcgattatatgaggtgacctatgaaagtacaggcaagggcaaaaattaa

SEQ ID NO: 1994 - DNA, 963 bp, Unknown
  Artificiall/Consensus sequence
gatgagatgtccgaatggattgaacaagatcacatggatgaaaaccacttgtatgttcatttgaaaaatccagaattactcgacctatccatttttgatcgattatcgaacgatgatttttgtctgccttgtatgttgacaaacgaaaaaacggcatcgatggtgtatgcgatagaaggctatattcctttacatgattttttaagtcagtatgtgtttgaaaaagaagaaggctatatattcttgcatcagttatttgaacaagccatcgcatccaatcgcaataaacccgttctatttgacccagactacgtatttgtctctagttttggagatcgctttgcgtttgtcgtggtgcccattcaaatatcgaactggatgtttcaaaaggatatgtcagaaaaatgggtggagtacatcgcaaaaacaatgcagactacaaccgcttttgaaattcctgggtttttattgaagtttttaaagagtgctgagtttagtttacctaatcttgtcttaggtctggataatatacgaaatttatattatccgaaaaagttttctttctttaaaaacaagaggatgcagacatttaaagtcaaagaacccatacaagctttccataaagagaagcctgttgaatctgttttggaagaaaaaacacagcttttacaagtaaaagtagatttttatgcctacttattatgcgatcaggaaaaatatgcattgtgcaacgaaatcaatctagtgggaagagcaatggtatgtgatgtccgtatacaggatgcgagtatatctttaaaacatgccaaaatcgtatgtgaaaatgatcggtactatatacaagatctaaagagtacgaataagacgtatctgaacgaaaaagaagtgaaacgtaagatgcgattaaaagatggcatgacgatacgatttggtgatgtcgtgtgtgaatttaaagaacaatag

SEQ ID NO: 1995 - DNA, 741 bp, Unknown
  Artificiall/Consensus sequence
atgtttaagtccaaacttgatttggacttttttaaaaaggaggtttttatggcaccaaaaacagtagctataattatggatggtaatggtcgttgggccaaaaaaagaggcttaccaagaacggcaggacacaaaaagggtgcggatacaattcgtactgtggccttagctgcacaagatatgggaattcaaaaattgattctatatgctttttcaacagaaaactggaaaagaccagaagatgaagtttcctatttatgtaaattaccaggactattctttaataaatttattaatgaattgatggaaaagaacattcgtgtaacttttgccggtgaattagaaaaattcccacaagcaacacaaaatgtaattaataaggctgtaaatatgactaaggataatactggattagaattatgtttagccattaattacggttcgagaagagaaatgttacttggtatgaaaaaatatgcggatgaggttgctcaaggtaaacgtgaaaacaatttaactgaggaagagttctcaaaatatttatttgtaccagaagatattgatttgatgattcgtacaagtggagaacttcgtatttcgaattatttgttgtggcaactcgcctatgcggaactgatttttacaccagttgcatggcctgattttgatgaaaaagcattaaaagattgtctagacgaatttgcttcaagagatcgcagatttggaggcttaacttcatga

SEQ ID NO: 1996 - DNA, 1074 bp, Unknown
  Artificiall/Consensus sequence
atggaggaaatgtatatgaattcaaaaattaaacgaattattgacttctcaactgcctttggaccaagtggcatggaagatgaagtatctaaattggccatggaagatgtcaaggatatttgtgaagttcatgatgatacaatgcgtaatacgtatatgcgctttaaacaagacaaagaacatgaaacaacgattcttttagatgcacatgccgatgaagttggttttattgtgcaagccatcaagccaaatggtacaattcgctttttaccattaggtggatgggatccaaaaaacattgtatctggcgaagtctggattcttaatgataaaggtgaaaagatttcgggtattgtcgcaagtcaaccggttcatttcttatctgaagaaaagcgtaatggaaaagtagattttgatgatttagtaatcgatgtaggcgcaacaagtgctcaagaagtaaaagaagaatttcatatatctgtaggtaacttcatgtgtcctgcagttacatgtaaatatgatgaagcacataagattttcttaggaaaagcctttgattgtcgtataggctgtgcagccgtaatggatgtactacaccaattaaaagatgtaagccacaacattgaagccacattaacaacacaagaagaagtcggcgaaagaggcatggacacagcaatcaaaaacttaaatcctaacattgcgatttgttttgaaggatgcccaagtgatgatacatttgaacaagactacatgattcaatctgccttgaaaaaaggtccaatgttacgttggtttgaccgttcttatatcacaagccctcgttttatgcgttatgcgattgatttggctcatgaaaaaaatattcctgtacaggaaagtgtaagaaaaggtggcggaaccaatgcaggaattactcaccgctataacattccaaccatcattatcggtattcccgttcgttttgcgcacgcttcttttggaatctgttctgaagaagattatgataatgctgtaaaacttgcggttgaaatcatcacaaacatcgatgctcaaactattcgaggattctag

SEQ ID NO: 1997 - DNA, 1515 bp, Unknown
  Artificiall/Consensus sequence
aaaaactatttttatatagttattatgttatattttgattataatgaatatataaaggagggcatttattttatgcttattcaagatgatgcgttacgtagtgtaattgcgcgtactttgcgtgttaaagaagaagaactaaacgaagatttgatgaaggaattgatccacttagaagtacaagatcatgaaatagagactctagaaggtttgcagtatgcggagaatctagaaactttaaatgcgagcaataataagttgcaaacattggatccaatcaaagatttacataatttagtttgtttaaatgtttctcgaaaccaattaagagatttgcaggctctacatggttttagacaactaaaaaaattaaatatctcaagaaacaatttatatacaatggatatttcaagtgttgctgctatgattaatttggaagtattgaatctttcaaaggcgaaagttgatagcttgatttatttagagcactgtaagaagttagaagaggttcatatcaatactgaaaatggtccttttagctatgccatcttaggtgtgcttaaaaaattaaagaaattggatatgggtggtatgcgtttattcaacatcgaagatttaacatatctttctaatgttgaagaattggatttaaacacaaacttaatgtcggatctaagtccattgttgtcaatgaaaaatttaaagaaattgaatgtttctaactgtccatatttaaaggattattctgtactaaaagaattttcaaatcttaaatctttgaatatttcctataatgaaccagaacactttacattcttgaaggaattaaatcatttagaatctctgtctatggaacagactggatttaaggacatgtctttattgaataacttgggtgatttaaaagaattgaatgtttcaaaaaaccgcttgaagaatttagaaaaattcgtaaatgttgagcatttggaaagtgtagatgcgaagttctgtcagttaacagaaatcaatttcttaaagaatgcgcgtcaattgaaacatttaaatttgttcacaaaccgcatcaaggatattcgtattttaaaggatgccaaagacatggtgtatttgaatgtgggtcgtaatgatattaaggatattacttgtttaaaggatatgaagcaattggaaatcatttctttggaaaacaataatgttaaagatttgacaccattaaaagaactaacaaacctttgcgatgtggatctatacaacaatgtcattgaagatttaacaccattagaacatttagagtttatttcttatttgcgtttggaccacaatgcgattacagatttaactccattatctaaacttaaatatttgcgttcacttactttaaaggcaaactacattacagatgtaactccattaaaagatctagaattattagaagctttacgtttggatgataatccaatccaggatacaagcgtacttgagagtatggagttctacgaaaaatttactaactaa

SEQ ID NO: 1998 - DNA, 1050 bp, Unknown
  Artificiall/Consensus sequence
tcatcaatgagtgcttatacaaatggtttagcgttctggaagcattttgaagaaaaacagggtgcaattattaattgtttaaaggccgaacaatatgaagaattaaacgaattgattcaagaattggatgaagaggtaatggaaattagtggtgcccatttctttgtcgaaagcttttatgattcttttgagatgacctttgacacaggtccaaataagacaacgcaatatttgtgtcagatgctttgtgacattgcacctaagagtgtgaaacaaaactggatcatgaatgcgactttaccgcctatgtcgcaaaaggcgattcaggccatggttcaaatcaaaaatgaggaatatactttagcagattttcatgtattctatcaaattgaaaatgatatgttggattgtaaagtatattgtcctggatttaatttgattggtaatccggaaaataaaaaagaaatgagtatgtatcttatggagcttgcgattggtcagcttgcgtatgaggcatatatttgtcgtgttgattttatcgatacgccagactcagatatgaagttctgtcaaatgattgatttttatgaagtgattatggctcttgttgagaagaatcattggaaagtatatgataagccaattgatatttattcggtatatcagccaattcaggattttgcgcacgatgccttaagaaaagatatgaagtttatttttactacgcatcctttattggtggaacaaacgattgaggaaaaggaagaagtgcttgcagatctatcgagtaaagatggtgagtttggctatgtgtattattcgaatcctttccataataaagaagatgctttgtatcgtcaaaaattatcgaaacaattggatgaaactatttctaaggtgcatgcaggtaaagtggttgggggagctattggtaagagcttttcctatattgactggattgtgtatgataaagacgtatttatgaaggtgtttaaccaattaaaaaaacagctcgatgcgagtgtcgaactgtattatcaaaaattttaa

SEQ ID NO: 1999 - DNA, 789 bp, Unknown
  Artificiall/Consensus sequence
gtggagctaaaaaatatgcttaatcgcaaggaagtacacaatagcgaaactttaaacattcaaattgattctcatgatcaaaaatcatatttaattgaattgagtaaagattgtacaaaatttgatttgaatgtggagtgtttagaaaattctttttcaaaattctttattttaaaccatgctgaaagtgcgtgcgcattaaacattaatatggtacttaaacaagatgccaactgccaaatgggtgtcttggatctagaaaaaagcccattgaaatggaatcactatgtggatctaaaagagcagggggctgaatatgaaattttaagcggtcaattatgtcaagaacacatcgaaaaagtatgcgatatggaagtaagacataatgcgcctcatacaaatggtcaaatgaaaaactttgccgttttatttgattatggacaatatcaaatggttgccaatggaaatattaaaaaaggatgtttcgatgctcagtctcatcaggcaacgcgtgtattaactttgggccagggacataagacaaaagttattccactattattaattgatgaaaatgatgtaaaggcaagccacgctctaacaattgggcagccagatgctgatcagctatattatctacagtctcgtggattgagcacaaaacaagctgttggattgttaagtgttggttatttcttgccagttattgatttagtagaagatgaagaattgaaagatagtcttcgtcaagaaatggaaagtaaggttggattatatggacatcagtaa

SEQ ID NO: 2000 - DNA, 537 bp, Unknown
  Artificiall/Consensus sequence
tatctccaactgtttattttagagaaggagataaatttacttatgaaaaaaggtaaaactacagtggcttcactattgattgtgttggtcactttgggactggatcaatggacaaagtgggctgttgagaagtctatcgcattaaatgattcggttgaaatgatcaatcatttcttttatttgacatatgttcgaaatacaggggcaggttttagtatgtttgcggaagctggaatgggtttctttgccgcacttaccattattgccttagttggtatggtatatatgttttttaaaacgaatgattcacgttatcagatttgtttatctttagttttttcgggagctattggaaactttatcgatcgtatgacgctaggctttgtaagagacttttttagtttctatatttttggctatccatttcccgtatttaatgtagcagatatctgtattacagtaggtatcgcattaatattagtaagtatgtttatagatgataagaaggagcaagcaagatggaaacaagaatcttaa

SEQ ID NO: 2001 - DNA, 849 bp, Unknown
  Artificiall/Consensus sequence
atggcaacattgacaaagaatatgacaaaagaagagatctttcaattaaaaaatcgattatctccatttatattaaaagaaagtacgccacagtatacgtactatcaaatcaaaacgaaagaatgttcgattacggcatatacaagtggtaaagttgtatttcagggagccgatctttcttggttagaaccaaaacaaacaaatagtgaagcacaagatcaagcgggcagcgatgaagttggtacaggtgattattttggtccggttgtagtggctagctgcattgtcacaaacaaggctcgcaaaaaacttgcacatcttggcattcaagattcaaagcaggtggatgatgttaagattcgtaagcttgcacctatcatcaaggaagtatgtccacatagtattttgattgttcccaattcaaaatataatgacatgcatgatacttgtaatatggtggatatgaagtgtcgtctgcataaccaggcttatgtaaatttggtacataaaggatatacgcttcctaagcagattgttattgatcagtttgtgcaagaaaaaagttactatcgctacttacaaggctttcctgaagtcattcggggtatcacatttgagaccaaggccgaaaacaaatacctggcagtagcttgcgcgagtatcctggcaagaaatgcctttctagaaacgtgggatcttatggaagaaaaatatgatttcaaatttgagaagggtgccggaagcaaggtggatgtgtgcggcaagaaattcgtagaaaaatttggaaaagaaaagctttaccaagtggcaaagcttcatttcaaaaacacacagaagattggagtttaa

SEQ ID NO: 2002 - DNA, 768 bp, Unknown
  Artificiall/Consensus sequence
atgaaacaaagaataattaccgctattggtatcattcttgttgtagcactaccagtagctcttggaggatattggttagaagctcttgccttatttattgtttgtgcaggagcatatgaatggatgcatattcagccagattttaaaagctggcctaaatatgttcttccactcagtgctttagctgtcattttaacaagagttttaccggataaatactttttcgttgtgatgacactgattgttgtattcttatggagtcttgttgtttttgttgaaaacttctcaatcatagatgcctttgtgtgtatttcatacgttacaattttctcccttgtttatcatgcggtaggacaaatcgcaaacgtacatcagtatctatggacgattgtttttgctacatacgggagtgatacaggagcctattttgtgggtcgagctattggaaagcacaaaatgaatcctagaatctcacctaaaaagagttgggaaggttttgcaggaggaattgtatttggttttgtattaagttttgtggttagttttagctacgtatcaaacttaaacccagttttaaatacattcttatgtttagtatgtccggctactgcagaacttggagatttgtgttttagtgctattaaacgtcattttgctgtaaaagacttctctaatcttttaccagggcatggtggtgttttagatcgtgtagattcactattattaaatatcatggtatttagtgttttatatacaatcattctctaa

SEQ ID NO: 2003 - DNA, 711 bp, Unknown
  Artificiall/Consensus sequence
tatgtcatgcgtagagccattctctttttaatttttgcgttgtttttagcgatggtcattcagccaaatttaaataaacaaattaaagaaaaatcaaaaatcgatgttcctgaacaaacggattcgacaattattaccaatgatacggttgacaattcgcgctgtaaatcgaaagctgtcatctgtattgatgcaagtcatggaggtagtgatgcaggatatacaagtgatggacatacgagtgaaaaagatctaaacctgattattgccaagaagattggagacagtctagcttcggtaggatataacgtcgtgtatacaagaagtgatgactcttctctttcaacagaagatcgtattacttcaatcaactcgcaaaaggcaaagtatttaatttctattcaaatgaattcaagttcggattctctatccaaaggttactccatttttacgcagcctaacgataatatgattcagcttgccaaaaaacttgcccaaactatgaattccatcaacctatcgcaatttgaaggtattgattcggatcattatgaaaacttccctatcttatatgatagtcaaattccttcgatactattagaacttggatatttaagcaatagtgaagactacacaaaattaacggatgaaactttccaacaaaagattgcgaatgcgatcacagaaagctttttagatcaaatcaactaa

SEQ ID NO: 2004 - DNA, 939 bp, Unknown
  Artificiall/Consensus sequence
aaccaatttatatttgatttgtgttataatatttttatggaattaaaagatgcattagaggattatcgcttatatttgaatgttctacaaagaaaatcaaagaaaacgcaacaatcgtatcttcatgatattgaggtgtatttaaatttcttaggtaaaagaaatattttgttgtgcgaaaacatttcagttttggatatcgaagactttttggatgtctatgccgaagatcacattgcctcgagtgttaatcgtatgattgcgagtattcattcttttcatttgcagatatcgattgcgcatcctgaaatcaaagatgtgtctttattaattcatgggatgaaatcatctaaacatctgcctgtctatttgtcggtggatgaggtaaaaaaagttttttcatcttttcaagacaatcagatcggccaatataataaaacgatattagttgtattatattcttgtggtttgcgtgtaagtgagctttgtgagttaaaattgaataatgtacatttggcggaaggtatcttaaaggtcaaaggtaaaggggacaaggaacgtgtgattccgatatcttcgtattgtatttcacagatgaaatattatttagattccattcgtagtgtttgggatgtaaagaatgtttcgtatttttttgtgaatcgtttaggccgtcgttgtactcggcaatatgtgcatttaatgatcaaaaataaagtgaatgaattaaatttgaactctaaaatctcagcacatagtttcagacattcgtttgcgacacatcttttagatggggatgcggatcttagaatcgtgcaggagttgttgggacattcaaacattcaaacgacgcagatctatacacatattcaagatcagcgtttaacaagtgtatatgatcgttgttttcaaaaaatagaaaaaccaaaggaggagtag

SEQ ID NO: 2005 - DNA, 1221 bp, Unknown
  Artificiall/Consensus sequence
acattaatgatgtctatatcccattttattaaatgtgactattatgtaaaaacatttggagggttggaaatcacaaacgataatgtaaccgttaatattgtcgaattatttggaaagcagctagtgaatttattacaggtcttattgtttcacagtgaaaaaccagttcaaaaagatgaactgattgatattctttggccagaaagtaagaatccatctagtgctttaaagttctcgatttttagattgcgtgctgaattgaatgaaattgaattcttcaaagacaaagaggttattgtaacgacaagaaaagggtacattttaaatccaaatttagattggaatattgattttgttgaattggaaaaggcgtataaccaaattaacgatggttcggaacttttagacgaaaaagagtttaagacggctagaaagattttcagattgtaccaaggtcgtttctatgcttcaccaagccaattgcactggattttacaggaacaagagatctttagacaaatgtatgtgaaaacgatgatgcgcacatcttgttacttatatacgcaaaaacgctatgatgagatgatgcttatgaattatcaggcggttttaattgaaccatttaatgaaggtttacattactattatatgaaaggcttagtggctacacgtaattatcgtgaagcgttgaagtattatgatgaattgaatgatattttcttatctgaactaggtacgggtttatcgaaacgctttaaacaattgtacgatatcattattgctgatcatgccaaagaagaaagtaaagatatggaaacaatcatgcgtgagctttcaagccgtgatcaacaaaaccaaggcttcttctgttcgtatgaaattttcaagtatttctatgaattgttgttaaaaatgtctattcgtaatgaacaaaattattatttgattatgttacagttttcagatggtactttggattatgaaaagattggtttagattttgatcgtgtaaaacgattggtaggttcttgtttaagaagcaatgacttgtttactcgtacaagtgaaacgcaactgctgcttctagtggattgtcaaaccgaagagaatgcgcacttgattattcagcgtatttcaaataagttctatagtatttttagaaagaaaaattatcgaatgaattattctgttcataaggcagaattagatagaaataattag

SEQ ID NO: 2006 - DNA, 561 bp, Unknown
  Artificiall/Consensus sequence
gtgctggttttacatcaaaacatgtggtggagacagatgaagcagcatattaaagaaattattgtcgttgaaggaaaaaatgatacaaacacgttgcagtctttttttgattgtgacacgattgaaacgggtggagaccaggtcaacgagaaaacgattgagcgtgttagacaggctcaaaagacaagaggtgtaattatttttacagacccagatacaccaggagaacatatacgtagattgattggcagtagtgtgccaggatgtaaacatgcgtttattaataaggaaaaagcgaaaacacctaaaaaagtgggtgtagagcatgcaagtaaagaagatttatgggatgccctatgtcattatgtaacgtttgagaataaagaagaagtattgagttggcaagactttattgatttaggcttagtcggaaacaaagatttgcgctttcaagtgtgtgaagattttcatattggtccttgcaatgcgaaaacatgttttaagcgtttaaatcagatgaatgtgacaaaagaagagatagaagaaaggagtctttcatga

SEQ ID NO: 2007 - DNA, 1281 bp, Unknown
  Artificiall/Consensus sequence
atgtttgtagatcaggtcaaagttcatataaaagcaggtaaaggtggagatggtttagtaagttttcgccatgagaaatatgttgcctatggtggaccttttgggggcgatggaggtaacggtggagatgtcatttttgaagccgatccaggaatgacaacacttttagatttacgttatcaccgtaaaattatcgcaactccaggtgaaaaaggtaaaaacaaaaaaatgcacggagccaatggggaacataaagtagtaaaagttccattaggaacgattgtaaagagaagtgataataatcaagtacttgctgacttgacaaaaccacaccaacgccaagttgtagcacatggtggtcgtggaggtcgtggtaactggcattttagatcaagccacaatacagcaccaaaatatgcagaacaaggtgtattgggtgaagaatttgattgtattgtagaacttagagtacttgccgatgttggattggtaggattccctagtgtaggaaaatccacattcctagatgctgttagtaaagcgcgtccagaaattggagattatccatttacgacaatcacaccaaatgttggggttgtacaaaccggagatggaagaagctttgtactagccgatttaccaggacttattgaaggagcaagtgatggtaaaggtttaggtcaccagttcttgcgtcacattgaaagatgtcgtgttattattcacattattgatatgggtgcagaagatggaagagatccattaaatgattatgaagtcattaataatgagttgaaatcttaccaaattcgtttattggaaagaccacaaattgttgtcgcaaataaaatggatatggaaaatgccgaagaaaatgttcgtcgttttaaagaaaaatatccagatatcccagtatatgaaacaacaacgattattcatgaaggcttagacccagtacttcgtaaagcagccgatcttcttgcaacaacaccagtattcccaattacggaagatacgggcgagacaggtgttatgtatacatttgaagagaagaagaaagacatcattattgaaaaagaagaagatggcgtatggaatgtttcaggtcctagacttgaacgtgtatttgacatcaataagttgaatacagaagaagacttctatctatttgccaataagatgcgttatcttggaattgatacagctttaagagaggctggatgtcaagatggagatacagtacgtttattaggctttgaatttgaatttattgaaaactaa

SEQ ID NO: 2008 - DNA, 969 bp, Unknown
  Artificiall/Consensus sequence
attgatcaagggggtatagacttgtcctttacatctgaaattaaaaaagaaatttgtaaagaagaaatcgatgctcaaatgatgaaggcacaattatgtgccctttttcaaatgcgagcaagtttacatatgaattggcaaggcatgtatttgtcgtttcaaactgaaaatgcaacaattgccaaacatgtttttcaaatcatgaaaacgttatatgatgtcgatcctcgtctttctgtgttgaaaaaaatgcagttaaagaaaaataacatttatcgcattcaagtgtttgataaagctcaagaaatattggaagatcttcagattttaactgattcaggtttgcgttatacaccaagcgtaaaaatggttcgttctgaaaagatggctagagcttatttgcaagggtgttttttggctagtggcagtatcaactcaccaaaatcgagtaattatcatctagaaatgtcgagtcaggaaaaagatttagcgttaagtgttcaaaaattaatgcagcgtttttatttgccggcaaaagtcatcgaaagaaaaagtgtttatgtggtatatataaaagctggagataaaattgcagacttcttacgtttatgtaatgcttcgaatgcgttgtttgaatttgaggattctagaattcaaagagatttctataatcagatcacgcgcctcgataattgtgaggttgccaatgaggtaaagagtttaaaggctgccaaatcgcagttagaggctattgagtttttggagagtcatgccaaaaatattgtgattccagaaaaaattatgcatgcgatgcaaattcgcaagatgtatccggaggccaatctaaatgaattgtgtttagagtgtaaaaatgaatttggtgaagatatttcaaaatctggaatgaagcatcgcttagcgaaagtgaagcagatggcttcagaattaaaggaggaattggatgcttaa

SEQ ID NO: 2009 - DNA, 1338 bp, Unknown
  Artificiall/Consensus sequence
ccagctatgagaaacgaaatggttgtaagtatttctagtgttattgctcgcattaaaaatgttttaacacaaactatggatctagatggcatctggattcagggtgaaatcagcaacctgacaaaacacagatcgggacattattatttttctttgaaagataaaagtggagaaatgagctgtgttatgttttcaagttatgtatcacgtttaaacttcaatgtagaagaaggcatgcgcgttttagtttcaggaagcattaatgtatatgaacaaaggggcagtcttcagcttgtgattcgtcaaatgaagcaagatggtttaggtgatttatatcttgaatttgaaaaaagaaaacaagatcttttaagggctggctattttgatgaaagtcataaaaaggctaaacctgactatattgaaaatattggtgttgtaactggagcacaggctgctgccttacaagatgtattatcaaccattcaaaggcgttggccgatgatgaaggtcactttgtatcctagtttagtgcaaggtagttttgcacctaaaagtttgattcaatccttgaaagaagctgatacacataatcatgatgccttattgattgttcgtggtggaggaagctttgaagatttgttctgttttaatgatgtccagcttgtaaagacgatttacagtttaaatacatatattgtcagtggtgtaggtcatgaagtggatacaacattatgtgatcttgtctgtgatcatcgaagtgtaacccctacagcagctgcacaatgggtgactttggatcaatatgaagtgatgactcaaattttgaaggatagagaattgttgaggcaaaacatgtctatgattttaaatcacaacaagttaaaactggattcgtataagaatcatccgtatttaaaggatccaaaatcttttattatagaaaaacaattaaaactagatggctacaatacacaaattgaacatgcactagagctagagctgcaaaagaaaaatgtcatcaagaattatacacaacagatgcatttgcgtatgatgaatatagtaaaggtacaagaaaataaactttctatggtgcctgaaaaactaagatcgaatatgcaagttttactacaaaattctagacattctttacaaaaaaattgtgctttattggatgcctattcacctttaaaggtactttctcgtggttatagtatctcaaagattgaagataaagttattaagcatgtcaaagatgtcgcaagggatgatataatggtgacaagagtaaatgatggtgtgatcacttcatgtgttgtatccactaaggaggaataa

SEQ ID NO: 2010 - DNA, 1359 bp, Unknown
  Artificiall/Consensus sequence
atgagagataggttttcaaatcgtttaggatttattttaattagcgcaggatgcgcaataggaattggcaatgtttggcgctttccatatattgtagggcaatatggaggtgctgcatttgtcttgatttatttattttttctagtcatattaggattgccagttatggttatggagtattcggtaggacgtgcaagtcaaaaaagtgcagccctatcttttgatgtgttagagccaaaaggaacaaagtggcattttatgaagtatgtggcaatggcaggaaattacatactgatgatgttttatacttcggtttgtggatggttgttttattattgctacaaaatgttgatgggtgattttaatggattaaatgtgggtcaaattaataatgaatttggtttaatgttgtcaaatcccttgattcaagtaggtatgatgtttctagttgtttgtattggttttttcatttgttcaaaaggcttgcagaatggtgtggaaaaagtatcaaagtatatgatgttgtgtttattggtgttgatgcttgtgctagctgttcgttcactcattttgccaggggctatggagggcgtaaagttttacttgttgcctgatttttcaaagatgcaaaatgtatcggatgtcgtatttgcggccatgggccaagctttctttactttgagtttaggtattggtgctattgcgatatttggaagttacattgataaaagtaagaagttaacatctgaggccattacggttgtgtgtttagatacatttgttgcattggttgcaggcttcatcgtgattcctgcttgttttgcgtataatgtggatcctgggcaagggcctggattgattttccagacattacctaatatctttgcgaatatgcagtttggaaatatttggggtgctttgttctttttgtttttgagttttgccgcattaactacaattattgcggtatttgaaaatatcattacaatgacaatggaatggacaggatggtctcattcaaaaacaatcaaagtaagttttgtgcttgtttttgtgttatctttaccatgtgcattaggatttaatgtattgtcttttgttcaacctttaggtgctggttcaaccattcaagatttagaagattttattgtatcgaataatctattacctttaggatcactttgctatgtattgttttgtacatctaaatatggatggggatttaaaaactttttaaaggaagccaattgcggagagggaatttcttttcctaaacaagttggtttctatgtttcatatatcattcctgttattattttggtaatatttatacagggatatatctctaaatttttgtag

SEQ ID NO: 2011 - DNA, 1260 bp, Unknown
  Artificiall/Consensus sequence
atgagtaagaaaagagtttatgcggctatcgaaattgctgatcaagagattcgtcttatcgttttagagatatttgaagctcgctacaacgttttaagaacagaaagagttgcttgttcaggtgtagataaaaatcaaaagattgtcgatgaaagtgctattgttacagccattcgtcaagctataacgaatgcacaggcagctttaggatatcgaattgagcgtgtcttattggctgttcctagtgtaaatgtaatgcgtagctcacaaaaggtgcgtgttcagattgaagatggtacaaaacatattcgtttgttccatattcagcaaggatttaaaaacgccattcaaaaacgattgaatgaagatgtagaatttgtcaatgcgaataaggtgtcttatgaagtcaatggacaagtgagtcagaaacttccattaaatcaggaatgtgaagatttcattatggatgtagatttattatatgccgacaaggaaacaatctattcgtatgctcgttgtgtggaacaggcaaatcttgaaatcttggatttatgtttagattcatttgcgattggtcaagaaactgcggctttggcacagagcacagaaagagttacaatccaaattgatttggaacagaatcactctactttagctttatttagtacaggtcgtttaatgacttgtacaactttggattatggatacttatggttcattgaggatatccaaagaaaatataagttaagtgatgatgtatgttacagattgttgcagaatattttctcgggtcaagaagatgaaaacagtgatgtgattgtttatattgaacaaagagaagatatgcgtgttgagattacggccaatgaattagcgagggcttgtttacctcgtattcgtcaatggattgcagctgtcaatgatgcatgcttaccaattgttcgccaaggaaaatcaagatatgtgatcacaggacaaggaagtaacattcccgtattgaaggatctagataaatcgttcaatgcgagcgcaatgatctatcaagaacaagccattggtgcaagagatggagcatttgtgtgtggcttaggtatggcctatgcttggcaagacatcaaccgtattcaccatgatgacagaattagtgcaaacaataatgaattagaagctagcattgattctattaatcaaaaggcgcatactggtgaaggtggatttacgaagaagttaaagaatgctattttagcagaagaagaataa

SEQ ID NO: 2012 - DNA, 1680 bp, Unknown
  Artificiall/Consensus sequence
ttattaaaggttgaaagaaaggagaagtatattgtagtcgaccagttagatgggtcaattacaatataccaggagaattcgatgagtttaccaatttatgtaattggacacaaaaaccctgatacagattcaatttgtgctgctttagctcttgcagaattaaaaagacagacaggaatcaatgcggtggctgctcgtttggggactttgaatccagaaactaaatttatattagataaattacatgtaaatatgccagttttattaacgactgcacgttcaacgttggaagaaattgaaattgatgatgcggtaacaattgaagaagggcaaacgattcgtcgtgcatgggatttatgcttagaaaatcatgtaaagactttgtatgttgtagatgataaaaatgaatataagggcatggttactttgggtgatgtttctaagattcagatgcaggatttaaatattacgagtgaattattaaaagaaacaccattagaaaatttagttgccagtgtaaagggttcttttattttaaagggaaatcttgaaagaagtggatttgttcgtattgcggacaaacgcttgatggatagagatctaaaaggtgccatcatggttttaaatgatcatgaagacagcatgatcaagagtatggcaaagggttgtgctgttattgtcgtagcagaaaactttgttccaaatagctatattattgaaatggcaaaacaaatgggagttactttaattagtacgccttataatattatgaaaatcattcaaatgatttatcgttcaattccggttgaattgattatgactccggctaataaagtgattcgctttaataaaagtgaatatgtagaggatgtggaacgtgaaatgttgaagacgcgtcactcatcttatcctgttgtattccagaaaaaaatattggggtctgttgctcgatataacttattgaaggctgaaaagaaacagtttattcttgtggatcataatgaaaagaaacagagtatcagcgatattgaaacggcgaatattgtagagattgtggatcaccatcgcattggtgatattgaaacagatcgtccaattgtatttagaaatatgatagtaggtagttcttgtacgattgttggattgatgtatgcagaatatggtgttaaaatgcctgagatcatcgcaaaattgattgcgtatggcatgattagtgatacaatgaattttaattcaccaacatgtacgacaattgatcgtaatttggcaaagcgtttatcaagtgaatatggtattgattttgatgcgatggctaaagaattattcgaaaatacggctacgattcgcggaaaagaattcaagaatattctttacaatgatgttaaggaatatatgttgagtggatatcacattgcggtaagtcaggtttttacgtttgatttgagtattgtggatgaaattaaagaggatttcttgaagtacatggatgaacaaaacaagatacatgaatatgatttgatgttgatggttatcactaatgtcgaaggtcgtggctcacgtttcttatatgtaggtaagttatcgcattttgttcgtgatgttgtagaagaattcaaggatcaaggatttgtttctcgtaaaaaacaaattgtgcctcgtttagcacaagaactggcataa

SEQ ID NO: 2013 - DNA, 1641 bp, Unknown
  Artificiall/Consensus sequence
atggctattgacggattatttttatacaatattcaagaaaaattaaacgcatataccccatgtaaaattggtaaaatacaaaatatcagcgatgaagaaatattgattcatctacacacacgaaatgaaggaaaccaaaagcttgtcattaatgtacattccaacacaaaccgtgtatatatcgcaaactttattcccggcattcaaccagaaccatccaactttgtgatggtcttaagaaagctctgttcacaagccattgtcgaatcttttgaacaagtaggatatgatcgcattttatgtttacacttatcttgccgcaatgaatttcaagaccttgtgaaatacgatctaaatatcgaacttatgggaaaatacgccaatatgattttagtcaaagatggcgtaattgtagatgcattaaaacgtattcctgtatatgaaaatgccaaacgattcatccatccaggcgcaaagtatgtagctcctgctcaaccggagaagaaaaatccatttgagatccaagatattgatttagatcaaagtcttgttaaacagatctatggcttttcgccattactatccaatgaatttatgtatcgcataaaaaacaacgaaaacgaaaaatacatcgatatattaaatgaagttgtgaattcaaatatactctatatctataaaaaagactttcattgtattgaactcaaacatttaaatgaacaaccaaagacctatacgattatggaaggattaaatcatttatatgaagaagatgaacaaaaaaagcggatcaaagaacaatatggcgatattattcgtactgtagaaaaggaaaaattaaaacaaacaaaaaaacttccaaagctagaacaagcattagaagatggaaaagactatcataaatatcaagaatatggtgatttgatctttgcgtatatgtaccagattcaaaaagaaaagacaatcgtattaccttcttttgaaaccaatgaagatgtaacaattccaattgatatgcgttatgatctaaaaacaaatgcgaataaatactatcagaaatatcataagatgaagcgtagtctagtgatcttagaagaacaaattgaacaatgtaaacaagatattgaatactatacacaactcgaagaacagcttcaacactgcagtgtttttgatgctggagaaatacgagaggaacttgttaaacaacatgtattgatgcctaaaaaagacaataaacgtaaaaagaagaacaataagccaaatgtccttcatttagaatttgatgattgtgaaatctatgtaggtaagaataacattcaaaataactatgtgacacaccaagtctctagaaagaacgatttatggttccatgtaaaagactatcacggttcgcacgtactattaaagagtgaagactttaccgaaccacaaattcggttatgtgccatgttagccgcgtattactccaaaggcaaagattcaagttcagtacccgtagattattgtttgatctcacaaatcaaaaaggtacctggatctaagattggttttgtgacaatgaaatccaataagaccatttatattgacccagatgaaaattatttattagaaatcattaaaaatcatcaaataaagtaa

SEQ ID NO: 2014 - DNA, 486 bp, Unknown
  Artificiall/Consensus sequence
atgaataaaaaagaaaaatttgcgtatgacatcgattttggtgccattatggactatgtagaaaaccgttttatgttagtaataaaagacgaagattggacacaggaggaaattgatatgttgaatagtggtatcgatcttcatttttgttacacaaacgatattgccgtatttgtgcttgaaggtggcgatattgattccagtgatttttatttcaatgttcaagagtgtgattggaaagagcatttgtttaaaagtgattgtctagatgtagaaattgtattggttgataaggcaaatgacatttgtttcaagaagtcacatactttgacaaaagaacaaagccaaagtattaaggattgtctaaatcaacaaaatgaggtatcctttatgccaagtgaatatgatgtgaatgtgcaaggaatccagagtgcatatgaaccatatgagcttatacgctttgaaaaatgcgaaatcaaattttaa

SEQ ID NO: 2015 - DNA, 819 bp, Unknown
  Artificiall/Consensus sequence
agcgtatgggcaaatcaagaaaaaacctttggagggttgagtatgggaaaagttattgcaatttcgaatcaaaaaggtggagtaggtaaaactacgacatctataaatttagcaagcggacttgcacatgtaggaaaaaaagtattgttgattgatttcgattcgcagggaaatgccacgcaaggattaaatgcgagtcaaaataattcacaagcaacgattcactctgtattaatggagggagttcctattcagcaggccatcgtacctaaaatgaatccaagaattgatattgttccagccaacattaatttagctggagctgatttagatatggacaaaatggaagccggcaaagaagaattattaaaaaaagccattgctcctattcgagatcaatatgattacattattattgattgtccaccatcacttggactattgaataccaatgcattgacagcagctgacagtattttgattccagtacagtgtgaatattatgcattggaaggagttacgcagttgttgatcacaattcgtcttgtccaaagaacaagtaaccgaaatttaaaaattgaaggtattttattaacaatgtttgatattcgtacaagattaagtgtagaagtttcgcaggatgtgcgtcaaacttttggcaagcttgtatatcaaaattctattccgagaaatgtaaaattatcggaagcacctagccgtggcatgtctatttttgaatatgatccaaaaagtacaggagccaaggcatatgctggtttaactgaagaagtactaaaacgtaattcaaaggaggcatag

SEQ ID NO: 2016 - DNA, 1410 bp, Unknown
  Artificiall/Consensus sequence
atgcttattaaaaaaattggaggtagaattatgagtgaagtagtttggaataaatattcaagagaagaatttaatgatgtaatgaaatttagtgatggatatattgatttcttatctgattctaaaacggaaagagcttgtgtaaaaaatgcaatcgcattagcgaaatcttatggatatcgtgatatcaaagaggttatcgaaaataaagagattttaaaagcacaggacaaagtgtatgtaaatatgatgaacaagtcgattgcgttaatgcacattggttcaaatccattggaaaaaggtatgaacattttaggtgctcatattgacagtcctcgtttggatcttaaacaaaatccattgtatgaagatggaaacattgcttatttggacacacactattatggtggtgttaaaaagtatcaatgggtgactttgcctttggcaattcatggtgttgtttgtttgaaagatggaacaactgtagatgtagcgattggagataaagaaagtgatccagtatttgtgattagtgatttattgattcacttaagtgcagatcaattacagaaaaaggcaaatgaagtgattgccggtgaagatttaaatgtaactgttggatctattcctttagaaaatgaagagaaagatgcagtaaaggccaatgttgctaaaattttaaaatcaacatatggctttgaagaagaagacttcatttctgctgaattagaagttgttcctgcaggacgtgctagaagctgtggattcgattcaagtatgatattaggttatggacatgatgatcgtatttgtgcgtatacaagtttgatggctcaattagaagcagaaaatgtaaaacgtacagctgtttgtttgttagtggataaagaagaagtcggatctcaaggtgctacaggtatgcactctatgttctttgaaaactttgttgcagaagttatggattgtatgggtgattattctgcattaagcgtgaaacgtgcaatgatgaattcaattatgttgtcaagtgatgtaagtgctgcacatgatccaatttacgcttcagcatcaagcccaagaaatcaagctgaatttggtaaaggtatcgtattcaataaatatacaggagctcgtggaaagagtggatgtaacgatgcgaatgcagaatatatcgcattgattcgtcgcattatggatgatcacaatgtagcttggcaaacaagtgaacttggaaaagtagaccaaggcggtggaggaacaatcgcttatattttggctaattatggaatgcaggtaattgactgtggtgtagctttacataatatgcatgcaccttttgaattggcaagtaaagctgatatctatgaagcaaaaaaaggatatgctgcattcttaacatacgaaggataa

SEQ ID NO: 2017 - DNA, 1182 bp, Unknown
  Artificiall/Consensus sequence
atggaaaaacaaaatgatttattgatggattcaagtatcctctatcgaagtacacagaaatattatgataagatgctgcaagatttgaatttgagttatgcccagcttccaatcttgattgaaatctatgagaatgaaggtatttccctccaacaaatcgtacaggttggtggatatgacaagggtacggtcacaaaaaatgttcaaaaattgaatacgttgggttatgtttccatcttaacaagtgccaaagataagcgtgttaaagaattatatacgacggcactcaccaaaaaacatatatctgaaatctatgggattcgtagagactggtggcatcacattacacaagatctaacggcagagcagattgaagttttttctacgttttatcagactttatccaatcatgccagaagctatgcagatttggagcagaccaatctgcagttttataaattaaaaaaattatctttatcggattatgattcacatttgagttgttctttatatacagggggatgtaatttaaagtgtccgtattgtcattcaagagatttggtgtatttaaaagaaaacatgtatccgatcgttacggaaaaaatcaatgaatatttagagagtcatcgcaaagatttagatggcatttatatatcgggaggagagcctttgatgcatgagggggttgtttcctttctacagtatgccaagactttaaactataaaattaagattcatacgaatggtatgttctatgaacgtttaaaaacaatccttgcacaaaaattggtagatcatgtcagtctagatatcaaaaatgcgccgagtgcctatgcgaaaacgtgtggggttgaggatatggatctaaaggatattgagaagtctttagatttgttgaagcaatcggttgtaccatatgacatttgtgtaactttggtagatgaattgcataatcaagcaacgatagaagaattaggacaatggatccaaggcgtggatacagtgattttacagccatttgaagatagtgaaacgaccattgatcattcgttgcatcgacctagttttgaagttgttttaaaatataaaaagatattcgaaaagtatgttaaacatgtaaagataagggggatcaagcatgatcgaagtcgaaaaaagggatgggtccatagttggttttga

SEQ ID NO: 2018 - DNA, 537 bp, Unknown
  Artificiall/Consensus sequence
atgaagttttgtaagttgattacagaggtcgatttagaactgctcgaagagttagtcgataatggatatcctgtggatcgcattgaagagaacgggcaggtttactacaaaacaccagctatgttatgccaaaatttaaaagtgaatgatgaagtgagaaattacagcaacggtttgatttcaatgtccattgaaaatgttcgaaagaaaaaggggttatatagaacggggaatctattgattgatatggattctaacattatccaaaagggtaaagaaaaaatctttattcctaaggcaagttttacaataatttcaacactgatggacgttcctcacaaaactgtatctagatcggcgttggttttttacttggaacaggcgtatcatcacgaaatattggataacactttaacggttcatatcgcttcaattcgtcgccttttgggtgatgaatacatcaaaacccataaaactgttggctatttttgggatttcgatgtttttaaagtggtagtagttacgcatgaaaaataa

SEQ ID NO: 2019 - DNA, 378 bp, Unknown
  Artificiall/Consensus sequence
atgatcgctaatggtgaaattccaagcaataaaatctatgaagacgaaagtgttatcgcttttctagacatcaaccctacttcttatggacatacacttgttgtcccaaaagaacactgtgattcttttttagattgtccagatgaaacacgcaaccatgtatttgaagttgctagtaagcttgccaacaaattggaacaaactctacattgtgatggcatcaacattttaagtaatgtgcatgaagctgcaggacaaagtgttaaccatttccacgttcatttgattccacgttataaagataacgatagtgttaccattgaatttcatgaaattgaaaaaccagattttgaagaattaatgaataaactaaaataa

SEQ ID NO: 2020 - DNA, 876 bp, Unknown
  Artificiall/Consensus sequence
atggatgagttgattgatcgttttctaaaatatatatatcgaaagaatacgcaatcagataaaactatcgaatcgtataaaaatgatttgaaccaatataaagaatatttattaagtcaatctattgattcttttgaatcgtgtgatagattgacttttatgaattttctagctacattggatcatttaaaatccagttcgattgcacgtaaaatgagtgtatatcgttctttctatgcgtatttggcagagtatatgggtatcaatgaaaaccctttattagggatacagacgccaaagaagtcaaaacaaattccagattttttatttgtagaagaaattcaggaatttttaaattcttatgaagataacaaagaagatcaatatcgcaatcgtatattatttacgatgatgtatgcatgtggattacgtgttagtgaatgtgtttctttggaatggaatcaaattgatttaaacaatcgaatcgtgcatattcgaggtaaaggggataaagatcgtattgtacctttttatcaaggttttgaaaaagaattgttggaatataaaaatagtttttggtcaaaatatgcagtggatgatcatgtatttgtgagtttaagaggtaaacaattaacttctcgtggtattcagtatttaatggataaacatgccaaagccattggaatgcatatgaaattgcatccacatatgttgagacatagttttgcgacacatttattagataatggagcggatattcgtgtcgttcaagagttactaggacattcatctttatcaacaacacaaatttatacgcatgtgactacagcacagttagtgaaggcttataaaaaagcgcatccttttgaaaaataa

SEQ ID NO: 2021 - DNA, 912 bp, Unknown
  Artificiall/Consensus sequence
atgaaaaaaatagtatctatgttgtgtgtatgtgttttatctttatctttatttggttgttctaaaccagaaaacaatgtggaattaaaaaagaatgtttcttgtcaattgttggatgttttaaccatcacaaatgatacagataattcgacgtactactattatttggcaagtgttgaaaataagggtaaaaagccgtatgacacaaagaatttaatttataccgtaacagatgacaatgaaaaagatattagtgtcattgataaatatcagtctacgccttcttatatcatcaataagggacaaaacacgtatatttatggatatattggttttccaaacaatgatcaaaaaaacttgggtctttcttttaacaacaagaaacagttcttgccttttaaagcctttgatattcgcaaggctagtgataagaatgtaaaggattcaaaggatacaaaatatactttctttgaggatgatacacttcagattggtgtggatgcatctaaggcaagttatgtatatgagaatggggaaacagtattaaaaaatattaagattacttataagaataaaacggattctcgtatcattgttccatatttaacgccgagtgctactttagaaggtgtcgatcttagtaacaagtatgatttcgcaaatatggatgaaatcaaaagtcatgattttacaacgaatggtatggcacctaaaacacaaagttttaaagcggatgtaactgggtatgtattgtatttcttggataaaaaacaaactgtaaatacagaaattgaattccattttgaaaaggcagctcctgattttacggataagagtaccaagccttttgtggttcatatgaattcgaaagcatttggaaaatcaaacacatttaagattggacttgaataa

SEQ ID NO: 2022 - DNA, 1308 bp, Unknown
  Artificiall/Consensus sequence
atgagtcaagaaatgtatttttctcgcatgcagaaattattaaaagatgaatataatgcctatattgaatctttatcgaaacctttatatcgtggtatgcgtataaatttaaaaaaggcagaattggatgaatttgatcatttggatcatccaagtcagttttgtaaggaaagttattatgtagataagccgttgggaaatcatcctttccatatttgtggttgtttttatctgcaagaaccaagtgcttcaagcgctgttgaaatcttggatgtacaagaagatgattatgtattggatttatgtgcagcaccaggtggaaagagtacgcagatcgcatcacatttaaaaagtggatatctagtatcaaatgaaattgatgcgaagcgtgcccaaatccttttgtctaatattgagcgtatgggtgtgaaaaatgtggcagtaaccaatacaagtgtagataagcttacgaaggtgtttgatgcttgttttgacaaaattttagtggatgcaccttgtagtggtgagggaatgatcaaaaaacatgatattgccctaaataattggagcattgaaaatattgaactttgtgcgactcgtcaaaaagaaatattagaacatgcctattctatgttgaaaccgggtggtactttggtgtattcaacttgcacatatgctttagaagaagatgaagatgttgtcttagattttttagaaaaacatgcggatatggtcttggtggatcctgaagtttcgtggggaagaaaagggtttaaagacttgaatgtgcgtcgtatctttccaatggatggtggtgagggtcatttcattgcgaaattcaaaaaacaatcaggtgttgcaggtaaacttccagttctaaaatcaaaaaaaatagataagattactgagaaatttttgaaggaacaattgaatacattgccaaactattactatatagataaggatagagtatatggaatggatgttccgtttgtggattttaaaaaggtaaaagtattacgtcaaggcgtatatttgggggatgtcattaagaatcgttttgagccaagtcattctttttatatggttgcagattttgactataaaagaaaagtggatgtaactctagaagaaatggacctatttatgcatggtgaagttttacaaaaggaatgcgaaaaagggtatatggctgtatgttttaaggggcatccgtttggccttggcaagagtgatggaaaacaaatcaaaaacaagattcctaaagggcttcgtttattgccaaattcacatgtaaatatagactaa

SEQ ID NO: 2023 - DNA, 756 bp, Unknown
  Artificiall/Consensus sequence
atgttaaaaaaactttactccttttttacttgctttcatgataaaatgacaaaaaagagggttgattttatggaacgagtcttaattgttgaagacgatgaaaatattcgtcaattattaaaattaacattggctagttttaattatgaactagttgattttgaaaatggaaaagatgcatatgattatctacaaaacaataaagtagatttagccatattagatttgatgttaccaggcatgaatggatatgatatattaaaatttattcgttcaaaggcaacgcttaaagatttacctgttattatcttaagtgcaaaagataaagagcttgataaaatcatgggacttgatttaggagctgatgattatttgacgaagccatttagtgtgttagagcttgctgctcgtattcgttcattacttcgtagaagtaaaaaggatgaacgattgattcaaatacatgacttatgtattgatttagataaaagaacggtgacaattcatgaagaaccggttgaattgacattcaaagaatttgaattattgaaatatttagctaaaaatgaaggtagagctgtatcacgagaagagttgattaatcagatttggggatatgattttattggtgaaagcagaacactggatgtacatattaactcattgcgtaagaagatgggaaatgaatatgcacattggattcaatctgtaagacaggttggatatcgttttgttgctgagtataacaatgtataa

SEQ ID NO: 2024 - DNA, 606 bp, Unknown
  Artificiall/Consensus sequence
atgtccaaattgtcaaaaaagaaagtaataggaatcactggatctatgggttcaggaaagagtgagatttctcgatatttaagaaaaaaatatcctgttttagattgcgatcaggttaatgcggatttattaaaaaagggaaatttgggttatcagaaattaaatgatttgcgtattgttgaattggattcaaatggacaaatcattaaggaaagtttagcttcatatatgttttctaaggcagaacatagaaaacaagtggaagccatcttgcatcctttgatttttgaacagatgcataaatggatttatgaacaagagagttcgattgtctttgtggaaatgccaattttatttgagatttctgcacaagatcattttgactcaatatggtgcgttgtggctgatttagatgtagccttatcgcgcctacaaacctatcgcaattttactagggaacaagctttggcaagacttgtatcacagatgaatccggaagagaagatggcaaaaagtgatattgtactgcaaaataatggtacggtagaacagttgcataaacaaatagaagaagcattaaaagaggagaaggtacatggcgattga

SEQ ID NO: 2025 - DNA, 1527 bp, Unknown
  Artificiall/Consensus sequence
atgagttttctatattttattttgggactttgtcccattttgtggctaatatttgcgctaaccgtacttggatggcccacatataaagctgcctttggttctttaattatttctgtactattatccgttgcgatctggcaacaaagttttctaaatacaatgacggctgcttgtgaaggcttcttaatggcactatggcctattattgttgtgattattgctgccgtatttacttataacttatctttacgaactcgtggtatggaaatcattaaacaaatgattaccagcgtttcaagcgacaaacgaattcttgtcttacttgtcgcatggtgctttggtggatttatggaaggtatggccggctttggtactgccattgccattcctgcaagtatgcttgtagctttaggctttgatccattattctcttgtttagtttgtctaattgccaacggagttcccactccatttggttccattggtattccaacggtcactttggctaatttagttggtcttgaaaatgctcagcttgcatttacacaaacccttcaattagctccatttatgttattatgtccattcttgatcgttatggtcacaggaaaagggtttaaagcattaaaaggcgtcacagcacttactttcgtttctggattaagcttcttgattcctcaaatgatcgttgcgaaatttgtaggttccgaattatgtgttgtggtaggaagcgtttgttcattattatgtaccattcttttgggttctaagataaaaccaaattctgaatacgaaatgaagttagaagcacacgaaaaaattacggttaaaaaggcattaacggcctggtcaccatttatctttatctttatcttcttattatcgacttcaaaattagtagctccaatccatacatacttgtcacaattcgcatcaaccgccattatttatacaggagacaatcctagcacaatgacatttacttggatcaacacaccaggtgtatggatcttcttatcagctattttgggtggcttgattcaaaaagctacatttagagatttcaaagtggtatttattgccacaatcaaacagatgtcgcaaaccattattaccatgctatgtgtacttggatgtgctaaaatcatgggatatgcaggtatgattgcgagtatcgcatctttcgccattgcggttacaggaagcttctatccattctttgccccatggatcggctgtctaggaacatttgtgacgggttcaggtacaagttcaggcgtattatttggtgccgtacaagaaagcgcagcccaaagcttgaatgccaatccatattggattgtcgcactaaactctttgggtgtggcagccggtaaaatgttgtcaccacaatctatcgccatcgcattaagcagtgtcgatggacaaggtcaagattctaaattattatccatgatcttgccttatggtgttggttttatcatcatcatgagttttgtggcttactttggtcaaatggtattctaa

SEQ ID NO: 2026 - DNA, 1638 bp, Unknown
  Artificiall/Consensus sequence
tataattatgaaattgggggtatttattttatgtcgaaatcttcagcggccaaaaagtcgattattgttggcggcctgatcggaacaggcggtctatttgtatcaaaactaattggattggcttatacaattccattttcatatatacttcaatcggaagcgtatcagtctgtatatgcacaatcttataatatatatgcgtatttattgacgatttttcagtcgggagtcccttttgcggtggccacacttgtagctcgttatattgctttagaagatgcgaaaagtgttattttagtaaagaaaattgcttttgcaattttaggtttaacgggatttgttggaatgatcctcttatttactttatcgaatgtaattgcgccagctatggtcgccaagaatgcggatatcatggcaaactgtttaaaaatattatctctagcgatttttcttgttcctgtattatctgcatttagaggatattatcaaggcttaaaagaaatggaagaatatgctttttcacaagcttttgaacaagtattccgtgttgcctttttactaagtgcagcatgccttgtagtctatgcgtttggctgggataaaaagtatgcattatatgcggcggttatgtcaacttcagtggcaacgattgcggcaattgctcaatttgcgtattttgatcgtaaacaccaatgtgtagtggatgaaatggtacaaagacaaacgacacgttctcattcagctaagaaaatcttcagagaaattcttatcctagccattccttatttagtagtcgcaattttaggaaatattgaccaggtatttaatggtttcttacttcctacaggattaaagatgcattataatgccaaagatacaacgactgtcatttctgcatcaaactatgtggcaggtaaattaaatgcgatcccaatgattttgggtcctggttttgcgacagcgataattccgcatatttcagaggctttgtcaaagaaaaattataagttagttaagaaaaatgtgttggatagtatcaacgtagttttatatgtagctattcctgtatcgttttgtatttttgcgtatgcaggaccattgaattacacgttatattattccgaaaacttagaattgtgtacattcgttgtacaatggatggctttggaaggtttcttatctacattagctccgttagttacgaatttaatggtttctttggaattaagaaaaaatgtattaaaaaatcttgcgattggtgtattgatcaaaggagttcttttgattccatttgtatggatcatggggatcgcgggtgctgttatttcaagctttattggtacaggatatatcatttataaaaatttaaaagagattcaagatgtatacaacatttcatatcgtaaaacttcaattattgtagtgcgtattttgattggattgttcgcgttatggattacttcaatacttctatctaaagttggattgtatggtgttgaaggatcaaaactttcatgtttgttcaagatgtgtttaaatggtttattaagtgtaattgtatatgtggtagttactttgtatttaaaagttccacaaagtatttttcactttcaactaagaaagaaatcgggtgtataa

SEQ ID NO: 2027 - DNA, 378 bp, Unknown
  Artificiall/Consensus sequence
ggagagttggcttttcaaaaggaagtgaacaccgtgattaaaagaggagaactgtattatgcggatttaagccccgtggtgggcagcgaacagggcggcattcgccccgttttggttttgcaaaacgatattggcaacaaatacagccctaccgtaatcgccgcggcaaccacgtcgcggctgacaaaagcaaagctccccacccacatagagctgcccggcgacaaatattgcctgcccaaggacagcgtggtgctgctcgaacaaatccgcaccatcgacaaaaccagactgaaagaaaaaatcggagaactgcccgaggacgtgatgaaggaagtgaacaacgcgctgcttatcagtctcggctttttccactga

SEQ ID NO: 2028 - DNA, 366 bp, Unknown
  Artificiall/Consensus sequence
atgaggacgagagaatctgaggaaatgtacctcgaaaccattttgcttttaaagaaaaaaaagggcaatgtccgttccgtggacgtggtcgaggagctgggttacgccaagtcaagcgtatcccgcgcggtaaacctgcttatccaaaagggctacgtaaacatggacagaaacggagacttgacgcttaccgcaagcggcgaagaaaaagcctcctccgtgtttgaaaggcactattatattacgcgcgcgttgataaaaatgggcgccgacgcggctcttgccgaagccaacgcgtgcagaatcgaacacgtcgtttcggacgatatgtttgaattgattaaaaaattcgccgcgtgcgactga

SEQ ID NO: 2029 - DNA, 639 bp, Unknown
  Artificiall/Consensus sequence
atggtacaaaaaaaagcttttttaaatatttatgtgtcgtcttatccctttgaatgtgggagtcaaaatatatcattcgcaccgagagcggaggaaatcgaggcctgcacaaacgaaaatgtccgcaggcaaaagctttatgtatggaagcttttggagcttgccgtcggtgatttgtcgggcatggatttaaatagcttgaacctaaggaaagatgaaaacggaaaatggcagtcggataagatttatatttcgttgtcgcacagcggcaatgttgtcgcggcggcggtgtctgacagctcggtaggcttggatattgaatttttcaatgaaaaaaaattcggaaagtcgcttgcaaacagaattgcaacagagagcgaaaaatctttttttgcaaaagagcgtgctttttcggagcgagtgtgcgccttgtggacgaggaaagaaagcgaatttaagcgtaaaggagaaaaaattttcagaccgttttttacaggcgcgctttcgtcgccgtgcaggacatttttgctcaaatgtaatcatgaaagctatgttttgtcagtttcgggagaaagcgtttcaaaatcgtcatttgtcacgccttttgataatgtcgttgtcttcgaagaaataaaataa

SEQ ID NO: 2030 - DNA, 690 bp, Unknown
  Artificiall/Consensus sequence
atgtcaagcgggcatcgaaaaagagcgttttcaatgaaaaaaattgtgtgcgttgtacttgcggttttgtttgtttttgcttttgtcggctgttcaaacggcggtacgttttccgaaaaaaactatttgtcggaaaacgggcaaataaggagcataattattgacgtcgccgacagggagctgaacataggtttatcctccgacggacagataagcgtaaattacttcgacagcgaaaagcaatatcttgaaatttccgtttcggaaagcaacgagcttgtcatacgcttggcttacgacaggagctggacggattttttcggagtcaaaccggacaaaaaatatcgcggaataacggtgcttgtccccgaaaacctgcttgcctcgctcaatgcaagcacgaccaacggggacataaaggtatcctgtctcgacgtttcggaggaaataaatctctgttccaacggaggcgacgtaatttgcgagcgcgtcggcgcgggcgggaagataagcctcaaagccaaaaacggaaacattcgcggcaccgtcgcgggcggcttggacgaattttccgtttcctgcaaaatcaaaaagggcgactgcaatctgccgttgagcaaggagggcggcgacaaggagttttttgccgattgcaacaacggcgacatatacgtcgaatttgtaaaataa

SEQ ID NO: 2031 - DNA, 591 bp, Unknown
  Artificiall/Consensus sequence
atgaaaatcgttgcaactaacaaaaaggcttttcacgactatttcgtcatcgacagctttgaagcgggaatcaaccttgtaggctgcgaggtcaagtctgtgagagctggagaagtaaacttaaaggacagctatgccgttatacgcggcgggcagcttgtgcttgtttccgcatatataaaaaattacgacaagggcagcttttccaatgtggacagccgccgcgacagaaggctgcttatgcacaggcaggaaattatgcggctgttaggcaaggttaaggaaaagggcttttcgcttgtgccccttaaaatgtaccttaacggttcgcttgtaaaggtggaaataggtcttgtaaagggcaagcagctttacgacaagaaaaaggctattgccgaaaaggatgcggaaagagacaaacagcggcagcttgccgatatgaaacggggaattgacaggaaacaaaaaaaatttcagaaagtgcgtcaaaatccttttcaacccaatcaaaatttgatagaatatataagcgtcgtgcaaacgtctcgtaaacgctactgtggctcagtcggtagagcagctgattcgtaa

SEQ ID NO: 2032 - DNA, 807 bp, Unknown
  Artificiall/Consensus sequence
atgaagctgacgggaaaaacggcggttgtcaccggcggaacaaaaggcataggagccgagctttgccgacttttttcgcaagcggtagcaaatacggtttgtcttgcgcgcagctgcggcgagggcgaaaaaaacgggattttttacatcccgtgcgacgtttgcgacgcggcggcggtggaaaacgccttccgcgcaatcggggaaaaattcggcagagtggattttttgataaacaatgcgggcatgggcatttccggctcggtggaaaatacgtcggagcgcgatttcgacagcatttcggacgtcaatttcaagggcacgtacaactgcatacgcttcggtctgccgctgcttcggcaaagcaagggcaggctcgtcaacgtgtccagcgtggcgggggcgattgccataccctatcaggcgttttactccgcaaccaaagcggcggttctcagtctttcggacgcgctcagaaacgaggtgcgcccctttggcgtaaaggtgcttgccgtcctgcccggcgacgtgaaaacctgcttcaccgagtcgagaagaaaaaataccgacgagggagtttatgccgcatacgcggaaaattcggttaaggttatggaaaaggacgagcagcaggggatgagcgccgcctacgccgcaaaaaaaatctttgcctgcgccgtcaaaagaaatatgccgcacgtcaaggtcataggcgtgaaatacaaatttttgtattttgcggcaggcattttgccgaggcggctcaaagattggctgctgttcaaaatttacggcggagagagctaa

SEQ ID NO: 2033 - DNA, 396 bp, Unknown
  Artificiall/Consensus sequence
attatgagatattcggaacagagagaaaaaatacttcttgcggtcaaaaactgttgcgaccatccgaccgcggaggtcatttattcccgagtcaaggcgcagatgcccgatatttcgatgggcactgtgtacagaaatttgcgtctgcttgcggaaatgggcttggttgacacgttggagacaacggacaaaagcctgcactacgacggaaacacggaggagcacgttcattttatctgtacgggctgcaacaaaataaccgatgttttcgtcagagcgaaaattcccgcgccgttgaaggatgacggttatcacgtcacaggcagcaagcagatgatttacggtctttgtccggaatgccggaaagaaaataaaaaatttttacaaggagattaa

SEQ ID NO: 2034 - DNA, 1167 bp, Unknown
  Artificiall/Consensus sequence
atgcttggaaactttacttactgcaatcccaccaaactgtatttcggaaaaaatgctctcgacggactgaacaaggagcttccgcgttacggcaaaaacattatgctcatttacggcggcggctccatcaagaaaaacggaatatacgacaaagtggttgacattctcaaacgcaacggcaaggaaattttcgaggacggcggcgttatgcccaatcccacggcggaaaaactcagggacggagtagagaaggcgcgcgcggcaaaagccgacctgctgcttgcggtgggcggcggctcggtgtgcgactatgccaaagcggtgtccgtatcggttttctgcaacgaggacgcttgggacaaatatttcgacagattcgaggacgttgacaatcccatagtgcctgtcggatgcgttttgaccatggcgggcacgggcagcgagatgaacggcggctcggtcatcaccaatcgcgagaaaaagctgaaaataggtcacgttttcggagaaaatgtttttcccaaattctccgtgctcaatccggagtttaccatgacggtgccccgctatcagatgatttcgggcatttacgacatcatgtcccacatactcgaacagtatttttcggggacggacgacaatacgtcggactatatcatggaaggtcttttgaagtcgctgataaacagcgccgaagcggcggtgaaaaacccgttggactatgaggcgcgcagcaacattatgtggacggcgacctgggcgctgaacacgctggtggcgaaaggaaaatcaaccgactgggaggtgcatatgctcggacaggcagtcggcgcgcacacggacgcggcgcacggcatgacgctttcggcggtctctctgccttactaccgccatattctcacttacggtctcgaaaaattcagaagatacgccgtcaacgtctggaacgtcgacacgcagggtaagacagacgagcagacggctctcgaaggcttggaaaaaatggagagctggatgaaaaaaatcgggcttgtgatgaacataaccgagctgggcgcgtccgaaagcagtataaacgatattgcggacagcgtgctgattatggacggtggttacaaaactctggacaaaaacgaaatacgcgaaatactcaaaaagagtctttga

SEQ ID NO: 2035 - DNA, 396 bp, Unknown
  Artificiall/Consensus sequence
atgcttaaattgaaacaggcggagcttgaagaaataaaggaagtgcgaaaaagcgttttcggcgacgctgattttgacgacgaggggctttgtctgcacgttttggctcgcgacggcgacgaaaaggcgggatgcgtttcgttgaaaaaggacggcgatttcgtccgtatttacgcgttgggagtaaaagaaaacctgcgtggaaaaatgacgggagaggcgttgcttaaaatggcggagtttctctctctcaaccgcgattgcagggaaacgtatgtgactgtcgggcaaaacgagggattttttgaaaaattcggctataaaaaaacatcgggaaaccgtatggagaaaagcctgtttgacggctgcaactgttgttctcacaactccgattga

SEQ ID NO: 2036 - DNA, 1122 bp, Unknown
  Artificiall/Consensus sequence
atggacaagaagcgacgcaacaaaatcagcttcgtcaccacgctgttcggattgattgcaaacgccttgctttgcgcgggtaaatttgcggtggggcttttgtgcggcaacattgccgtcactgccgacgcggtaaacaatctttccgacgcgggcaacaatgttgtcacgctgatagcaatcaaggtggcgggcaagcctgcggacaaggagcaccccttcggacacgaaagggtagaatatgtttccgcgctggtcgtcgcttttattatactttttttgggcgtggagctggcggtgtcttccgttgaaaagataatactcaatttcaaagagccatatctgcccgaatttgacgcgtggctggtttacgttttgtcgttttccgttgtcgtcaaggtcgtcatgtttttcgtttacaggacaaacggtaaaaaagcgcagtctcccgtgctaggagcaatggcgttggacagcattatggacgttgccgccaccgccgccgtgcttgcggcgattcttatcggcagattggcgagcgtcaatcttgacgggtacatgggacttgccgtatccgttctgatatttgtcggcgggataaagatagcaaaggataccgtgagcggtttaatcggggttgcacccgacaaaaagctcattgccgagctggaagccgaaatcgcggcttacgacggcgtactcggcgtccacgaccttttggtgcacagctacggaccttacaatacattcgtcacggtgcacgccgaggtggacgcaaaagccgatatgcttgccgcgcacgagcggatagaccgaatagaaagagattttctcgaaacacgaaacatacatctgttggttcatcttgaccccaccgaaaaggacaatcccgaaatcgaggcggttttgccgtcgataaaggaagttttgtcgtccgttgccgacggtcttaatttccatgacgtgcgacttgtcaggcagggcggcgcggaaaaaatatttttcgatatggttgcgcctttcgagctggaaaagtcggatgaagagcttaaaaatcttgccgaaagccgcctttttgaaaaaacaggcatgagcttttcggttacggttgacagagagtga

SEQ ID NO: 2037 - DNA, 927 bp, Unknown
  Artificiall/Consensus sequence
atgcgcgaatttttcctgaattcgggaatttattttgaagaaaacgtaccgctcaaaaaactcacaaccttcggaacgggaggccccgcgaggtacgttgttcagcccaaggacgagcgcgaaataagcgccgttctgacttacttgaagcaaaacgacgttccttatttctgtctggggggaggcagcaacgtgctggcgtcggacgacggtttttcgggcgtggtgattgttgtcggacggtttatgtctcagatattttttgaaaacggcttgcttgttgcgcaggcgggagccaaggcgtgtcaggtggcgcatttcgcctgcatcaacggactttcgggtgcggagtttcttgcgggaatccccgcgtgcatgggcggagcggcgtatatgaacgccggctgcttcgacagggagatgtccgacgtcgttgcgggagttaaggctgcggacgaaaacggagaaaaggaattcggtcacgcgaggtgcggctttgcgtacagaaaatctgtctttcagtcaaacggaatgattgtcacccgcgttttgttggctctcaaaccggaaaaaccggaaaaaataagggcggcgatgaaggagattttggaaaaaaagaagcttacccaaccattggaatatccgagcgcgggcagcatattccgcgccgagggcggcgcgcccgcgggacttttaatcgacagggcgggtttaaaggggctgcgcgcgggaggagcggaaatttctctcaagcatgcaaacttcattgtgaacaagggcggagcaaccgcaaaagacatactcgagcttatggacgcggcgggcagcgcggtcaagcgcaagttcggcgttgtgctgaggcctgaaataaaatatcttggagacaccgatgatatcgggagattatcatattcattcacgttatag

SEQ ID NO: 2038 - DNA, 606 bp, Unknown
  Artificiall/Consensus sequence
atgaatttacccaacagattgtctttgctgcgaatagctcttgtgccggttatggcggtgtgtttttacataaatttcgactacggagctttgcttgcggtagcggtgtttcttattgctgcatttaccgattttctcgacggttacattgcaagaaaaacaaatcagattaccgaacttggaaaattgcttgaccccgttgccgacaagcttttggtggcggtggcgctttttatggcaacaggcgctcgcgtgcttgaaaatgagtttattccttattatattacggacatctgcgcgtcaattattatcggaagggagctttttataagcgttttcaggcaaattgcagcagctaagggctttgtaatgcaggcgaatgtttacgggaaaatcaaaacagttgtgcaagatattgcattgccgctgatgttgtttcttaaaatgaaggatgtgattatcggatggtcgcagactttttacgacgttgtattctacaatgcattgggattgttgattttggcgacaatattaactattatttcaggcatagtatatatttgtcgcaacaaaaatttgctgagagcggaagataaaaaatgttaa

SEQ ID NO: 2039 - DNA, 369 bp, Unknown
  Artificiall/Consensus sequence
atgaagtcgttacaagaactcaacgcaatcagagagagaatgcaaaaacagacgctcaacagagacgccgcgacggaaaattccacgcgcgtggtggtgggcatggctacctgcggtatagccgccggcgccaagccggttatgagcgcgtttctcgaagaggtttccaaacgcaatttaaagcacgtcgttgtgagccaaacgggctgcataggcatgtgcaagctggaaccgattgtagaagtgttcgtaccgggacaggaaaaggtgacttacgtcaaggtcacgcccgaaaaggtgtcgagaatagtcgccgagcatattgtcaacaatcagcctgtaaaagaatttacagtagatgagaaataa

SEQ ID NO: 2040 - DNA, 747 bp, Unknown
  Artificiall/Consensus sequence
ttgctttttctccgattttgtgttaaaatcaaagaggagaaaaatttattgaaagtttttgcaatcagcgatttacatttgtccactacggtaaacaaacctatggatatcttcggacctaattggagcaatcatttccttgcaatcaaggaggattgggaaaaaaaggtatccgacgaagacgtagtgcttatgccgggtgatttcagctgggcaatcaaatcggaggacgccgaaagcgatttcgcattgttcaaggagcttaaaggcaaaaaggttattctcagaggaaaccacgatttttggtggaacacgataagtcaggtaagagcaattttaccggaaggctttttcgccatacagaacgacgcgttaaagttcggcaacctgattgtttgcggttcgcgcgggtgggttttgcccgagcctaacagaccgcttaatgaacgcgacaacaaaatttatttgcgtgaaatcgagagaatcaagctgtcgcttgccgctatggagaaactgcggcaggagggtgaccgtgtgatatgtattatgcattatccgcccttcaacggcaggcgcgaggaaagcgaatttgtcaggcagttgatactgcacgacgtggacacggtcgtatacggacatctgcacggcaaggaagtcagaagcgacttgtttgtcagaaaattcaacatgaatttctggttgacttccgccgatttggtggatttcaaattgaccgaaataatttga

SEQ ID NO: 2041 - DNA, 312 bp, Unknown
  Artificiall/Consensus sequence
atggcaaaagctaaaaaaactcagaaggcggccgaaccgagaattatgaacggtcaccttgtgaaggaagccaaagctcctctttacaaggtcaagcacgccaaaggcgacaagccttaccaactcagcgacaaaaaaatcaaggtcacgcttgtaaaaagcactatcggctgtttgaaggtgcagcagaggacggttgaagcgttgggactcaaaaagattcgctcttttaaaattctcaacgacaacgacgccgttcgcggcatgattttccgcgtgaagcatcttgtgaccgtcgaggagcttaaatag

SEQ ID NO: 2042 - DNA, 855 bp, Unknown
  Artificiall/Consensus sequence
atgcacatacagtggtttccgggacatatgaccaaatcattgagaatgatggaggagagcgtaaaggttgtggacgcaataggttacgtccttgactgccgtgctcctttttcttgtttcaatcccgctttcggtcagtacactgaaaaaaagccgtgcgtatttctgttaaacaagtccgaccttgccgacgaaaagaccaccgacaggtggcttgcatattttgcttcaaagggagacaaggcgattgccttgaacgcaaacgaaaaggggtgcgcaaaacaggtggtaaaggcattcgattcgctggaaatgaaaaatgttttgcgtttaagacaaaaaggagtagtcagacccgtcaggataatgattatcggcgtgcccaattcaggtaaatcaagcatcataaatcttttgagcggcaggaaaagcgccgttacgggaaacaagccgggcgtgacgcggggaaagcaatggattcgtctcggcgacggcttggagctgcttgatacgccgggcacgttgtggtcaagattcgagaaccaatgcgtagcgcagaatctgttttttatcggaagcataagcgacaatgtcgtggatttgtgcgagggggggcaagcccttctcgacaggctcacagaggtggctcccgacgctttgaaaaaccgttacaaattgacggacggggatttgagagacgaaggattgatggataaaatttgtatcaagcgcggctgtctaaacaagggagagcctgacagggaaagatgcgccgccgcgattatcgacgatttcagaaaaggaagaatggggcgcgtgtctctggaagcgccgcaagcggaagatgaagcttaa

SEQ ID NO: 2043 - DNA, 1254 bp, Unknown
  Artificiall/Consensus sequence
atggagtttatgaactgcctggcaaccgctgccgaaaccatcggacaatggggattttccgaaggatttgcgagtatcatgtcggaaatcgaaaatcccacgtttgtcggctggctggtcaaagggttgctcgacgcggtggggaattacggctgggccgtggtgctttttaccgtaatactcaaaatcattactttgccgctggatttctggcagcgtttttccatgaagaaaaacgcaaaaatgatgtccgagcttgcgccgattatggcaaagctggacaaggcttacgccaacgacaaaaacaagctcaatcaggaaaagcagaagctttacaaaaagcacggctacaatatgctttcgggctgtctgcccatgattgtgacaatgacaatcttttttgtcatgttcggcggtctcaatcaatgttccgcttacgtcaacctcaaggtttacagcgagcttagcgtgcactacaccgatacgctttctgccgagctgtcaaagcacacggaggaatacgaaagcaagcgctatgacattttgctttcgggaaaatcgacggcaatcgaggattacaagacgtggctgggcggtcagggcgttgcggaaagcgctttcgacgcggaaataagcgcggcgacaagccgtatttcccaaatcaaggcggaggcacaggcggaggcgcgcaaagcggtgggagagttctatctcgaagcaaaggagggctttttgtggattaccaacataagccgtcccgacacttgggttgagtcctttccggaaacggcggaaaagtttaccggcacgctcacaaagaaatacagggcgtacaaggacgaattcgactccgagctttacggcgaaatctacaagggcataagcgaacagggcgtaggctacaaggtgggcgacaagcattggaacggtcttatgatactgcccgtgctgtccatagctctgagctttctttccacgtttatttcaaacaaaacgagcaaaaagaaaaacgaggaggaacagcagctcgaccccaacgcggcggcggctcagagcagcaacaaggtgatgatgttcgtcatgcccgtcatcatgggtgttttcggctttgtttatacggctacgtttgcgctgtatatggtttgctcgagcctgctgtccattctgtttacgctggcgatgaatcccataatcgacaggcggattgcaaaaatagagtccaaggtggaaaaacccgattacaggagaaaataa

SEQ ID NO: 2044 - DNA, 711 bp, Unknown
  Artificiall/Consensus sequence
atgcaacggctgcggactgcaaaaggagggattgtgcaaatgatagcaatcaaatacgccaagcgttatcctttgtctatgatttcacagtccgatatgctcaacgtaataaaaagaattttgacgcgggcgggcgtaaaggtcgaatattcggcgggcttcaatccgcatatgcttctgtatttttcgcccgcgctttcgctgggcatagaaagcgagtgcgaatacgtttgcgccgccgcggggtacgcgcccgatttgaaagaaaaactcaatgacgcggctccgtcgggtttcgagtgcctcaaagttttttctttgccctgtgaacccaaccttaccgcgaggtcttacgccgcgcattatgtgttcaaagcgcgcggacttggaaagcaggaactttcttccattgcgggaaaccccgattttaccgtcttgttcaaggacaagaacggagaaaaagtcaaatccgccggcgaaaaaatctatatgctcaaagctgtcggcgatgatgccgcggaagccgtccttgcctgcggcaacgacaatctgcgcgcagacagagtgttgaagcagctgtgcgcggatttttctctcgattgggacgccgcaacgataaccaaaatcagactgctgcttgacggagcggaggacgcggacgaatttcttttgaagctgcaaaaaaacgcggccgcagcttgcaaaaattga

SEQ ID NO: 2045 - DNA, 675 bp, Unknown
  Artificiall/Consensus sequence
tctgagacagctgtcgcacatttcttcttctatcggaatgtaatttcttttgcagacagggcaaagctttgtttcctcttcgaggtcgaagtcgtcgtcgaggagtatgtctttgggcataagccccaactcggctttgcatatatcgcacatttcctgcctgctgtcgatataattcaaatcgcagcgggggcatttaatgtaagtaattttgctcataaacctaaaaaacctctgttctcggatttgcctgcatattatatattcaattatccgaattgtaaactgtttaaggcgaatttttttcaaaaaaaatatacggagtatcggaggcaaccgacggcggcgcaaaagagtgtaaaaacgtcgtttttgggcacaattctgaaacaaaactcttttttcgcatatactacatatagaggtgaaaaattgcgaaaagtaacgacggacatcaacattgcgaaaaaaagagtggatatgttaaagggcaaggatttgcttgtgagatacaacaaggggcgcaacaaaatcagttatttcaagggcagaataacggaggcgcacagaaacgtttttgtaatcatggttttcgacgagatattcgacaggctgagctgttcctactccgaccttttgtgcggggacgtggcgtttaaggaaatcaaaagttaa

SEQ ID NO: 2046 - DNA, 1116 bp, Unknown
  Artificiall/Consensus sequence
atggctaaatttaaaaaaactcttgccgcttttgctatgcctgttgtcgcgatgattgccgccgcagtcacctgcttttttgtaccctttgacaagcagtatcttgattatttcgattttcgtacccttgcgtgtctgttctgcacgctagcggttgtgtgcgcttttaaaaatataagatttttcaggtggctcgcggatgtgattgtgcgcagattcaaaacggtcaggggagccgtaatcgcgcttgtgttcgtaacttatttcggttccatgattatggcaaacgatatggcgctcatcacctttttgccgttgggctttctcgtgctggaatcctgcgcgcagagaaaatatcttgcttttgtttttgtcatgcaaaacgtcgccgcaaacctcggcggaatgctcactcccttcggcaatcctcagaatctgtacctgtattccttctattcctattcggcgggagagttttttcgcgttatggctgtgccctttgccgttgcctttatactcattttggcgtcctgtctgtttgtcaagccgttgaaaataaaggctgtttcgacgcaggtgccgcgtccgccgttgttcaagactgttgcgtattccgtactgtttgcagtgtcggtgctcatagtttttcgtgtttttccctattggtgggggctggcagccgtcgttgcggcgttgttgctccttgacccggcaagtctggtcaaggtggattacaagcttcttgtcacctttgccgcgtttttcgtttttgcaggcaatatggcgcgcatagacgcggttaaggaatttttaagctctttggtggcggcttctcctttgcttgtgggagtcgcgtcctgtcaggtgttgagcaacgtgcctgcgtccatgctgctttcccgttttaccgccgacaaaaacgccttgctgattgccgtaaacataggcggactcggcacccccgtcgcgtctcttgcaagtctgattacgcttggagaataccgctccgcaaacggcggcggcgctcggcgttatctcggtttgttttccgcaatcaatttttcgtttcttgcaatcctgacggcggtttcgctgttgattttgccgctgctctaa

SEQ ID NO: 2047 - DNA, 882 bp, Unknown
  Artificiall/Consensus sequence
atgacgacgttaaacaaaaaaaattcttttgcagaatatataaagatatatgccatgctgacacttgcggggacgcttatggcgctgggaatctatgtcttcgtgctgccctgttccgttgtggcggggggaataggcggactgagcaacatcctgtattatacctttaacatacccgtgagcataggcagcatagcgctgaacgcgccgctgctgattgccgcgctgttcaaactcaaaaagtcctattcagtcaggacggttttcgcctgcgtggtttattcgtcggtgacgctgctctttgaaaaaataaatttctttcagttttcggacagcaggattatcggcgtggtaatggggggagcgctttcggctgcggccataacggttgcttactttgccggcggcagcaacggaggcagcgaaatcgtaaccggactggtcagcgtcaaaaatccccacgtggaaatgggcaaggttctgcttatcttcaatctgggagtttacgcgctcgcgtttgcgctgcaaagagaattgatgcaggtgctttactcgctgctgatgtcatacgtgacctccttctgcgtcaaaatttttatgaacgggatagaccccgtgctgaaatacacggtgataaccaaaaaatcgcaggagcttgacgcggaacttttcaaggttttcaagagaggcgccacgaatatagaggtagtgaccgaatacggcgagcctaccgacagaaaggttgttatcgtcgtcatacagtaccgacagaatcaggtgttcaagcgaattttgcgcaaggtggacgaggagtgtttcgcattttgcacttcgataaacacggtgttgaacaagcccgatttcaataagagatacaaataa

SEQ ID NO: 2048 - DNA, 378 bp, Unknown
  Artificiall/Consensus sequence
atgtccaacgcagcggtaaaaagaagtaattcgggcgaaataatcaggggcggactgttgagttttgttttcgccacaatacttgtgcttgtcttttcactgattgtcaagcttacgaatatgtcggcaaccgccgtgccgatagtaaatcaggtaataaaaattttaagcgtatttctaggcgtgtttttctctcttaaaaacaaggaaaaatgctggctgaaaggcattttgtccgctttgcttttcgccgtgctcagctttgtggttttttcccttctcgcaaacagcttcaattgggcgggattcggaattgacctggcaatcgacgcggttgtaggggcgattgcaggcattatttgcggtttgagaaaataa

SEQ ID NO: 2049 - DNA, 459 bp, Unknown
  Artificiall/Consensus sequence
gccgcatattcaattattgcggaaaaatacttgcaaaatttttgtctttgtgctatactgccaaagcattgtattggaggtcaagatgatttcaaccttgttggcggcttctgccggacttattttgggcatcagaataacattgatggcgttgatgctaatctgcgccgtctgtataatagttttcgtaatgcgtcagcacggcgaggaggacggtcttggagcaatcagcggtcagaccgaaacgcaggacagcttttacggcaaaaacaagtccaagagaaaggaaagcagactcaagctgtggaccatgatttgcggcatagtgatagccgttttgagtatagcttggtttgttgtggaattgctggtttgacaacgtacctgacggcagagcttggtttctgccgtttttttattgaaaaaggaaagttcttaaatgaaaatcgttgcaactaa

SEQ ID NO: 2050 - DNA, 888 bp, Unknown
  Artificiall/Consensus sequence
atggaaatttacgacaaaaagtttgtggaactcggcaacggagaaaaatacgcgttcatcgaaacgggaaagggcgcgccgttgctgcttattcacggcaacatgtcaagcggcgtgcatttttcgcctatcttgcccgcccttgccgaaaaatttcattgcttcgcacccgatttgcgcggcttcggcgacagcagctacaacaaacccttcggcagcctgaaagagcttgccggggacgtaaagctgtttgccgacagaatgggcttgaaggaggcatacgtcataggttggtccaccggcggcggagtggctttggagcttgcggctgccgagccgcaatttgtcaaagccgttttttccattgagggagcgagccacaagggatatcccatattcaaaaaagacgaaaagggtatgccgatagtaggcagtctttattcctctcccgacgaaatgggagaagaccccgttcaggtcaagcccgtgagtctagcctttgccgccaaaaactttcaggcgacggacgctctgtggaaagccaccatatacgttgtgaacaagccctctcagaaggacaacgaaatacttataaacgagaccatgaagcaggtttgtctcaacgagctggattggtcgcttgcaaacataaatatgtccgactcgcccaatttttatcagaagggcgacgacacaatcaaaaacgtcgtgtgcccctgcgcgttcacaagcggagagctggacatggtagttccgcgctacatggtcatggaaaacgtaaacgcggtgaaaaacagcaagctcttggcttacgaaaagtgcggacattcgccgcttgtcgattgccccgacagactgataaaggacataacggaattttttgcctga

SEQ ID NO: 2051 - DNA, 573 bp, Unknown
  Artificiall/Consensus sequence
gtgtggactttttgctgttcacacttttttattttttcggaggtaaaggttatcaaagatttacagaccaacgagcaaatcagagacagagaggtgcggctcatcggttcggacggagcgcagctcggtatcatgtctgcgcgacaggcgcagcagattgcggatgacgctcatttggatttggttaaaatttcaccgaattctgttccgcccgtctgcaaagtgatggactacggcaagtatcgttacgagcagaacaagcgcgaaaaggaagccagaaaaaatcaaaaaatcgtggagctgaaagaaatcagactttcgatgacaatcgacgagggcgacattgccacaaaggcgaaaaacgccgtcaaatttttgaaggacggcgacaaagtcaaggtaagtctcaggatgagaggcagacaaatggcgtttgtgggcaacggaatcgaggtcgccaacagcttttacgaaaagataaaggactacgccacgatagaaaagaagcctttggcggaaggcagattcatcaccatggtgcttgctcctgtcgataacaaaaatacgaaataa

SEQ ID NO: 2052 - DNA, 1323 bp, Unknown
  Artificiall/Consensus sequence
atggtacatagctttaaggtaaacgacgaatattttgttttcgactcggagagcggctcgctccacacggcggacagacttgttttcgcgttgctcaatgacaataaggaaatactttcgcaatattccgccgacgaaacggcggaagcgcaggctgaaatcgaagcccttaaagaaaaagggctgcttttttccgcgccgcagacttcggtcgaaggaaattacgaggcgggtatcgtgaaatcgctttgcctgcatttaagtcacgattgcaatctgagatgccgttattgctttgccaatcagggcgactatcacggcaaacgcgaaaatatgcccttgaacgtcgcgcttaaagccgtggatatgctgattgcaaagtcgggcgcggtaaaaaatctggaaatggattttttcggcggcgaacctctcatgaatttcgacgttttgcgtcagacggttagttacgccaaagaacaggctcgaaaggcggggaaaatctttaaattcacctgcacgacaaacggactgctgttggacagggaaaaatccgattatctcaacgaggaaatggacaatgtggttttaagcctcgacggcagacgcgaggtcaatgattttgcccggccgtgtcccaacggcagaggcagttttgaccttattgtcgacaatttccgttattttcgttctataagaggaagcaaaagctattttctcagagggaccttcacgcatttcaacaccgattttgccaaagacgtgctttttatgcgcgagctgggctttgagcagctttcagtggaacccgccgttctgccgcgcggaagcgaaatggaaataaaggactccgacctgccggaaattttcggacagtacgaggagcttgcaaagcaatatgtcaagcttcgcaaaaatcccgaaacgtggtttagcttttttcatttcaatatcgatttggaaaacggaccgtgtctcaaaaaaagacttaaaggctgcggcgccggctgtgaatatcttgccgtcgttcccgacggcggagtgtatccctgccatcagttcgcaggcgaaaaggaatatctgctcggcaatgtgttcgatatgagtcttgacgaatccaagagaaaaatttttgcttcaagcaatcttttttccaaagaggactgcaaggactgctgggcaaaatatctttgcagcggcgggtgctcggcaaatgcggtgcacttcaacggcgacataaacaagccattttctcaggcgtgcgcgctgatgaaaaagaggacggaatgcgcgctttacgtatatgcgaaagagcggctaatttaa

SEQ ID NO: 2053 - DNA, 669 bp, Unknown
  Artificiall/Consensus sequence
atgacagacaaaaacgatatgggaacggaaaaggaacaggaaaaaaacgggacgcccgaaaactgcggcgaagaaaagacagaggctgcgcccgaaacggaagcggagtctgacaagactttaacgcaaaacgccgaagaaatggacgctatggacgagccgcgtcttagggaatacgcaaaagctttgattgacgggttgaccaaggaaaacgagattctgataaaggagcaggcggagcttaaaaagcagatagaaaagggaaactcttatctggatatgcttgccgctttgaaaagcgattttgaaaattatcgcaggcgcaccaacgctcaggcggaaaacagcgaaaaggagggcaggctgttcgtaataaaaaagcttttgcccgtgctcgacaccttcgacagggcgagggaaatgcttgacgaggtcaccatgacgacgttcaacctgatagtcaggcagttcgacaaggtgcttgccgactgcggcgtggaggtaatcgacgtgctggggcagccctttgaccccgccacagcaaacgcggtgcacagtctggaaacggacaaggaagaggaaaaaaacgtcgtgctggaagtttatgcaaacggctatcgctacggcgacaaggttttgagatacgcgcaggtttgcgtcggagtctga

SEQ ID NO: 2054 - DNA, 852 bp, Unknown
  Artificiall/Consensus sequence
atgaaaaaggcactgattactgttatcgcgttcttactcctgttttcgttctgcgcctgctctgcgggggaatttatttccgcctccaagctggaaaaaatcaaagagaaatccggtatagacgcaaatcccgtcgccacgctgacgctgcgctacaccgatataaacgaggaatcgagtggcgaggtttatacggtcgttatcgaatacgagcttcttatcgacaaagcgcccattaccgtcataaatttcatgaatctcattcagcagggattttacgacaacacggtggtggattatataggcgaaagataccttatcgccggcagatattcggaggaggacgacaagtttataaccaaagaatccggttacacgattaagggcgagtttcttgccaacggcttcaaggttgacgaaagcaaaaaggacggggacaacgcgcagcctatgctgggcagtctgattatgttccacaatgcgcagacttccacgaaaaattatttcgacaccgcaagcagcgcgtttttcatggcttttaccaacgagttttcaacggcgacggcggtacccatgtccaaggacaattacgctgttttcgcatacgtcaagagcagccgcatgatggtttccgaaaacggaggtttctatcccgcaggcgggacaggcagctccaattcgacgggtttggcttccaaattcgttgacgatatgagaaattacgaaacggatacgcaggaaacggacggctccgacttgcagaacgctccggaggaaacgattaccatcgtttcgataacgctggacaaggaatacaaaaatcttcccacaagctaccgtaaaaaggcttga

SEQ ID NO: 2055 - DNA, 627 bp, Unknown
  Artificiall/Consensus sequence
atggaattttggtggaacaacatgttaacgctgcaaaaggtgctttttatcgtcgcctgcgccacaactctgattatggttatccaaattatacttatgcttgtaggcgccggctccaacggcttcgaggctgccgatggcgaccttgtaggcggcgcggattttgacggagacgccgatttcgacggaggcagcgacatagctcagagcgacttgggcgctttcggcatgaagctgctcggcataagaagcataatggcgtttctgtgtattttttcgtgggtgggctacacctgcgtttatctcatggattggtggtgggctttgctcatcggggtgggcgccggcgtcgcggcgtcgctgcttgttgcgttgctcatgactctcgtcgaaaggactcagaccgacggcacgacaaacatacgccgtgcaatcggttgcagcgcggaagtttatctgcgcatacccgccgagcgcagcggtacgggaaaaatcaatgttatcgtgcaggaaaaaatggttgaggtcaacgccgtaaccgacgaaaacgaggatattcccaccggcgcggcggtcgtcgtggacagcgttgtgtcggacggtctcgttgtagtcaaaaaacaataa

SEQ ID NO: 2056 - DNA, 597 bp, Unknown
  Artificiall/Consensus sequence
ccgccgatttcggtctttccgcagcgctcaaagcgcttacgggcgtgtcgtaaaaatcggtgggaaatgagcgaaaacaaggaagccaagtggtatattctgcacacctatgcgggatatgaaaatatagtcaaggcaaatctggaacagatgattgaaaacaacaatcttcaagaacagattctcgacataaaaatccctaccgagcagaccatagaggaaaagaacggcaaaaagaaagcggtggaaaacaagacgatgccttgttacgttttcgtaaagctggtttactcctcccagctgtggtatatgctgacatatacctgccgcggcgtcaccggctttgtcggtccgcagggcaaggcatggcctctcgacgaggacgaggtcagacggctgcgtctcgaagaggtcgttgtcgatttcgatatggaaatcggagacagcgtaaaggtggtcaacggacctttcgagggacttatcggagtgataaaatcaatcgaccgcgcgcaccaaaaggtgggacttgtgctcaatatgttcggacgggaaaccgccgtcgaaatggattttgtgcaggtcgaggcattgaaatag

SEQ ID NO: 2057 - DNA, 594 bp, Unknown
  Artificiall/Consensus sequence
atgctgggattcgttagcggaaaggtcgtttcgatatacgagggaacggcggttgtcgaaaacaacggtcttggtttcgagcttgccgtttcgtccaacacgcttgacagtcttaaaacgggcgcggacgttaagctgtttacttatcttcaattgagagaggacgggcttacgctattcggttttgcaaccgtcgaagaaaaagagatgtttctcaaactcatttccgtttcggggattggtcccaaggtagccctgtccgtgttgtctgggcttaaaatgtccgacctgtcttccgcaatcgtcacgggagatatagccgtgcttacaagcgtaaaaggtctcggcaaaaagactgccgagagaattgttctcgagcttaaagacaaagtagacgtgtctcgcgaagcattcgtaaacgtatcgcccgccgccaaaggcagtctgctttcttccgaagccaacgaagccgtttcagtgcttgtttcgctcggactgagcagacaggatgcggcggcaagaattaaaaacgcgtcggaaaacggcgcggaaacaacggaggaattgctttcctacgcgcttaaaaacagctga

SEQ ID NO: 2058 - DNA, 960 bp, Unknown
  Artificiall/Consensus sequence
atggctaaatacgagctgattgcggacataggaaccgattttgtcaatatgtctttgaaaaacgcggattttgttttgcgggagcctgcgctggttttggcggacgcccgcaacgaaagcgattttctttccgcgggacttgccgccaaaaaggcagccgactcggaaaactcgaagcttgtctatcctttcgccgagggctgcgtcgcggacaaaaaagccgccgatttttttctgcggaaggcaatggaaaagcttctgccgtccacggcgtttccccccagagtggacgtttgctgtcttgtgcctgtcggctcgggcaacggcgaaaaaaaggttctggaagaaattttcaacaatataggcgtcaaatcggtcagattcaaagagtccgtgcttgccgccgccgcagcctgcttcaaggagtttgacaaaagagcgggaattgtagtggacataggctcctcagtgaccgaccttgcggcggtgagagaggacaaaatcgttgcgggctgttctttttatatcggaggagcgtattatacgcagcaaatttccgattacgttctgaaaaaatacgggctgcaaataacctttgccgaggcggaaaagctcaaactcaaatgcgcgggactttatcccaacgacgtttctttcggcacggtggcgggactcaacataaacaagggcgcagcggaagaaataactgtcaccgcgcgggaaatttacgacgttttggcagctcttaccgacaagctgtgtcaggtcgtgacaagccttttgctcaccgttcctcaggaaacgagcgcttatttcaaggaaagcccgatttttctctgcggcggcggcgctcagctgtcgggtatggaaaaatattttttcgacaaaatgaatatgggcgtgcttgttccgtcggacagctttctcgcagcggtaaagggcgccaagctccttttgtga

SEQ ID NO: 2059 - DNA, 1071 bp, Unknown
  Artificiall/Consensus sequence
atgagtatttggtgggtaataattctgtttttattgggtcttgctctgattatcaagggcggcgatttttttgtcgacgcggctacgtggatagcggaggtttcgggcgtgccgaaattcgtcataggcgcgacggtggtaagcgtagccacgaccttgcccgagcttcttgtttccattatagccacggcggagggaaatcttgacatagcggtaggcaactccgtcggctcggttgtcgcaaacatcgggcttattatgggcatatcaatggtttgcctgccttcggtgatgaaacgcagggacctgctcggcaagggaatattgcttgttgctagcataaccctgctatggattttttcgctgggaggcaaccttaatttttgggaaggaataatagtcctgcttattttcggactgtttatttttgaaaatctccgcagcgccaaaaagcacgaattgaagcctttgccgacatcggagggcgcggcggagttttctgcggacgctcaaaacgtgtttgccgaaacaaaggtcggctccgacggaggcgaagcgtcctctgcgggcggaggcgcggcgggcgtcaagcgcgacaagcgcactataacgataaatattctcaaattcctgttcggtacggctttcatagtcgccggcgcgcagctgcttgtaacctacggcagcgagcttgccgtgcgcatgaacgtgcccgaaagcataatcgcggtcaccatggttgcaatcggcacgtcgctgcccgaactggtgacgacaatcacggcaatcgcaaaaaagcaggcgtcgttgtcggtaggcaacattattggcgcaaacataatagacctgacgcttattctgcccgtctgttcgtttatcagcggcagaagcgggcttgacataaacgcgcagacggtgtttctcgatatgcccgtatgtctgggattcgtgctcatttccgtcgtgccgtcaatgataacggggaaattcgcgcgctggcaggggattaccttgcttgcgctctatatcggctatattgttgttctgagtacgggtgtgctgggcttttga

SEQ ID NO: 2060 - DNA, 1530 bp, Unknown
  Artificiall/Consensus sequence
ttgacaacaaatcgcaatgatttacagggggcaaaaattatgctggaaaagaccatgggcaattttacatcaaaccgtttcgtaacgctggacaaatctcagctcatcatcaacgcgctgcttgccgcaaaggacgacgtaaaggaaattctcagcgtggacgtggagccgcaggtgacttctttcgagccgcttaacggagaggctctcgtatccggcagggtgaatgtaaaggttcttaccaaagacgcggagggcgcgctcaacagcctcaattacaacgccgatttttcggacagatacaaaaacgagcttatcgagccaaacagctctcttacatttgaagcggacgtggttgacgcaaacgccgccgtcgaaaacggagcgataaaggtggaaatagtagccgacttgaacggaacccttactgaaacggctcagaactcctgtctgtcccgcgccgagggtatatacgtcaaggaggacgtaatcacggttggcagggttgctgcgactgtttcggacaattttacagtttcgggagaggcggaggtcaaatacggcatagaaaaggtgctgctcgcgcaaagcgacgtgtgtcttgcgcatgcggaagctcgcgacaatgttttgactctcgaaggggattgcgcgcttgttttgacttacatagccgtcggcggcggactcaaaagtcagctgataaaaataccgttcagggaggaagtgaacgccgaaggcttttcgggcgagggagaaataaacgtcttctgccgcgtcagaaatacgagaatacatctcgacgtgctggaagacgccgaaaacaatatatttacggcggaaatcaatattgcggtgcgggcgcaaaacatcgtggaggaggacgaggacgtaatctgcgacgcctattccgccacgcacgagcttgaactgtcgttctgccgtgttgcaagcactgtttcttacggcatgaccgccgcgacgtttaattcggcgggagaaatatccgtgccgggcgacgccgaaatcacaggcttctgcggactcaaagccgccgtgacaagcgtcagacctctcgacggcaaacttacgcttgaaggcgtgctcaccggaacgctgcttgcttccggcgggggcgacgcggcttatccgtttgcggtgcccttcgtgcacaccgtagaaaacgacgatataacggaaaatcttgtagtcagggcggacgcggcggtaaccgagtttgaataccgtcagggcagaaacgtcagcatgaatttcacggtctgcgtttcggcgaacctgtatcgcaacatagaagaaaactgcgtagccgacgcggtagagggagaggagctttccgaaaccatgggggcaatagaggtgtgcatagcaaaggcgggcgaaacgctttggcagatagcaaagagtctgcgcatgagcaaggaggatatcatggcagccaatcccgagcttgtgactcctttggaaaaggacgaaaaattagtcgtttatcattgtattgcaaaggactga

SEQ ID NO: 2061 - DNA, 942 bp, Unknown
  Artificiall/Consensus sequence
atggaaaaagaaaacaaaattgttctcaaaaacgaaagaaacgggcacgtaaacaagctggtaaacgaattgggcagctggggctttttcaaggttatttaccgcaacgatatgctgaaaattctcggcatgaacatactcatgctgattttattcgtgcctgtcggttatcttgcttacagatatcttatacaggtgtcgcagtttacgtcacgactgcccgttggcaacgcaatcggcttcggctacgcgccgtggcttggcgtcggcgctgaaatatcaagactcacaaatcttgccatgtcggagcttttgctgtggatgctggcagcaggcgccgtggtagggctgtcggttgccggcggcatggcgataataagggattctttctggacgggccgtctcaaggttttcaaggccttcgggcgcggaatcgttgaaaacggcgttgcgtgcgtcgtttgctttgttctgcttgtgggctgtgtaaacggcatttaccacgcctccgtcgccatgagggcttttcccgcatgggcaagcgttcttttgcaggtggttatgtggcttgcgttggcttttctgacgctgtatgtcatgacctttttaagcgtcaattccacatacaagcaatccgtgggagtaaatttgaagagtgcgtggcatatactgatgcgctatatcgtatcgacgattttcaaatttatcattgctttgcttcccgtagcgttgcttttgctcaccttcggcaatgtaatattctcgtttgtcatagctgttttcgcaatcttcggtttcttctacgtgattttcgtatggcagagccacatgatgattattttttccatttacaatccagtggaaaaaatcaagattgtaaaaagaaaaacgcagcagcccaaggctcaggccgaaaacaaaacggaaaatcagacggcttga

SEQ ID NO: 2062 - DNA, 510 bp, Unknown
  Artificiall/Consensus sequence
atgcaaagaaaactaggaaaagccacggatcaaaggcttgctttattgaaaaatcaggtttcctacctattgtggaacggcaaaatagagaccactctggcaagagccaaagaggtgcagaagctggctgagaaaaatctcacgcttgcaataaatacgtatcaggacgtcgtgaaggtacagaaaaccaaagtagtcaacggcaaggaaacaaaggttgacgtcatcaacgacggtcccaaaaagcttgcggcaagaagaaagctcatctccaatcttgtcgacattcaggaaaccaaaggacaaaaggagagcaagagcgcttacaatctgagaacaaaggacatcaagatgcctttgatagaaaagattttcaacgtttacgctcccaaattcgcagagcgctccgaacaaatcggtcagaagggcggctataccaccattcacaagctgggtatgcgtcgcggcgacgctgcggaaatggcaatcatcgaagtattgcccatctga

SEQ ID NO: 2063 - DNA, 558 bp, Unknown
  Artificiall/Consensus sequence
atgaaggattcggcaaaacggatagcgcttgcggctttgttcgcggcgctcgtttccggcggcaagctggcgcttatgttcatacccaacgtagaggtggtgagcatactgcttgccgttgccggatattgtttcgacgcgcttttttccctgtcggtaagtcttgtcttctgcacggtggaaactgcgctctggggcttcaacacctgggtgattctttattttgtctattggccgcttgtttccctgcttttcgggcttatcggcaaatcgcgccttaaaaacaggtgggttacggcggggcttgcggcggctatgaccttttttttcggcgtgctgtcaagcgttatcgacactctcattgctttcggcggcggaggctttgtgttcaacggcgaggatttttttctgcggttcggcattctttacgcaaggggaatcgtattttttgcggtgcacattgtatccaactttattcttttcgcactgctgttcagaccgctgtgcgagttggtgaacaaacttaaaataaaaatgtttcccgaggagtcgctgtga

SEQ ID NO: 2064 - DNA, 597 bp, Unknown
  Artificiall/Consensus sequence
atgtcttgcggaaaagtcaacagaaacgcgcgtctgacgacaccgcaaaaggagaataatatgcaggaaaaagattttgtgtcctacgaatacaggacaaaaacagtcaaaagcaaggacatgacaaaggcgacggatatgtacgaggccttcggttgggaagtgacctccgcggcccatacagccgtcgacaacacgactctttctttaaaacgcgacaggaaacaaaaacacaagcaggagctttcgcgtcttgaaagacaggcggaggaaattttcggcacgataaacaacttgcagcgcgcaaaaaccttgggagcaagcgtattctcttacattttcggctgcatcgctgcgctcttgctgggcggcggaatgagcctgattatgctaaatcaaaacaatttcgccgcgtttgtcggcggaatcgcgcttggcatcgcaggcattgcgctgtgctgcgtaaattattttatttacaaaaaaatggtcgaaaagaaaaccggagaactgctgccgatcatcgacgacaacgaagaaaagcttgccaatattctcgaaaaaggcaacgacctgcttaaagccgacttaatctga

SEQ ID NO: 2065 - DNA, 849 bp, Unknown
  Artificiall/Consensus sequence
atggcaggtctgaaattcaggattttaaaaagcttctggcttctgctggcattttccctgtttatcaggcaggcgtatatcttcggactttacacattgagtgtgctgatacatgaatcggcacactactttgttgccaaaaaatgcggctacaagtgcaattgtatagcggtttccgccttcggcgccgtcctgtacggcgaattcgacagcgttgacaaccgagacggcgtcaaaatcgcgctggcgggacctgcggcaaatgcggtgtgcgccttggttttcgtagcgctttggtggatgtttccggcgctttacgttttcagtcagccctttgtcgccgcaaacgtctcgctttgcctgataaatctgctgcccgcctatccgctggacggcgggcgcgttttcgtttctctgctttccgcgaaaaccgattacgcaaaagcgttgaaggtaagcaaaatcctttcggtggcgctgtctggcgcgctgttttttgtttttctgtgtatgtgctttgcgggcgtgcccaatttttctttgggattgtttgcggtcttcgtcctgtccgccgggctgtccgaaacaaagggcgaaattttcagcaagcaaatagttttcgaggtttacaaaaagagattggacaggggagtggaaaaaaagacgctggtgttttcggaggaggcgacgcttaaaagcgttgccaaaagaatgtcgcaccactttgtttatcggatagaggtggtggaggcaaaggacggagaggtaaaaaaagtcttttcgcacgcacagttcctcaatcttctttcctcccatgcgcttgacactccgttgaaagagttgttataa

SEQ ID NO: 2066 - DNA, 627 bp, Unknown
  Artificiall/Consensus sequence
atgaaaaacaaagaatttacgctgagcatcttccgcaacgaccccaccttcgccaacacggacaaggaggatttgcgaatccgcagaacaaaaacctttctcatgcaggcgttgataagactcatggaaaagcagagtttcgagcagataagcgtaatagacatctgcaacgaagcgcttgtgcaccgagccaccttttacaagcactacaaggacaaatacgaccttttgaccaacacgctcgaaacgctcaaggtctatattttcgcggataacgcaagcgagcgcgcatatttaaacgacaaggagctgtttttgaacgtggcggactgcgcgctcagctttttcgaggcgcaccgcagcacaatcaaaaacgtgctcaaccacaacaagaacgaaaccatgctggacatgattttctacaccacggaaaagacgcttaaacgctttatcgagtgcagaatcgagcagactcaaaagacgccctccgtgccgctgcccgtcatagtttcctttttttcgggcggcttttcctctctcattttgtggtggataaaccacgaggacgtctgcaccaaaaacgagattttaagctacatcacacgccttgtcgaagcgcggatttga

SEQ ID NO: 2067 - DNA, 867 bp, Unknown
  Artificiall/Consensus sequence
atgagctggcgggttgtagtggtaaggggacgttgcaagctggaatacaagctgggatatctcgtctgtcgcggcgaagaagtcaaaaagttgtttcttaacgagatatcctcgcttgtggtggagtctaccgcggtttctttgacggctgctttgttgagcgagttaatcaaaaacaaagtcaacattttgttttgcgacgaaaatcacaatccggtttcacagctgttgccgctttacggaagacacgattgcagcggagttttgcggcggcagctcaattggaaagaagaacataaaagcgcggtgtggacggcgattgtccgtatgaaaataaaaaagcagatggaatttctttccgaactttgctgtcctcagagcgagcttttgaaaagttatgtcgacggtaccgaattgaatgacagaacaaaccgtgaaggacacgcggcaaaggtatacttcgacgcattgttcggattgagctttaaaagaggagacaaaacctttctgaacggggcgttgaactatggatataccattttgctgtctgcgttcaacagggaaatcgcgggattgggtttcaatacacagctcggattggcgcacaaaagcgagttcaatcaattcaatctgagctgtgatttggtggagcctttcagggtgattgtggacaaagcggtgttcggaaaggataattgccaatttacgccggatttcaaacgatacctttgcgatattctcaacagagaaataaagatagacgacaaatattttgttgtaaacgatgcaatcggtatatacgccaagagcgttttcaacgcgttggaagacggggatacgtcaaaaataaaggaatatgagttttag

SEQ ID NO: 2068 - DNA, 837 bp, Unknown
  Artificiall/Consensus sequence
atggattggcaaaagctttggaacgatataacaacttttttttcaaacaattggcttaacatgatttggttcgtgctggcgcttgtgctcggtataattttgattaagattatatgcagcttgctttcaaagggacttgcaaaaaaaatggaccgcattgtgagcaattttatcgtggtaatcgtcaagttctgtctgtgtatggtgcttgttttcgtgcttgcgggcatcatgaacatcaacacgacgggacttgtcgcggtcatcagcgccgcgggactcacgctgtcgctgtcgttgcaggacagtctcagcaacgtggcgagcggtatgctgattgtgtcgcaaaagccttttaaggaaaaggattacgtcgaaatagacggggtgggcggtcagataacgcgcataggcgtgtttaccacggagctggtcacgttcgacaaccgcaaaataaccctgcccaaccgctccgttacttcaagcccgatagtaaattacgacgctatgcccacgcgccgcgttgacataaagttcaaagcttcgctttcttgcgagattgacaaaatcaaagccgagtcggaaaagattatttacgaggacccgagaacccaaaagggcagcttcaccattgtggtggacaatctcgacggcggcgtcgcctttgtcatcaagtattgggtagatacggcggattattgggacagcctttttcttaacaacgaaaaaatattcaagatgcttcaaaagctggacgtcgcgctaaacgtgtcggcggtgcgtcttttggaggacaggctttccgaaaagaaagacggggacaagacggcgttctga

SEQ ID NO: 2069 - DNA, 894 bp, Unknown
  Artificiall/Consensus sequence
atgaaatatgtgcttttttctctttcttgcaacgaaattcgacaaaaaacgagaaaattgtacaaatttagcgttttattttgtacaataacggtagacaagcgcaaatcgtatgtgttatactttatcacaaggaggccgatagaattgaaaatagctttaatcggtgaggatacggaaagcaaagccaaaatcagggaatattttgctcaaaacaatgattatgaatttgtgtttgacgaagcggacggctacaaggcgctgcaatatttcgacgaaaacgacgttgacgtggtgataacgcccattatgctgcccgaattgaatgcgttcgacttgatggagcatttcagaaacaaaaaatccatgaagtttctgattttgtcggaattgaagtcggaggcttttatgatgagatgtctgacaagcggagcggcgggatatttgttgaagccggtcaactgcgcggtgctcgccgaaaagctgcaaaatcttcaatcggcaaaaacaacctttacgactacgggcaagccgtccaatctcggcaaaactttggacgaaaagatttcaaacattttcataaccgtaggcatacccgcgcatatcaagggttatcagtatctgcgcgacggcatcaagctggttgtcgaaaactcgcagaaaatcaacagcataacaaaatgtctctatcccgagattgccaaacgcttcggcaccacgtcaagcaaggtggaaagggcaatcaggcacgcaatcgaggtcgcctggaacagaggcaaaatagaaaacatcaacaatttgttcggcaccaaaatttataccgccaacgaaaaaccgaccaacggcgagttcattgcgctgatagcggacaaaatgctgctggacgaaacctga

SEQ ID NO: 2070 - DNA, 1872 bp, Unknown
  Artificiall/Consensus sequence
atggattttttcgacgtaatagtaataggcgcgggacacgcaggctgcgaagcggcagtcgccgccgcaaaactcaaatgcaaaacgctcgtgcttgccgcaaatctcgacgcggtggcttttttggcgtgcaatcccagcataggaggcaccgccaaaggacagatagtaaaggaaatcgacgcgttgggcggacaaatggcgctgattgccgacaaatgcacgctgcaaatgcgtatgctcaacaaaagcaagggcgccgccgtttacagcccgcgcgcgcaggtggacaaaaacgcataccacacagagttcaagaaactcctcgaaagcaccgaaggtctgaggcttaggcagggagaagcggtaggaataaaaaaaataacaaaaaaatcccaaaccctgtgggaggtaagcaccgcggcgggagaaaaattccgctgcgtttccctcgtcgttgccacgggagtctatttgtcaagcagaatcatcgtgggcaagtacacaaaaaaacaaggccccaacggatttgcgggctgctatcggctttccgccgagctgaaaaagctgggattcgatttgagacgctttaaaacgggcacccccgcccgaatccaccgccgcagcgtcgatttttccaagaccgaaaggcaggagggcgacgaagcactgcccctgtcctttctcaacgaaaaagccaacaacagccgagtctgccatctgacatacaccacgccgcagaccaaagaactgattttgcggcacaaggacaaagcccctgtctacaacggctcgataaacggcgtaggtccgagatactgtccgtccatagaggacaaggttatcaggtttgcggacaaggaacgtcatcagatttttttggagccggagggcgaggacacggaggaaatttatctggcggggctgtcaagctccatgcccgtaaacgttcagagagaaatcgtgcgcacggtaaaggggcttgaaaacgctgaaatcatgcgcgacgcttacgccatagaatacgactgcatagaccctaccgaactgaatgcctctctgatgtcaaagcggcacacaggtctgtttttcgcagggcaaatctgcggcacaagcggctacgaggaggccgcaggtcagggacttgtcgcgggcataaacgccgcgcggcttgttcgaggcaagcccccctttgttttaagccgcaacagctcatatatcggcgtgctgattgacgatataaccgcaaagggagtggacgagccttacaggatgatgacggggcgcgcggagcaccgtcttttgctgcgtcaggacaacgccgacctcaggctcacgccgacagggcgcgaaatcgggcttgtggacgacgaaagatacgagaagtttatcggtcgcttaaaaagattggagggcatgaaaaagactgcggaaaaaacgctggacgcaaaaaccgcaaaccgcatacttttcgaggcgaaggaaaatccgacggaaacgggcgcgacggtttcggcgcttttgaaacgccccgccgtgcgcgcggaaatgcttgtaaacgcgggacttttttccgacatacccaaaaacgagttggaaagctttgaaacggaaataaagtacgcggggtacatcgccaaagcggaagcgcagatgaaatcccaagcggcgctggaagcaaaaaagctgccgcgcggaacggactttacgcaaatcaaaggccttaaaacggaagccgcgacaaagctcaacaaaattatgccggaaaatctgctgcgcgcaagcgaaataagcggagtcagccccgcggatattcaggttttgtcggtgtggctggcaataaaatcaagaaacgaaaagaaaggagactga

SEQ ID NO: 2071 - DNA, 288 bp, Unknown
  Artificiall/Consensus sequence
atggagcttaagcagcctgccgcggcaggtacgttggagtccggagacatacttatcgagctggagcctaacgagggcaaggggctgacaatcagacttgacagtacggttgccaaccaattcggaaaaagaatcaaggaagtcatttcggagacctttgccgaaatgggcgtcaaggacggctttgtagacgcgacggacaagggcgcgttggattgcacaataagggcgagagtcaaggcggcgttgatacgcgctcttggcaaggacagaaataaatgggaataa

SEQ ID NO: 2072 - DNA, 972 bp, Unknown
  Artificiall/Consensus sequence
atgatggaaatagaaaaaccaagaatgaatgtcgaagaaaactccgacggcacttatataaaaattgtcgttgagccgttggaaagaggtttcggcatcacgcttggaaacgctttgagaagagttttgctttctgcccttcccggagttgccgccgtaggcgtaaaaatcgacggcgtacagcacgaattctccacaataaacggcgtcaaagaggacgttacagaaattattctcaatctcaaacaaatagcgatgaagtccgacaataccgcacgcgatttcagaaaaaccctgacaatcagcaaggtcggtccctgcgaggtgacggcggcggacatttccaccgacgccgaagtggaaattcttaacccctcgctccatatctgcacgatagaccagggcggtcagctgaactgcgaaatcacggtcgggcggggcagaggatacgtttcggcggagaagaataaggaagtcaacagagagctaaagcttgcgtatcccttgggatatataccaatcgattccatttacgcccccgtcaaaaaggtaaattacaatgttgacgcggcgcgcgtgggacagaatataggctttgacaagcttacgctcgaagcggagacaaacggcgctttttcggggcgcgaaatagtggggcttgcggcgaaaatcctttgcgagcacgttcagatgtttgtggacctgtccgagtctatgggcgaattgggcattctaatcagccgcgaggaagacaagcagcagaagattctcgacatgaacatagacgacatggatttgtcggtcagaagctacaactgcttgaagcgcgccaatattcagacggtaggcgaccttaccagaaagacggaagaggatatgctcaaagtcagaaatcttggcaggaaatctctggacgaagttattgcacggcttgaaagcttcggtctcggactcaaattgaaagaagattag

SEQ ID NO: 2073 - DNA, 519 bp, Unknown
  Artificiall/Consensus sequence
atgcttaacaaaaaaattgcggatatgctcaacgaacaggtcaacaaggagctttactccgcatatctctatctcgatttcgccaattattacgaggacgaggggcttgacggctttgcccattggtacgaaattcaggcgcaggaggagcgcgaccatgcgcttatgctccgccgctatctcatagacaacagtgtgcgcgtaaccttcggtgaaattgccaagcccgacaaagagtacaaaccgcatatgtgtcctttggaggcggggctaacacgaaaaatacgttacgtcgctgattgccgcaatttatcgcgccgcgttcgacgaaaaggatttcaaaactatgcagttcctcgattggtttgtcaaggagcagggcgaggaggagaaaaacgccgacgacctcatcaaaaagatgaagcttttcgggggagattccaaaggtctgtatatgctcaatcaggagctgaacgcccgcgtttacaccgcgcccgcaaacgctgcggattgacgtga

SEQ ID NO: 2074 - DNA, 1119 bp, Unknown
  Artificiall/Consensus sequence
atgacaaaaaattttgacgacgtcaaaaagctcggcttcggtcttatgcgactgccgcaaaaagagggcgtcatcgacgttgaaagagtcaagactatggtggatatgtttctcgacgcgggattcaattatttcgacaccgccttcgcttacgcaggcagcgaggacgcgataaggcaggctctggtcaaccgcgtgccgagagaaaaattttttcttgccaccaaaaacgccgcatggctcaactgcaagaccaaagacgacgcggtggctcagtttgaaacctctttgagacagacgggtgcgggctatttcgatttttatcttttgcacaatttgggagagtcgcgcacgcactttttcgacgatttcgatatgtggagctggattcaggagaaaaagcgcgaggggcttgtcagacacgccggcttttccttccattccacgccgcaagagcttgaagaaatcttaatcgcgcatcccgaagccgaattcgtgcagctgcaaatcaattacgccgattgggacaatcccgcagtgcggtcgagagagtgctacgaggttgcaagaaaacacgggaagcccgttatcgttatggaaccggtaaagggcggaatgctggcaaacccgccgaaaaccgtgctcgacgtgctcaaaggcgcggagccggattcctccgcggcttcgtgggcgctcagattcgccgcggggctggacggagtgctgacggtgctttcgggcatgagcagcgaggagcagatgagggacaacatatcctgcatgaagggcttttcctctctcgacgaaaaagaacgtcttgctttgagccgcgcgcaggaggaaattaagaaggttccgctcattccgtgcacgacgtgcaactattgcgccaaggtttgcccgcagaatatcggcatatcggggacgtttacggcggacaattattttacgctttacggaaacagggatatggcgctctcgcaggcggattggctggtggacaggcacggcagacagcgcgccgacaaatgcgtcggctgcggaaattgcgaaaaggtgtgccctcagcatatagaaatacgcaaagagctgaaaaaatcggtgaaggagctttattga

SEQ ID NO: 2075 - DNA, 960 bp, Unknown
  Artificiall/Consensus sequence
gtgactttttctcagaacgtaaaggaagaaatcctcggcaggctttcagattctttgccgtgctgccgtcttgcctgtctttcggcgctgctgcgcggggcgggcagcctggaaatcaggtcgggcagtctgggctgttcgcttacgtcggaaaacaaaagactgcttgaatttgccggagaaatcgtatattcgctttacggactcaaaaccgaaataaggcgcgaggaaactaaaatcaagggcaacagcctgtggtcggttttcattgcggaggaaaagacgctttccgactgcggacttgcgtcgctgtcaatggagggctatctcaaaatcaacgagggtatagacaaatacatcgtagagcaggactgctgcaaaaacagctatgtcgccgcgctgtttgccgcctgcggctccgtagcgttcagtcccttgaagactctcgaccaaaaggcgggcaacagattcggctatcatttggagttttcgcttacctcccgccgtgccgcagatgacctcgtgtgtcttttggaggaaaaggacttccgttttaaaatagcggagcggaaaaacgtctgggcggtttacatcaaggacagcgcgtcaatatgcgatatgcttgcctatatgggggcggacaaagccgtgctgacgctcaacaatctgcttatcgagcgggaaatcagaaacaacgccaaccgtcagaaaaactgcattaccgccaacatagacaaatcggtagacgcgagcgaaaagcacattgccgcgataaacaaaatccgcgcccgcgagggaatgttcgacaggcttgcgccgcatctgaaagaaatagcggcggcgcgggtggaaaacccgttttccacgcttgacgagcttgcggacaagctcgggcttacaaaaagctgcgtaaaccacagactgcgcaagataaccgaaatagcttcgcgcctgccttga

SEQ ID NO: 2076 - DNA, 933 bp, Unknown
  Artificiall/Consensus sequence
atgtacaagcgtattgcggcaattctcgtttgcgcggcgtccgtcgttttgttcttcctcaatcccgcgaaaaacatacaaaacgtatcgacaggcgtgctgatatgggcgacaagcgttttgcccgccctgtttccttttttctttctttcaaaactactgattgagctggacgctttcggaggactttccactctcctttccaaaccgacgcaaaaaatattcggcgcgccgcccgcggcaagctatatctttttgctgagcgtagtttgcggctaccctatgggcgcaaagctaaccgcggagttttacgaaaaaggagcgttggacaaaacgcaatgcttgaagctcgcaaccttctgctcgacgggaggcccgatttttattattggtactgtcggcggcgtataccttaaaagtgcggctgcgggagcaatcatacttgtttcccatatactcggcgcgcttgcaaacggtctgctataccgcagacgctttgtctcggtttcggaatgcggcagacttatctcacgacaaaagaacaacggcgaaatactcggcgactgtatgcagaattccataatttccgtgctgagcgtaggcggattcgtaactgttttctatatgtggactcaaatgcttttgtcgctgccgcctttgagcggcgcgggaaagcttgttcaggggattgcaggcggattgcttgaagtaaccgccggttgcaaaatactcgccgatacgggcagcgcccctctgacagtcgttttgtgctgctttctgataagcctcggcgggctttgcatttttttgcaatcttcggtgttttacagaaaatgcggcgtcggcagcggaaaaataatgctgttcaaattgactcaggcgattttctccgcagctttttgcgctccgctcacctttttgtttctgaaatga

SEQ ID NO: 2077 - DNA, 1128 bp, Unknown
  Artificiall/Consensus sequence
atgatagggcggcaagtaaggcggtatctagcaggcgccatcgccatcctgtccctatgggccgctctgcccgccctagcagatcaacagccggtatccagcgcagcgggggccatcttaatggaagccaccacagggaaggtactgtatgcgaaaaacgcccatcagcagttgcccatggctagcaccacaaagattatgacggcattgctggccattgagcatggggatttagacgagatggtcaccaccgatgccagcgcctatggggttgagggttccagcatgtatttgcagctggaggagacggtgagcctgcgggatctactctatgggctcatgttggcttccggaaacgatgctgccgtggccattgcggtgcatatcggccatggcgtggcgcagtttgccaacatgatgaaccagcgagctaaggccctgggcgcgtttaacaccaattttgtcacccccaacggtttaccggacccagaccattatacgacggcctacgatctagcttgcatcgcggcggcggccatgcaaaatcccacctttcgggagatcgtatccacccaatattatcgaaccagcacgggggctgtgcccaggacatttaaaaacaagaacaagatcctatggaattacgaggggggaaacgggatcaaaactggctataccaaggctgccggccggtgcctggtgtttgcggcggaacgggacgggatgcagctggtgggggtgttgctcaattgcagcgatatgttcgaggaagcggaaatgctgttggattacggcatggagcattatgaaatgacgccgttggtaagaggcgggcaagccattgccaacgtatatgtggcggatgggatgaaaaaccggttggcactttgcccgggggaagatataatggtacctgtggaaaaggatgggagcagcttatataagacccgggtgctgctaccagatgggctaacggctcccataaccgcagggcagacttgcggggaggtggaggtcctggaagaagacgggaccctgcgggccaaatttgacctgctcgccatggaggacgtggaccaggccacagtaggcttctatataaagaagctattccgcaacatgacatag

SEQ ID NO: 2078 - DNA, 1338 bp, Unknown
  Artificiall/Consensus sequence
atgttaaaggtaaccaagtttggtggtagctccctggcagatgcccgtcagttccaaaaggtgaaggatatcgtacaggcggacggcagaagggtcgtggtagtggtctccgcccccggcaagcggttcccggaggataacaagatcacggacctattgtatctgtgccatgcccacttgaaatatggggtctcctatgacggcatcttttccatgatcgaggaccggttcctggagatccaaaatgaattggggctggatgtggatctaaaaggggaatttgccaagatccgggccaatatgcataaaaacatgtccatcgactatctggtctcccggggggaatacctgacgggaaagctgatggccgcctatttgggctatgattttgtggacgccacagaatgggtagcctttggctacgacggcaagctggatatggagaagagccaggccaatctggcggccatgtttggggaaaagtctaaggtggtgttgcctggcttctatggggcgctgccggacggtaaggtgcgggtcatgagccgggggggaagcgacatcaccggcgccctggccgctgctgccattgacgcaggcgtttatgaaaactggacagatgtttccggcatcctgatggcagatccccggatcgtagacaatccacggccgattgcccatattacgtacagcgaattgcgggaattatcctatatgggagccaacgtgctccatgaggagaccattttcccagtgcgtatcaaggacattcccatcaacatccgcaataccaacgatccccaagcccccggcaccctgatccaggagagcttttccaaggagacccgggaggaacgcaaacggttcattacgggaatatccggccgcaaggatttttctatcctcaccctgcgcaagggccatttggccgcggataccggcaccattcgtggggtattggctatttttgaaaaatacaacgtgcccatcgaacatttccccagcggcattgatagcttttccctggtggtctctacggaaaagattaaatcttgtatttatgatataataggggagatcaaggacctgttccaaccggattccatcaccgtaacggacaacatcgccctgatcgccacggtgggccggaaaatggcctttatccccggcgtcagcggcaaggtgttcggtaccctaggggccaacgatatcaacatccgcatgattgcccagggccccgatgagatcaacatcatcgtaggggtggaaaaccaggactttgaaaagactattcgcgttttgtacgatagctttattgtaggagggaaagaggaatga

SEQ ID NO: 2079 - DNA, 2031 bp, Unknown
  Artificiall/Consensus sequence
ttgaaaaaaaatctttccaccccgctgatctacctggtgctgctggtggtcatcatcgcgctggtgtccggctttgacccccgggggaattcggcggaagaggtgagctataacgactttatccagctggtgcgggaggaaaaggtggcctatgtggacatcacggacctgcagctggttggtttatacgtcgatagcgaattgtcccaggaaactttcccggccaagtatgatttctatacctacatcccctccctggaagcttaccgggaggatatgaccatcctcaccgaggagctcaagggcatcccccgggatcaggtgaccaacgcggacttccccgtggaatccatggccaaccccacccccaagccctccatctgggaagggttgcttccctatgtgctcatgatcggcgcgctggcggtgctgtattatttcatgttccgctcccagggcggcggcaacagcgtgatgaacttcggcaagagccgggcccgcacccagatggaccctggcaaaaaggtcacctttgccgacgtggccggcgcagatgaggaaaaggaagaactgcgggaagtggtggagtttatgcgctcccccaaacgcttcacggaaatgggcgcccgtatccccaagggcgtgctgctggtgggcccgccaggcaccggtaagaccttgctggccaaggcggtggccggggaagccggcgcacccttcttctccatttcgggttccgactttgtggagatgttcgtgggcgtgggcgccagccgggtgcgggatctgttcagcaccgccaagaaatgcgcacctgccgtggtattcatcgatgagatcgacgcggtgggccgccagcggggcgccggcctgggcggcggccacgatgagcgggaacagaccttgaaccagctcctggtggaaatggacggctttgccatcaacgagggcatcatcgtattggccgccaccaaccggccggatatcctggaccccgccctgttgcggcccggccggttcgaccggcagatcaccgtaaactatcccgacgtaaagggccgggaggagatcctcaaggtccacgccaagggcaagcccctggcggaggacgtgtccctggcggtgctggccaagcggaccagcggctttaccggggcggatctggaaaacgtattgaacgaggcggccatcctggcggcccgctataagaaaaagaagatcaccatgctggagctggaggaggccatcacccggacggtggtgggcccggaaaagaagagccgggtggtcacggacgaggataaaaaggtcaccgcttaccatgaggcgggccatgccatcgtggcgctgaaaatgccccattgcgacccggtacacgaggtttccatcatcccccggggcgctgcggccggctataccatgaccatgccggatacggacgacaaccatgtctcccggggcaagatcctggatgagatctgcatgtgcatgggcggccgggtggccgaaagcatcgccttggacgacgtatgtaccggcgccatcggcgacctgaagcgggccagcgagctggcccggcgcatggtgatcgagttcggcatgagcgacgccattggcccggtgttcctgggcggggacacggaggtgttcatcgccaaggattggggccatcagcggaactattccgaggaagtagccgccaaggtggacgcggaaatgcgccgcatcctggaggaacaattcgaccgggccaaggctgtgctggaagaaaatcgggaggccatggatcgggtggtgaaggccctgctggagtacgagcgcatcgatggggatcagttcatcaagatcttcaatggggaatccatcgagatccgcagctacaaggaccgcaaggcggacctggaaaagccggatgaagaggtcctggcccaggagcaggctcaagccgctgcccaggagccacaagtcccccccacggctccggaacagcctgcgcaaccggaacagcccgaacagccggacgagaaataa

SEQ ID NO: 2080 - DNA, 1920 bp, Unknown
  Artificiall/Consensus sequence
atgcaaaagatccaggtattaagccaacagatcgccaaccagatcgctgccggcgaggtggtggaacggccagcttccattgtgaaggagctggtggaaaacgccatcgacgcaggcgctaccaccatcacggtggagatccaagagggcgggatatcctatttgcgggtaacggacaatggcgccggtatcgaagccgaccaggtgcccgtggcctttttacgccatgccaccagcaagatcgccagcgcggcggatctggaccagatccagactttgggattccggggggaagccttggcgtccattgcagcggtatctaaggtatctttgaccacccgtacccagcaggcggaatccggcaccaacatcgtgatccatgggggcgaggtgcgctcctgccaaccggccgcctgcgccgggggcaccagcattgaggtagaggacgtattttataacgtgcccgcccgcaggaagtttttgaaaagccagcgggcggaagccgctgccattggggatctattgtcccgcatcatcctggccaagccccatatttcctttcgcttcctaaacagcggcaagcaggtctaccaaagcgccggggacggccagctaaaacatgccatacactgcgtatacggcagcgaggtgctggccaaccttcggcctgtcagctaccgctacggccaactggaggtttccggctttgtaggcaccgagcagctagcccggcccaaccgcttgcaccaatccctgtttgtgaacggccggtatattcgttcccagcggatctcttttgcggtgcagcgggcctttgagacccggctcatgagcggaaagttccccttctatgtgctggatctcagcatcccctgggaagccgtggatgtgaacgtgcatccccaaaagatggaagtccgttttaaggacgaagagcaggtattccgggctgtgaccgttgccacccgcatggccctgggggataccgttgcccccttggttcgggaaacggacgtagcccccttccgcaaaatggtcagccatttccccgaagaaaacaaggagaagccaacccccggctctgccttttccaccatgtccaccgcagagctgaaggaattgcaggaaaagctgggaacagctcgtaccacctcccaattcgatgggttattaggggaaccgggggtgtcccaagaatggcgacgggaggctttgcccatactttcgccaaagggatatgccaacgaaccagcgtcccaatccccggtgacgcctgcgccccagcaggaggtccttccgccagaaccggcagagccgcctgtccaggaagctatggactttggcattgcgccctatcgggtggtggggcaattattcgaatgctactgggcggtacagcagggggatcgggtattcttcatcgatcagcacgcagcccatgagcgtaggctgtatgaatccctcatggccggccaactggccggcgcgtcccagatgctgttgctgcccatccaggtcaaacttcagccgggccccttcgccctgctgctggataacctagctgcctttgaggagctgggattccagctccaggagtttggcgcccttaccgtgcggatcttggcagtcccttcctttatgggagaaggggcggatgctggagacttccttcgggaggcgttggcgtatctggaacgccaaggcagcgtgcgggcgacggatcttaagcgaggcgcccttatccagatggcctgcaaacatgccgtcaaggcgggggataggctggcgccggatgagatcgaggcgttgttggcccaatatgcggcccaaggggttcccatgacttgcccccatggcaggccggtgatggtccagatgacccggttggaatttgaaaagctctttaagcgggtattataa

SEQ ID NO: 2081 - DNA, 975 bp, Unknown
  Artificiall/Consensus sequence
atgcaagaaaccttatctatgacctccagctgggataaaacctttcccaaaagcgaaacggtggcccacgaaaagatcacctttcacaaccgttatggcattgcgctggcagccgacctatatcgtcccaaaggggcggacggaacactgcccgccatcgccataagcggcccctttggggctgtgaaggaacaggcttccggcctatatgcccaagaattggcacagcgaggctttctgaccattgcctttgatccctcctataccggcgagagcggcggctacccccgttatgtggcctccccagatatcaataccgaggacttttgcgccgcggtggactgcctttgcgtgcgaccggacgttgacccggagggaatcgggatcttgggcgttggcggctggggcggcatggccctgaacgccgccgccgtggacactcgcatcaaagccaccgtggcctccaccatgtacgacatgacccgggtcaacgccaaaggttattttgacagcgaggacagcccacaggcccgctatgaaaagcgcaaggccatgtgtgaccagcggaccatcgactatcgaaacggcagctatgccttggcgggcggcgtgccggactccctcccccaggacgcccctgccttcctgaaggattattatgcctattataaaacgccccgcgggtatcatccccgctccctgaattccaatgggggctggaacatcacctccgccctgtctttcctcaatatgcccatcctccaatacagcagcgagatccgttccgccgttctgatggtgcatggagaaaaggcccattcctgttactttagtaaggatgcctttgctaagctgaccggagataacaaggaactgctgctgatccccggggctagccataccgatctgtacgatcgaagagacatgatcccctttgaccggatcgcaactttcttcttacaatatctgcaataa

SEQ ID NO: 2082 - DNA, 1302 bp, Unknown
  Artificiall/Consensus sequence
atgaaggtaggcatggtttccctaggatgctccaaaaaccgggtggacagcgaatatattctggcagccttgaccaatcaaggctttaccatcaccgccgacccaaaggaagcggaggtgattttggtaaacacctgcggctttatcgatcccgccaaggaggaatccatcaacaccatcctggagatggccgcctataaggagaccggccgctgcaagttgctggtgggaacgggctgcttgacccagcggtatgaaaaggagctgcgggaggagctgcccgagctggatctgctttggggggtcaaggacccccaggggctggcgcggaaggtggcggaaatggccggcctaccccagccgcaaccccctggctgctgtccccgcattttgaccaccccgcggtattctgcctacctgcgcattgcagacggatgtgacaatcgttgcgcctattgcgccatccccttgatccgcggcccgcgcaagagcgtgcccatggaggatgtgctggcggaagccaggcgcttggcggagggcggcgtggtggagcttacggtgatcgctcaggatacctccgcttatggcagcgacctttacggcaagcccatgctgcgggagctgctattggagctgtgcaaggttcccggccttcattggatccgggtgctgtatacttatcccaatacggtggacaccgacctgatcgacgccatggtacgggagccaaagctggtaccctatctggatatgcccatccagcatattgcgccggatattcttcggcgcatgaaccgccatggtactgcggcgcatatccgggagatggcggcttacgcacgaaacgctagcccggatttcatcttgcggaccacggtgatcacaggcttcccaggggaaacggaggaggaattcgaccaattggccgaatttttgcaagccaatccctttgaccgtcttggcgcctttgcctattcgcaagaggaaaatacccctgctgcgcagatgccggatcaaattccagatgcggttaaagcagaacggctagatcggatcatgactgcccagcaagcaatatccttggtgtgtaatcaaattcgtgtcggtcgaacgtacgaagttttggtagataaggtgcagggggatatttgcctaggccgttcctatggagaagcccccgaggtggatggttgcatccgcttctattaccaggggccggcccccaaacccggcacgtttgtgcaagtccgtatcaaccaggccggaccctatgacctatggggcgagatggtgcttcaataa

SEQ ID NO: 2083 - DNA, 1434 bp, Unknown
  Artificiall/Consensus sequence
atgggaaactgttccaaacggctggtaaaatattcacaatcctttacgcggaaaaacctatgcaaccatatttttataaagtttgaaaggcaggtgttggctttgccaaaatattccatccggggtggcgtacatccactggaaaactgccatgggggcaagacgcgcactagcagcgtagccattcggccccatgcgcccagtgtggtggagctgtccatgtcgttgtttttgggcaggcccagcacgcccctggtcaaggtgggcgattatgtgaagttgggccagaagatcggtgaatccggcggctttgtgagcctgccggtccacgccagcgtatccggggaagtgatcagcgtaaagccccagatgatgctcatggaccggccggaaatgaccgtgaccatccgcaacgacatgcaggacgaatggatcgaccttacgcccctgggtcaggatgtggacagcgtggagccgtcggccattatcccggccatccaggaagcgggcatttgcggcctgggcggcgcggcgttccccacccatgtgaagctgaccatccctgaggggaagcggtgtgaagccatcatcgtcaacggggcggaatgcgagacccatgtgacggcagaccatcggctcatgctggaaaatgcccaggatatcgtggatgggctgcggctggccatgcgggccgtaggggtggaaaccggcatcatcgccatcgaggacaacaaaaaggacgccatcgccaccatgaaacaggcggtggcgggcatagccggcctgtcggtggtatccctgcaggccaaatacccccaaggcagtgaaaaacagctgatctatgccaccaccgggcgggaagtgccttccaaaggcctgcccatcgacgtgggggttgtggtgctcaacgcagggacggcggcagccattgcagacgcggtgttgcggggcaagccgctcattcagcgggtcaccacggtgaccggctgcgtcaaggagccggccaacctgttggcccggatcgggaccccggtttccgaactggtggaggcctgtgggggctatacccaggagccctaccgggtggtgatggggggctgtatgaccggcctatgtacgcccaacgacgccgtacccactggcaaacgcaccaattgcgtgatcgccctgacggaaaaggaggccaaaacccaagcggagggcccttgcatccggtgcggcaggtgcatcgaggcatgtcccatggggttgcagccctataagatgcgccagctctgcgacaaaggggacctgaaagcagcggaagcggccaatgtgatggaatgtgtggtatgcggttgctgcacctatatctgcccggcgcagcggcagctcacatccatattcaaaaacaccaaggacgccatcgcgcgggaagcaaggagggcaaaataa

SEQ ID NO: 2084 - DNA, 1116 bp, Unknown
  Artificiall/Consensus sequence
atgaaagaaaagctgaaaaaaacctatgaagccgtgggcttgccccgcttgctcatcatctgcttcttcctggcgctgctgctctcctcgggctccctggagctatccatccccagcctgttgggggatacggtgcgccggtgggtcatgtacggcatattggtgctggccatggtgccggcggtgcaatgcggcatcggcctgaatttcggcgtgagcctgggcatcgtgggcggcctgttgggcgccaccatcgccattgagctggaatttgccaacccctggatcagtctggcggtggccatggtggtgggtacggccatcgccaccgtgttcggcatgggctacggcctgctgctgaaccgggtcaaaggctcggaaatgacggtatccacctatgtgggcttttccaccatcgcctttatgaacatcgtttggctgtccctgccctataaaaacggcgaaatgatctggcccctgggcggcgccggcctgcggaataccatcaacctgaattccagcttcggcgaggtgctcagcaatacgcccctttccatcaacatcagccaacagggcgtcacctttggggaaaaagcggcggagctgaatgcggctgccgttgggttctatatccccacagccgccctgctgctcttctttgcggtttgcttcttgatgtggctgttcatgcgcagcaaggtgggcctggccatgagcgcagcgggcgccaatcccaagtttgcccaggccaccggcatcaatgtgaacaacatgcgcatcctgggcaccaccatttccaccgccctgggcggcgcaggcattgtgctgtacgcccaaagctacggcttcttgcagctgtataacgcacccttgatgatgagcttccactgcgtggcggccatcctcatcggcggcgcatccatcgcccgggcccgtatctcccacgtcctgttgggtacgttcctgttccaggggctgctggcggtggcgctgccggtggtgaacaaggtcctgccggagggcaacctttcggatatcatccggatcatcatctcctacggcatcatcctttacgccctgtccaaaaccaagcaaggagggaaaggcgatgcgtga

SEQ ID NO: 2085 - DNA, 1254 bp, Unknown
  Artificiall/Consensus sequence
atgagcgggaaaggcacgattaagctcctgggcattcttgcgggcgcatccatgttgacgggatgcgctgcagctgcaacaacggccaatgtgacccaggaggaagaagtttcttctgcgattgcatcggtccatggggagagtattcccttggcaaaggcggctgtagacgatgccgtcacggtggaacccacccagtcgccggacgcccatgtggtagagatcactttgccgccggctacgccggcctatatggtggtgacatcgccgcaggcctccagccagacgcaaccagcggcgaccccggaagccagcccggcagcaacccccaacccgactccaaccgctacaccggaagcgacccccagctatacggtggaagagctggaggaatatgtggacggttatgtgctggcggccacagttaatctgcgagccggcccggggaccgggtacgatgtgctgggggaatatgaacgctacgataccctgttggtgaccggcacctgcgaggaatggtatcgggtaaagctggacggcctgcggggctatatgctcaaggagtttgtagccatgggggatgtgccagaacctacgccggcttatgcggtggaggagttggacgaatatgtagacggctatgtgaacgccaagaccatcaatctgcgggcaggccctgggactggctatgatgtgctaggggaatacgagcgctacgacaccttgctggtgacgggcaaatgtgaggaatggtaccgggtaaagctggatggcctgcggggctatatgctcaaagagtatgtgaccatcggccaggtgaaggaagcggagcccaccccggcgcctacgcccacaccggagcaatccatcccagtggtagaggaaacgcctacgactaccccctccacgagcatttctcaggcggacgagctgtatctggctgcccaggtggtgcaaaaagaaggggatatggaaagctatgtggctgttgccaacgtaatttataaccgggtccatagcagcagcttccccaacaccatcgaggaggtcctgtaccagaaaaaccagttttccaccagtaacctgaaggcgccttccaccgcggctttggcggcggtccagcagatcttcatcgacggcaacctgatcctgccagcggaggtaatgtatttccaagcggcaagccggggtacggaccgcagcggatatacctattatggcacctacggtggaaacgtatttttctaccgctag

SEQ ID NO: 2086 - DNA, 1152 bp, Unknown
  Artificiall/Consensus sequence
atgatttactttgataatggcagcacatccttccccaaagcgccaggggtgggcgcagccatggcggcgctgctggagaacgcgggctttaacatcaaccggggcggctatgaaggcgcctatgcagtggcggatatggtattggatacccgggagatgctatgcaagctctttgattggcaggaccccaaagacgtgtgctttaccggcaacgtgacccagtcgctgaacctgatcctcaaggggttcttaaagccgggggatcatgtggtggtcagctccatggaacacaatgcagtcatgcggcccctgaaccagctggcggcccagggggtcgcctttgacgcggcccaggccgatccggacggtaccctgcctatagcgcgggtagaggcgctgcttcggcccgatacccgcctggtggtcatgacccatgcctccaacatctgcggcaccatcctgcccatccaggcggtgggcgccttatgcaaggaaaagggcatcccctttgtggtggacgctgcccagaccgcaggcatcctacccctttccatgaaagacctccacgccgccgccatcgctttcaccgggcacaagggcctgctgggccctcagggcatcggcggtatggtgatccgggaggattttgcccagcagatcgaacccctgcttagcggcggtaccggcagcgtttccgatacggaattcatgccccatttcttgcctgaccggtttgagagcggcaccatgaacctgccggggatcgccgggctgaacgcagccctggcttacatccaggaaaccgggctggacaagatctaccagaccgaaatggccctttgcgcacgcttcctggcgggggcccgcactctgaaaaacgtacgcattgcaggcatagacggcctagaaggccgcgtggccaccgtttccctggacttcacccaggctggcttggacaacgccatggtttccttccaactggatagcgaatacgggatcatgacccggtgcgggatgcattgcgccccccgggcccacaagaccttgggtaccttcccccagggtacggtgcgctttgcctttgggcatcggaatactccccaggaggtggatacctgtctggaggccttggaaaccattctggcaggctag

SEQ ID NO: 2087 - DNA, 1290 bp, Unknown
  Artificiall/Consensus sequence
ttggctaaagaacgccggcttcggatcaataagctggggacgcagctcaccatcagcgccttgctatgcatggtcgtcgccctttgcgttttctatctgatgcagagcgcagctagctttgctttgaccaattgggtatcggattcggacttttaccaggccatgagccgccggtttgccaatcgtgtccagcagtatgtcacggaaaaccacatttccctttccaacctggatgccctggacaatatgcagggggatattttgatctccgtataccaggacgatgtgttgctttacgattccctaggcgcggacgcaatggtagatcccttgccaagcgcagtatatcccctttccttagaggacggggaagcctgggtgtacatttgggactatgggttttatacggtctatttccgggtgtttgatatgatcagcgccctgtttgcctttttctcctttgtgatcctgttcgtctttctgatccacaagaagctgaactatatcctgcggctggaaaacgagctggccatcctagagggcgggaacctgcaataccccatcaccatccagggcaacgatgagcttacctgcctggcccaaggcatcgacgatatgcgccgttccttcatcgagcgccagcagggggaggcggaggccatccgggccaatcatgccctgatcaccgccatgtcccatgacctgcgtacccccctcacctccctgaccggctatattgagctgctgcaaaaccagcaatatgccacggaagagcagcggcaatatttcatccaggccagccgggacaaggtattccgcatcaaggaaatgaccgacgccctatttgaatacgctttgtgttccggcgatgtcgcccccgcccaattggaggccatggacgcgtatgagttgctcagccagtttgtggaggaatacggctttgaactggaaggcgcaggctttcagctggagcgcgccatcccgccctttcaggcccaggtgctggcagaccccagccgcttatcccgggtgttcgacaacctgacctccaatttgaaaaaatatgcggaccccgcctatcccatccaggtcagcctgtccgtacagcgggatcaggtggaaatggtcgtggccaatcaaacccggcattatgccgccgtggaaagcacccgcatcggcttgaaaacctgtcaatccatcctgcaacagcacggcggcgggttccaaaccagcatggatgggagccggttccaagcccgccttgttcttcccctgctccaaggggattga

SEQ ID NO: 2088 - DNA, 1329 bp, Unknown
  Artificiall/Consensus sequence
atggaaaagttctttaaactcaaagaacacaacaccactgtccggacagaagtgatcgcgggcctgactaccttcttcgctatggcctacatcatcttcgtgaaccctgacctcctctcccaaaccggcatggaccagacctctgttatgatggccacctgcctttccgctgccgtgggcacgctgttgaccgccctgatggcaaacgtcccctttgcgcaggcccctggcatgggcttgaacgccttctttacctttagcgtatgcttcggcatgggctatacctggcaaaacgccttggccatcgtgctgatctccggcgccctgttcttcttggtggcggtttctcccctgcggagcaagatcatcgatgccatccccgcccccatcaagcatgccatcagcgccggtatcggcctgtttatcgcattcatcggccttctgaatgcgggcatcgtggtgtgcacctcttccaatgtgacggaccttgcccccatggctggcaacaacgccgccgtcgtggccctgatcggccttttgattaccgccgtgctcatggcctataaggtcaagggcgccatctttataggcatcatcgccaccaccatcgtgggcatcccctttggcgtaactaccttcccggaaagcatcgtgttccatggcttcggcgccctggcccccacctttggcgccgtgttcaccgatggcttcaacggcttgatgcagtttggccttttgcccctgctcactgccatcatcaccttcgccatctgcgactgcttcgatacggtgggtaccctcatcggtaccgccagcaatgcaggcatgctggataaggatggcaagctgcccaagggcgacaaggccctgatcgccgacgccatcgccaccatggcgggcaccgtgctgggcacctctacggtcaccacctttgtggaaagctccaccggcatcagcgagggcggccgcaccggcctgacctctgtggtggtagccatcctgtttgccctggcagccttcttcttcgcccccatcgccctgatcatccccagcgcggccacggcccccgccttgttgatcgtcggcgtgctgatgctcaagggcgccgcggagatcgattggagcgatatcgaggtggccattcccgccttcctcaccatcgccatcatgcccttcgcgtattccatctccgatggtatcgcctttggcttcatcttctattccctgatcaagctgatccggggcaagggcaaggaagtgccggtgttcatgtacatcatctccgtactgttcatcgtcatgtatgtgctctccgccctgcctgcataa

SEQ ID NO: 2089 - DNA, 1176 bp, Unknown
  Artificiall/Consensus sequence
atgtatgagctttgtacggatatcggctatgtgacccttaccaaaacaggggaacagctttgcggcgaccatgtggagctggtccagcaggcggatggctccgtggtgctggtgctggcggatggtctgggcagcggcgtaaaggccaatatcctttccaccctcaccggcaagatcatctccaccatgatcgccaacggccttaccctggaggattgcgtcagcaccatcgccgccacgctgccggtatgcgcggagcgcaaggtggcttattccaccttcaccatcctgcggattgtggattgcgcggaagcggagctgatccaatacgataacccccacaccatcctgctgcggcggggcaaacatgtggattacccggagatctgcgaaaacatcgatggaaaaaacatctacaagtcccgtatgcgcctttgggaaggggacgtgctggtggctatgagcgacggggccctgaacgccagccagggcaataccctgaacatgggttgggatcgggcggccatcatcgacttcctggaaaccatgtacaacgatagctttaccgccaaaacctgggcggccatgttggtggaggagtgcgaacgcctttacgggggccagcccggggacgatacctccgcctgcgtcatccgcctgcggcggcggcaggtggtaaacctgctcttcggcccccccgaaaaacgggaggataccaacaaaatgctttccctcttcttcgccaaggagggcaagcggatcgtctgcggcggcaccaccagcgagctggcggccgcctacctaggcaagcccctggatacctccatgcccctgtacctggaccccaagatcccccccacctccaagctccagggggtagacctggtgaccgaaggggtcatcaccatggcaaaggtgctggaatatgccgaggactatgtgaaggaaaaccgcctttatatggactggagctgcaaaaaagacggcgcttcccagatcgcccggatgctctttgaggacgccacggacgtgaatttctatgtgggccgggccgtcaacgaggcccatcaaaaggaaggcctccccatcaccttcaacgtgaagatgcagatcgccgaacgcctctccaaactcctggaggagatgggaaaacgagttcaggtgagctatttttaa

SEQ ID NO: 2090 - DNA, 1671 bp, Unknown
  Artificiall/Consensus sequence
atggaaaccaatgaactcctgatccaaatcgccttttgggcatatgtgctgctggacggggtggcagttaccctggcagccattcccttccttcatatgttgcagctggaaagctaccagggtcccatgtatcttaagtgggtgcgtaagcacctgggccaatggtccggcccctttttggccggtgtggcgggcttccttttgcgcatagccggccaatttttcccgggcggctttgggaccctgctatggcggggcggggacgtgatctttaccggcatgatgctagcctttgggatcatggccctaaaaaatcaaaaaaaggccaaaaaacccctgcgctataccgctagggtcaagcggctattggttcccgtattcctgctcgccctggtggggccggcggcgcggctgctgttgcaggcgtcctatgtgcggctcctttttaatggcatacagccttggggcggctggtgggactatggcttctggccggagcttgtgcggtttttgcccgggctgctgctgccccttgtggtatgcctggcccatgtgctcacctggccggtggaaaagctggtccagggctggtatatgggggacgccaggaaacgcctgcttgccaatccggcgctaatccgcatcggcatcaccggcagctttggaaagacctctaccaagtacgctttgggcaccatcctgggggaaaaatataagaccctctatactcctggcagcttcaacacccccatgggagtgacccgaaccatacgagaaaaactcacgccggaacaccaagtgtttatcggggagatgggggctcgttataagggggatgtggcccagctgtgccgtctggtcagaccgcagtacggcatccttaccgccattggcaagcaacatttggaaaccttcggctccctggaaaacgtaatgcgcgccaaaggggaactgttggccggggtcggcagccagggctgcgtctttctcaacggggacgatcccctgtgtcgccagctttatgagaacagcccattacaggaaaaatacctttttggcacccagggagaaggcttgtatatgcgggcggaggatatcaccgtaggcccggagggcagccggttcaccttggtttgccaggatgggacccggatcccctgcgtcacccggctcctgggccggcacaacatcctgaacgtggcgggagccgccgccctagcctataagctgggcttaagcgaagcacagatcgccgccggcatcggcaagctggagccggtggagcatcgcttgcagctcttgcccggccccattaccgtgatagacgatgcctttaacgccaacccggtgggctccagcgaagcgctggaggtactgaagtccttcccaggccgacggatcatcattacccccggtatggtggaactgggggaggagcaggcggccttgaaccaggcctttggcttgcacatggcgtcttgcgtggacgtggctatcctggtgggacccaacgccccggccatcaaggcggggctcctggaaggcggcttcccagaggaccggctggtggaggtggaatccctggcccaggccacggaaaagctgccgctgtatcaacagccagggtgtacggtactgtttgaaaacgacttaacggataattataattga

SEQ ID NO: 2091 - DNA, 1158 bp, Unknown
  Artificiall/Consensus sequence
atgcgaagaaacaaaaaagggcttgcgttgctccttgccctgctgttgccgctggcgatgctgttatccggctgcgcccaaagcgccgggccggcggcttccgccgaggccgtccccacccaggaagcggctggggcggaaacggcccaagatgcggttgctccgccggaggaggccgcgccccaggaacgggagatcaccgacatggccggtcgtaccatgacggtgccgctggagatcgaatccgtattttccacaggccccgcggcggcaatttatctgtacaccctggttccggataagctattggggtggaattatgcgctcaatgacattgaaaagagcatcatcctggagcaataccatgacctgcccaacttcggccagggggacgccgtcaactatgaggcggtgatcgccgccggccccaccatcgccctgaacgtaaccagcatcaatgacggaagtatcgatgcatccgacgccctggcagagcagctgggggtaccggtggtgatggtgagctccgacctattggatgcgccggcagtctaccggtttatggggaagctcttcggtgtggaagagcaagcggaggctctggccgcctacgcggaggagaccttcaacgccatttccagcctggatattccccatgaagaaaaggtgcgcatttactacggcaacggtgaagattccctagaaaccgcccccgccggttcttcccatggccagctcatcgacctggtaaacgccgtcaatgtggcggatctggagctgggggacggttcccgggtgcagatctcagcggagcagctgctggcttgggacccggatgtgatcatcgtcaacggagaacctaaggcggatatgaccggcagcgccgcggcggaggccattctggctgatcccctattcgccaccctaaaagccgtacaaaacggggcggtctacggtacccccaatgcgcctttcagctgggtggaccggcctccgggacccaaccgcatcgtcggtatgcgttggctatccggcctgatctatccggaatacctggactatgacgtggatgaagcggtgcgggaattcttccagctcttctatcacgtggagcttacggacgaacaactcacacagctttacaacggcaccctttaa

SEQ ID NO: 2092 - DNA, 3288 bp, Unknown
  Artificiall/Consensus sequence
ttgccggtctccgggcaggccacggagcaggccctggtgatcaacgaggtggtctcttcaaattccacctccctctcccacccggaattgggttccccggactggatcgagctatataacggcaccaacgccaccattgacctgtccggcttcggcctgagtgacaatgtaaaagagccccataaatggaccttcccagaagggaccaccatcccggcgggaggatatttgctaatatatgcgtgcagctataccggcgaagacgatagccttttatgcaccgatttcggcctatctaaaaacggcgaatcccttcttttgaccgacgcctattacgccattttgcagcaggtggatctgcctgccctgctgccggatgtttcctatgcccgggacgcttccggccaatatggttattgctccgacccaacccccggcaaggaaaacggggaagtggtcttttcctccgccggggacgccatcactgccggcacctccgacgccctgaccattaccgaatgcatgcccaaggccggggcttgcctggccccggacggaaaagcctatccctgggcggagctatataacagcggcagcgagcccctactgctttccgactactatctttccgataacatccatgagcccctcaagtggcggctgcccggcgccaccttggaagccggcgcctataccaccatatggttctccggggacgagggcaaggacggcatccacgcagggttccgcctgggctcttccgacgacaccctggtgctcagcgacagcacgggaacccagatctccatcctcacctggcccatggaccagatcccggagggggtatgcgtcctgcccggcggccaatataccgcccaggccacccccggccagcccaacagccagaccgggatattctcttccctggagtttgctcccatggaggcggacgcgccggtgcgcattcacgagatcctgctgcataaccaatacagccttcgggatgaaactggcgaacggaccccttgggtagagctctataacagcagcagccaagccgtatcccttggaggctgctatttgagcgacgacccggaaaatcccttcaaatgggccttcccagaggattccagcatacagcccggccaatacctggttattttcctctccggcaaagatgccgccggggatgccctgcataccagcttccgcctctcggactccgacgaagccctggtctttacccaaaccagtaccatgagccaggatcaatgggcgttgcctacccaattgggggataacgtatccatgggccttgcggcggacgggtccatcgcctactttaccacccccacccctggggcggccaataccacccatagctttaccgagcccctaaacgggggctatacggatatggagggggtctatatcagcgaggtctccgcggtgagcgccgcgaaaagcggcaaggcggactggatcgagctgcataacgcctccgacagtaaggtggatctggcaggctggcacctgagcgacgacccagacgacctgcaaaaatgcaccttggaaagcatgaccctggacgccggcggttacggcgtcgtcaccgcctcttccagcaccgcaaagggcgcgacagcgccctttggcatatcccccaccggagagaccctgttcctttccgacgcccaaggcaatatccgggatgtgttccaaaccggcgccctccggcttggcgtcaccgccggccgttccgccggcagcgccagccgggtctattataccgaggccacccggggggaagccaacggcgcgcaaagctataccggctttttgcccaccccggtgttctcgaaaatggggctctatcacgaccagcccttctccctgaccatcacctgtgacgccccggacgccaccatccactataccctggacggcagcgagcccacggaggcttcccccgtctataccggccccctcaccattcaggagaacaccccggtccgggccaaggcctttggcgggggcctcctatccagcgacgtggccaccgccacctaccttttcgagaccccccacaccctgccggtggtctgcctaagcgcccaatccgacgactgggacgccatgtattccgtgacggagcgcaagcttcgggtggaaaagcccgggcatttcgcctactatgaaaccgacggcgccttgggcaccgcctttggctgcggccttagggccagcggctcctctaccctcctggccaggcaaaaatccgtcgccgtattcctccggggagcctacggacaaagcgaaacgaattatcccttttttaccgacagcgacgtgaccgtgttttcctccctggtgctgcgcaattccggccaggaccgggataaggcccggctgcgggacagcttcttctccaaggcggtcaagggcctgaacatggaatacgctgaaacccggctggtgatcgtatacgtaaacggccaatactggggcatctacgacctgaacgaaaaccagaacgaggattatatggccgcccactatggggtggacccggacgctgtggacatcatccgccggaacatcgaagccctggccggccgcaacagcgaaaataagcgggttcgggcatgggccttggccacggatacctccgatccggacaaatacgccgaatacatccaatgggtggacccggattactttatcgattatctcatcgcccaaacctattttgccaacggggacatgttcaaccaaaaatactggcgcagccaggattataccgtgcgctggcggccggtctattacgacctggatctggccctatccagctccagccccacccgcaacatcctgcccaactacttcaacgccgagggcattccctcccaggacggctcccttaccaatatggacctatatgtgggcctgcggaaaaacccggactggtgcctggcctttggggaacggtatgtctatgtggtctacaattatttcgatcccgaccgcctgaccgccatcctggacgatatggtgaaccagctccggccggaaatggcccgccacatccagcgctggggcgcccccagctccatggacaaatgggaaacggaagtggctgagctgcgggaatgcttgcaggcccgtcaatcctatgccctgaaatatctccagcgggaatttgattttacggatgcgcagatggcccaatgggagcaggctgccaaggccgctgcttccacggctgtttctcctacgcctgcgccctga

SEQ ID NO: 2093 - DNA, 471 bp, Unknown
  Artificiall/Consensus sequence
atggctgtcctgacacatgttattccttgccagtcatacatttttggggtaaaatacaaacgtaataatatgctttatgataggcgattactttttaaaggaggtttgcatatggcaggcacgatcattaccgagcttggacgtatcaccatagacgaggatattctggcgaatatcgccggttatgccgcaacggaaaactacggcgttgtgggcatgaagccccggacggctaccgatacgtttttgcagcttgtaggcaacgataccaaccgcaaacgaggcgttaaaatcaccttcctgggagacggtagcgaggcggatgtagatctgtttgtcaccatggtctatggcgtttccttacaggtggtggcaaaaaataccatcggcaatgtacgctatcgggtagaggaaatgaccggcattaaggtcaacagcgtgaacatccacgtagaaaacatcaccgcttga

SEQ ID NO: 2094 - DNA, 1065 bp, Unknown
  Artificiall/Consensus sequence
atggatgaacccctggcgcttatgtccatggaccttgcagacctgcaggcgctgatggaaggctggcgggagccggcattccgggcaaagcaggtctatgggtggcttgcccggggcgcaaggccggaggagatgaccaacctgtccaaaaccctccggcagcgccttggagaattgccctatggaggcgctgccatctatgataaacgggtatcccaacgggacggcaccataaaatatttgtttgccctggaggatggcaacctggtggaaggggtgctgatgcgctaccactatggtaacaccctatgcatctccacccaggtgggatgccggatgggctgcgcattttgcgcctccaccctggagggttgcgtacgggatctacatcctggggaaatgctttcctttattgcctgcgcagaacgggacgaaccggcgcaaaaccggagccgcaccgtcaccaatattgtgttgatgggcagcggcgaacctctggataattatgacaacgtggtaaaattcctccatatggtgacggatccggcgggtatgggcatcagcccccgaaacatatccttatccacttgcggcctggtgcctaagatatggacctttatggaggacgcgccccatgtaaccctgtcgatttccctgcatggggtggacgatgaaagccgtagccggatcatgccggtaaaccgccggtacggcttatcccagttgatccccgcagccaaagggtatgcggataaaaccggacggcgcgtggtatttgaatacgccctgatcgcagggcagaacgcctccaaagaagatgcggctaagctggccgcacttttgcggggcgtaaactgtcatgtaaacttgatcccgcttaatccagtaaaggaacgggggctagccggtattagccgggaaaaagcccatcagtttgctggttggctgacggaaagggggatctctgctaccgtgcgcagggagatgggaacggatatcgagggcgcatgcggacagctgcgccgccgggtactggcagaagggaaaggaggaagcctgcagtga

SEQ ID NO: 2095 - DNA, 1749 bp, Unknown
  Artificiall/Consensus sequence
atgggaaggtttccggatgcttggttgcaggagctgttgtcaaaaagcgacctggcggccatcgcttccgaatatacggtcctcaagccaaagggaaggcggctttggggctgctgtcccttccatagcgaaaagaccccttccttttccgtgaccccggatacccagctgtattattgctttggctgccacgcagggggcggggtgatccagttcgttatgcaggcggagcggctcacctataccgaggctgtaaaaagcctggcccagcgggcgggtatggagctgcccgaagaggtgaacgatgaaaacctccaacgggagcgcgcccagaaggagcgactttacggcgcctgccgggaagccgcccggtattatgtgcgcaacctcctgggggagcagggggaagccgcccggcaatatttgatccgccggggaataaaggccagcgccgtcaaggcctttggtctgggctatgctttgcccggctgggagaacctcgcccaatacatggagcaaaagggcgtatcccctgagaccctggtggaggccggcctggccatacggggcaagcagggacggatctacgacgcttaccgggaccggatcatctttcccatcatctcggccaacggccgggtgttggggttcggggccaggaccatgggagacgatacgccaaaatacctcaataccggcgatacccccatcttcaataaacggtataacctttatggcctgaacctgcaacggggcaaacgcccgggggacctcatcatggtggaagggtatatggatgtggtgcgcctgtatgaagggggggtcaccaatgcggtggctagcctgggcaccgcccttaccgtccagcaggccaggctcctgaagcggtatgttccccgggtgtatatctgttacgatggggatgcggcaggccagaacgccacccttcggggtatggatatcctggcgggagagggcctggaggtgcgggtaatggccatccccggcggccaggacccggacgaatatgtgggggcccacgggggggaaggtttcctttccctgaaggaccaggccaagaacctacaggaatacaagctggacgccctttggcggggcgtagattcccaggacgccaacagccgggaggaatatgcgaaaaaggcctgtagctttttaaataccctacagccggtggagcgggaccggtatatccccattgtggcccggcgcacaggctatagcttggacgctgtccgggcccaatgccagatcggccagggacccgtccagaataaccctggaaaataccggcatactaagcaaaatcaggggcccaagccgcagcctgccaccgccgggctggagactaccctgctggcctgcatgctcaagagccaggacgccctgttggcggccttgagccggatgcaggcgttggagatccgcttcccaacggcggcccttaaccaactggcggaacggctgctggcggaaaaccccgatcccgccctgttgatgggagagcttaccggggagacggcggccctgatgagccaggccatggagcggttggagggcttggtggagccggaagccacggcattggattgcgtgaacacattggcccgtatggccatacgggctcgcatggaagaactgagcgcagcctatacggatagcccggaaacagcccaggagctatccgcgctgcaaaagaaattgacggaattaggccccatggcctga

SEQ ID NO: 2096 - DNA, 2073 bp, Unknown
  Artificiall/Consensus sequence
atgaagaactataccgcagcaaacatccgcaatatcggcattttcggccacggcggcgaagggaaaaccacccttaccgaggcaatgctttttaatgccggtctgatcgagcgtatcggtaaggtggaaaacggcaataccaccaccgactacgatcccgaagaggtcaagcgcaccatttccatcaacgccgcgctggcgcccttcgagtggaaggatgtcaaggtcaacatcattgacgcccctggctttttcgatttttatggcgaagtgaccgctgccatggcgttggcggacgcggccctgatcgtggtaggcgctgtttccggcccagtggtaggaacggaaaaggccatggccatgtgcaaaaagtctggcaaagcccgcatgatggtcatcaaccagatggaccgggaaaatgccaacttcgacaaggtgatgggcgaaataaacgaaaagtttggccccagcgtcgtgcccattcagctgcccattatggaaaagggcgcctttgtggggtatgtggatatcgtccatatgaccgctcgccgctttgatggcaagggcgagaaggaaatgcctatccccgatggccttgccgatcgggcccaagagctgtacgagcagctgaccgaagccgctgcggaaagcgatgaagccctcatggagaagttctttgaagagggcgagctctcccgggacgagatcctccagggcctaagccagggcgtgttggacggcgtcgttaccccggtgtgctgctgcgcggccgcccccaacattggcgtgaccacccttatggataacctgatccactatatgcccgccgccaaccaggtggctgctcctgcggctgtcaatcccaaaaacggcgaagccgtgcaggtgggccaggatggtaagtttgcgggccaggtcatcaagacggtgatcgaccagtttggtaaatattccatcattaaggtctatcgcggcacgctcagcgtggatacgcccctgtataacaccaatcaggaaaagaacgagaagggcactgcccctggcctcatgcggggcaagaaggttacgcccatggataagttgatcgctggggatatcggcgcgctgtccaagctccagtataccgccacgggagataccctgtgcgatccttcggacccggtacagtttgcagccatcgagttccccaagccctgcattagcctggcggtttccgcgaagaagcagggtgaggaggacaaggtctttgccggacttaacaaactcctggaagaagaccccaccatggccatcgaaaagaacgtggagactggcgatgtgctgatctgcggcctgggcgaagtgcatctggatgtgctttgctccaagctgaagaataagaccggcgtggaagcccagatctccgatcctcggattccataccgtgagaccattcgcggcaccgcggaagccgaaggtaagcataagaagcaaaccggcggcagcggccagttcggcgtggtcaatatgcgctttgagcccctgaccaacggcgaagatttcgagttcgtcaatgccattgtgggcggcgtggtgcccaaggaatacatccccgccgtggaaaagggtacccgggaagccatgaagaagggcgtattggccggctatcccatgatcggcgtcaaggccaccctgttcttcggcaagtaccatcccgtggactccaaggaagtggcctttaagagcgcggcccgtctggcctataaggaagcctgcgccaaggcccagcctgccttgatcgagcccatctatcagtacaacatcaccgtgcccaacgagtataccggcgccatcatgggcgatctgtccagccgccggggtcgggtgttgggtatgaacccctgcgaggacggtaccgaggtagtggcggaagcgcccctgtccgaaatgtttaagtatgccacggatctgcgctccatgacccaggcgcggggttactttaccagccaatttgtccgctatgaggacgtccccgccatggaggccaagaagatcatcgagaatgcccagaaggacgaggacgaggacgaataa

SEQ ID NO: 2097 - DNA, 2406 bp, Unknown
  Artificiall/Consensus sequence
atgcaggcagtcatcatggccggcggacatggcaagcggctgcgccccttgacctgcaccatgcccaaaccaatggtgccacttttaaacaagccggtgatcgattattgcgtggagctgcttacagcccatgggatcacggacattgcagccaccctacattacttgccggatatgatccgagagcatttgggggatgggcgggcatttggggcggagattcgttatagcgtagaagacaagcccttgggtaccgccggcagcgtggcggcggtggcccggcctggaaagcctgtgctggtaatgagcggcgatgccataacggatgtagacctgggcgcgctgatccgggcccacgcggacagcggcgcggcggccaccattgtgctcaaacgggtgcaggtccctacggaatacggcgtggctttgatggatgaaactggccgcataagccgctttttagagaagccccagctttcccaggtgtttagcgacctggccaatacggggatctatttgctctccccggaagcggtggaaatgatccccaaggatcaagcctacgatttcagcatggatctttttcccaagatgctggcggcaaacatgcccatcatgggtcatgtcacagaaagctattggtgtgatattggggaccttagggcctatgtacaagcccagcgggatatgctggcagggaagtgcgcctttgagaccttggcggtggagcgggatggcatttttatggagcatgacgccaaggtatccccggaggcggcgctggttgccccctgctacattggccgggatgcggaggtggcaggaggcgccctgctggcggacggtacggtgctgtgcagcggcgttcggatcggggcgggcagcagcatcaagcggagcattttgctgcaaggcgcccgggtacgggagcatggggagatccggggtgcggtcatcgcggaaggcgcccaggtggacgaccatgcccgtatctttgccggtaccgccctgggggctggaagccatgtgggaaaaggggcttctataaccgccggggcttgcctgtggcccaacaaacaggtggaggatggggcgacctgccaggaggatgtgatctgggatgggggcctgcacaagaacaacctggatacggtggtaaaaggctatacggatggggaccttgggccggagcgagctgcacggattggggcggcctatgtaaaaagtcagaaaggcgctcaaaaggaattggccattgccacagatgggagccagcaggcggttatgctcaagcacggggccatggcggggatggtgtcccagggcggggacgtatatgatctgggccattgcagctattccgcctttacccatgggattcgcagctacggcctacagggcggcatctatgtacagcgagatggcacagggccccatggagcggaattggctctatgcgatgggcagggctgccggttgacgggcgggagcttccgttccttccggcaggagttgctcagcgggccacatccgcctttgacggcccagcggctgggcatcatccagcagctggggggcgcggccaaaggctatgaagccaggctgggggatatcttggagccgggggtccaggccggtgggtataagatcatcctcagcggggatggggacctgtatgataccgcggcccgggtgcttttaccggctggatatagcgtgctattcatggcggaacgccaggcgagccgcttgcatggcagcatgatccaacagggggcagagttagggttcttcgtggacgaaacaggggagatgacctgtatctttcgggatcaataccttggcgaaagccagcggatcgttttactgatccaatgcgctctggcggaagggcggcttcggggccatacagggctgccggttgggatcagcgaaacctatgcggaatatttggagggcttgggatgcaaagtacatcgatgcccagaggaccgggaaaaatggaagaaacaggcattgacccacggctgttatcttccagagctatttgaaacggaggcagcggtggtgcggttaagccaaatgggacggcagggacggcttgccggctacgtggagcagttgcccaagacctatgaagcggagggcagcgtgggctgctcctggaaggagatggggcgggtaatgcgaagcttggtggagaccgagcgcagcgaccgggtggagctgatggacggggtgaaggtgcgcagcgacaaaggctgggtgttgatccggccgaacggggatctgacagcctaccgggtggtggctgggagcttcaatggggaatatgcgcaggagctgacagacctgtatttggataaggtccggcagattgcccaagacaaaggggaagaatcgtga

SEQ ID NO: 2098 - DNA, 897 bp, Unknown
  Artificiall/Consensus sequence
atgtttaccgcaaaagacgtaatggccctgcgcgagatgagcggcgccggcatgatggattgtaaaaaggccctggtagagtgcgacggcgacatggataaggccatggactatctgcgggagaagagcctggcggcttccgccaagaaggcgtcccgcattgcggccgagggcgtggtatccagctacgtgagcccggatagcaagaccggcgtcatcgcagaagtgaattgtgagaccgacttcgtggccaagaccgacgacttcaaggccctggtggatacggtagccaaactggtggcggagcaagatccccaggatgtggacgcccttatggcgttggataccggcgacggcaccgtggcggagatgatcacccgggccgtggccaagatcggcgaaaagatcaccatccggcggtttgcccgcagccatgtggaaggcggcatggtggattgctatgtgcacctggggggtaagatcggggtgctggtggagatcgcctgcgaggacgtggccgctgccaagcccgtggcccatgacatcgccatgcacattgccgctgccaagcccacctgcctgtccaaggcggacgtgaaccaggatgacgtggagcacgagcgcaagatcctgcgggagcaggccatgaacgagcccaagcccaagcccgccaacatcatcgagaagatggtggaaggccggatcgaaaagtactacaaggaagtctgcctgctggagcagccctttgtcaaggagcctgacatcagcgtgggcaagctggtagagcgcaccggcggcatccaggtgctgggcttctatcgcttcgagatgggggaaggcctccagaagcgggaagataatttcgctgaagaagtgatgggccagatgaagaaataa

SEQ ID NO: 2099 - DNA, 2181 bp, Unknown
  Artificiall/Consensus sequence
ttgggaaatgcaggggtatccggcaaaaaaagattagcgatcaccctggttggggtggcggtgatttttttcctgctcatcctgcgcttggcctggtttatgttgatccggggctctgagcttagggagctggcctccaaccagcagacccaggatacctccctcaccgcttcccggggcgccatcagcgacgcctccggggtggtgctggcccaaagcggtaccgcgtataaggttttgctgaatccatacctgatgagccaggaggaatacgcggacgaccggcagcggatcgccctggagctgtccgagatcctggaaatggattatgattatgtgttacagcaggtcatgaagaccaatagtgctggtgaatactatagagaggtcatcctgaagcggcaagtggaacgggatgtgatcgacgagatcaatggccgccaactgggagccggggtctacacggccatcgactccaaacgctattatcccaacggcagcctgttctcccagctgctggggttcaccaccatcgacggggtggggcaaagcggcctggagcagaagctggataaatacctggcgggcgaggatggccgcatgatcacggaaaccgaccgggcgggccaggccctggcctatggggcccaggagatcatccagcccatcaacggctacgacgtggtgctcaccacggacagcgccatccagtccttcctggaaaaggccctcaaggaggccctggaggtaaaccaggcggaaaccgcccaggggatcatcatgaaatgcaaaaccggcgagatcgtggccatctccacccagccggactatgatcccaacgatcccccccgggacgatatgtccctactcaattccttgagccgcaaccgggtggtggcggatagctacgaacccggctctacctttaagatcatcaccctggcggccgccctggacagcggcacggtgaatgaatccacctcctaccattgcgatggctcgtacgtggtaaacgaggagcggatcaaatgctggaaggacggaggccatggcagcgagaccctgatcgaggcggtgcagaattcctgcaatccggccttcatgcagatggccttggccatgggggtggagaccttttacgattacatctacggcttcgggtttgggagcaccacgggcagcggcatctccggggagagcggcggcatcgtgacccaccagaagtatattaacgacaataccctggcccgcatcggctttggccaaagcatcgccgtgacccccatccagttggccactgccgtatgcgcggcggtgaacgggggagagctgatgcagccctatgtggtggaccgcattgtcagcgaaagcggcgaggtgatcctgcaaaaccagcccaccacggtgcgacgggtgatctcggaagagaccagcgccaaggtccgcaccattttggagagcgtggtcaccgagggcagcgggaaaaacggcgccatacccggttaccgggtggggggcaagaccggcaccgcccagaaatacgaggacggcaagatcgccgaaggcaagctgatcgcctccttcatcggcttcgcgccggcggacgacccggaatacctgtgtttgatcctggtggatgagcccaaggtgggcaccattttcggcagcacggtggcggcgccctttgtcaagcaagtgctggaagaaaccctgcgccacgcgggcttcttgcccaccgagcaggcggagaccgtgagcgtgcccgacctgacgggcatgaccatccaggatgcgaaggcggccttggaggccaacggcttggaagccgtataccaggacgatgaggcggatacggtgaccgcccaggtggcggcgcccaatgagatcgtacaaaaaggcagcgaagtgctgctatataccgccaacaccggcgagatcatcaccgaggcggagatagagcaagtgaccgtgcccaatgttttaggccgcacccggctgggggtgaaggatatgctggacgaggcggggctggagatccgcatcgacccgccggatcaaacgggcatcgccttccggcaggtgccggaggcgggcaccaaggtagaagctggcacagaggtgctggtggagtttgaaaacgccgccaccgccaccttgcccggcgacgaggaagaggactag

SEQ ID NO: 2100 - DNA, 1233 bp, Unknown
  Artificiall/Consensus sequence
atgaagcggatcgcggtgatcggcggcggcccggcgggtatgttggccgcagcggaagccgccggcaaaggaaaccaggtcatcctgtttgagcaaaacgagaaaacgggcaagaagctctacattaccggcaagggccgttgcaatctgaccaacgcctgcccggtggaggagatgttcgagcatattccccgcaaccccaaattcctgtacagcgccttgtatggctttaccaaccgggatatcatggcgctggtggagtctatgggaattaagctaaaggtggaacggggccagcgggtgtttcccgtatcggaccatgccagcgacgtacttaaggccctgaacgcctatatgcagggtaaaggggtggaggtgcggctgcatagccgggtggagtccttgaaaaaggtccaggctggatttatcgtaacggtaaatgggcaggacttgccttttgaaacggtgatcctgtgtaccggtgggaaaagttatccaaccaccggttcagatggttccgggtatgcattggcccaaagcctaggacataccctgatcccttgcaagccttccctggtgccgctggagacccaagaggattggccgaaaacggctatgggcctttccctgcggaatgttcggctccaagtgaaacaaaggggaaagacggtgttttctgaactaggggagatgatgtttacccactttggggtatcggggcctttggtgctatccgccagcagccgcatcgcagacgctccccaaggctgcctgctttccatcgatctgaagcctgggctggacccggaggccttggaccggcgggtgcagcgggattttgaaaagaataaccggcggcaattctccaatggattgggagaactcttgccggccaagctcataccggtgctggtggagctttccgggataccgggggatttgaacatcagcagcgttacccgcgtccagcggcagcaattttgccacctggtaaaaaatctgccattgaccgtaaaggggccgcgggatatccaggaagcggtgatcacccggggcgggatcccagtgaaggaggtggacccttccaccatggaatccaagctggtaaagggcttatattttgccggggagatgttagatgtggatgcctatacgggcggattcaatttacagatcgcctattccacaggcgtgttggctgggcgcagcgccggagcgggcgaaaggggataa

SEQ ID NO: 2101 - DNA, 2361 bp, Unknown
  Artificiall/Consensus sequence
atggtgctggctgtcctgggatttgtgctgtttatggcggcgcagctctgggatctggacgcatggcaggattttgacccagccaacattttaggcgcccagcaatccctcatcctttacgatggggaaaacggcgagatcctccggcttcacgacaaggaggaccgggtatccatccccctgtccgatgtgccggatttggtgcaaaaggcctttatttccgccgaggacgcccgcttttatgagcatccgggcgtggatgtgatccgtatcgtgggggctgcttgggcagatattaaagcgggaggctatgtccagggggcttccaccatcagccagcagctgatcaagctgagccacttgaccgctgacaaaaccatctcccgcaagctggaggaggctgtgttggcctgccagatggagacccgctactccaaggacgagatcctggagatgtatctaaactacgtttactttggcggcggctactacggtattgaggcggcggccctgggctattttggcgtccacgccaaggatctgtccgtggcccagggagccatgctggcgggcatcttaaaatccccctccaactacgcgccccatctggattttgaggcatccctggcccgccgggatacggtattgagcttgatggcggaatatgggtacctggatgaccaagggttggctgacgccaaaggggaaaccatggtcatccttcatgatggcaccgcctccgaggagggccggaattattatgtggacgcagccctgcaggacgccatggagatcttgcagatcgatagcgaaaccctattgagcggcggctatcggatctatacggccatggacagcgccatccaaaaccagtgcgaggccattttccagcaggacgacctattccccggggacgcccagggggccattgtggtacaggaagcaggaaccggcctgattcgtgccatggtaggcggccggggggcatacgataccgccatggcctttaatcgggcgacggatatccgcaggcagcctggttcggtgatcaagccggtgatcgcctatgccccggccctagagggctatggttacaccgccgccaccatgctgttggatgaacccaccacctttgcggaatacagcccccgcaacttcggcaacaaatattacggctgggtcaccctgcgggaagcggtgactcgatccttaaacgtacccgctgtaaaggtgctctccgatatcggggtatccgcgggaaaggcctttgcccaaagctgcggcattccctttgacccccaggataccagcctgaccttggccctgggcggctttacctatggggtatcccctctacagatcgccggggcctatgcggcgtttgcttcccaagggatctataatacccccacctgcatccaacggatcacggacagcactggaaaggagctttatgtctatgaaccggagaaccggcgggtcatgtcggagcaaaacgcctatatcctcaccagtatgttgcaaagcgccatccaggaagggaccggacaccggctcaaggatctggatatccccttagccggtaagaccggcaccgtgggagaaggggaaggcaatcgggacgcctggatggcctgttatagcgccgactatgcggcggcggtttggatcggctacgataccagccaggatggcgctttgccccaggacgccaccggtgggaaatatcccgccttgatcctggagcagctgttccaaggcctttaccaagaccgcgcgccaaaagaattttccatgccctctggcgtcaatgcctataagctggataaacgcaccttggaaatgttccatgagccggtgctggccacagccttgacccccagctccgccatccaaaccgaggtgtttgtggaggggacgcagcccacagcccaaagcagctattgggtggtgccctcgccgcccggtgaattccgagtatatttgggtggggacggaaaaccgcaaatcgcctttaccggccgggaaagctttgcccaatatcagctataccggcaaaaggggaccgaaagcccccagctgatcaaaacctgggacggcaagggcgccgtcacctatggggatgattccgcgctgcccggctgcacatatacctattatatattgcctgtgcatcaggaaatgaacgtgggcggagagcaggtaaaaggacccgccaccaaaaaagtaacggtcaccaccccggaagcggtgatcgatgtggagatccctggacccaccccgcaaggtgaagttaccccttcgccggcagcttcccccagcctgctggaggaattgtctgctgcttttgccggtaggtga

SEQ ID NO: 2102 - DNA, 1941 bp, Unknown
  Artificiall/Consensus sequence
atgctggcgccgcttctttgcttggtgcttttatgcgcctgccaaaaggaggtggagaccaaccgataccagggatatacccttgcggacaccccattggaaggaggggaggccgtcgcagaggccaatgcctatgccctggccgtaacccccagcggggaaactacgaagttgaccttcacctttaaaaccggcagccgcatgagcggtacggtaaacgaaagcgaagcccagggcgtgccccggtatcgcgcctggatagaaaccgcccctgccaggctgatgcttcagtttgacgggttgagctattgggattttgagcgccgggattgggaaaaatccggtttggttttaggctatttccgctatgcgctggtcaatccccttcctttacagaccgatgcgcccttggatggggaagctgcggaagcggcggaagaggagccccagcctatggaatcggtctgtctatgtttccagttggcgcaggacgctgcctttcagatccaggagcaggggggacagttgagcgttacccttttgcctgtggtccaggaagcccagccggaacaagaggcggaagaggcgccctggtatttgatcggcaatgggttccgggattattgtgaaggtaccctattgggcgcggagcaaatgacccccacgtatacctccagtttggatcaggtggtgcttatctcccaggcatatgcttcggatattgaggcggaattggcaaaacggcagattttggagcaaaaccccagcgccttggaaagcgattggatggcggtgcagctgggggcggacggcttacctgcctttgatgaaacggctaggcaacaagccgcttttgtagaagcggtgcagcgccgaaacggccaggtggcaggcgcccaggtttgcctggcggacgggatcttcctttcctctgtgccccgtaggctgggaggtgggatcttgtattccaaacggatcacagagggcattggtgtagacgccatcagctatgaagaactgtatatcctggacagccaggataaggaaaagcggttgctggactatgcctttgccacagtagagcgggctgtcttttcaccggatggtagaaagctggccgtattagagcgggaggcggagcgcaccaacctgtatgtggtggacgtaggtacccgcgatatcattaccgagctgacgcgggcagggttcggggacacggtgagcgccctatgttgggatagtatgggcagcatgttgttcgcggtgagcggcagcggagaaatgcaggtccatgcttatgactttaacgtgccggatgaaaccaagcgccatacggtggtggataaaaatggggccaatgaaggctacatcggctattgtggcggcgaggtatacttcgtgcaaagcgaaatggaaggggataccatctacgaaatcaagcccgaagggggcgtgcgcaaagccttttgccaaggcggcgcatttgccctttcccccaataacgcctacatggccattagcggcgcttccagcattgcgggaggcgcggggggcgaattcctgctgcgggatatgcagaccgggcaaacccaaaccatcaccgacgatttcgccgtatatgactttgtctggagccaggacgggtccattctgtattattttgaaaaccggctctccggcagcgcaggggaagccggagaggaagcggctgctacccaaacgccccagcctcaggacccctatccctataccctgtgggcctatcagctggaaagcggggaaagccagccggtatgcgacctggccagtacccggatcgctgcttccagctgggccaaccggctatattatacctatctggacgaggagaccatgggggaaaaggtgcgggcgacctattggatcgattttcagcagacgccggagcaaagcggcgcatag

SEQ ID NO: 2103 - DNA, 1110 bp, Unknown
  Artificiall/Consensus sequence
atggaacagcgggcacgacggtaccggctatggttatgctttgccctggggcaggcccacagccgcatcgcagcccttttggcccactaccaggaggatgcggaagcggttttccgggacgcaaagcaccattgcctgcccgaattgaatcaacgggacgccggcctgaaccggcagctatacgaaaaggcggaggaagggtacatcgatcgttgcctggcgtatatggagcggcataagatccagggggtgctgctgggagacgccaattacccaaaattattgacccagatccatcgcccgcctacctgcttatatgtgcggggcaggctgccggaggtcattcatttgcccatcgccatgatcggttcccggaattgctcggaatatgggaaacgggtcgccatgaccatggcccgggacttttccagcgtaggggtatgcgtggtatccggcctggcccatggcatcgacgggctgtgcgccaagggggccctggcggcggtggataattcctttcccaccatcgcggtgttgggctgcggggtggacgtggtatatccccctcagaatcgggagctgtatgagcaggtggtggaacggggggccgtggtatcggaatttcttccgggggaaaagccgcttcctgcctatttcccccagcggaatcggatcatcagcgggctgagcaaaggggttgtggtggtagaagccgccttgcacagcggcaccaatattaccgtggagttcgccctggaacagaaccgggatgtatttgccatcccaggaaggcccagcgatgaaaagagcaaggggaccaaccggcttataaaagagggcaacgcaaagtctgtgaccgatgtatgggacgtgctggaggagtacgacatccagccagggcaaagagcggctcccaaatggatcgacgaaagccggctgagtttggagcagacccttttggtgcggctgctccaggcaggggaacgaaatatcgatgaattgtgcgaattgacgggctacaatgccccagagataaatttagccttgacagatatggaattatcgggaataattaagcaatcgccgggtagattgttcagcttggaataa

SEQ ID NO: 2104 - DNA, 1584 bp, Unknown
  Artificiall/Consensus sequence
ttgcaggatttattgcatttgcccattttgcaaaattccaaagtccttgccggcagccaaggcctatccaatctggtcaccggcgccaccctggccggcgccccggatattgtggccccggcccatcccggcgagctgttcctggtggactggacctggatcgaagcgccccccgccctttcctcggactttatctaccggcttcgtcaattgggcatttcgggcatttgcctacgccctgcggtgagcctgccggatttttccccggattttcttcgggaggccgaccagctccgcctgccggtgatccagctggcccggggcatcaccctcgccggggtgctcaaaggggtttccgacgccctcttggagaagcaggccgcctatcttgcccaggcccaggccttggacgaggtggtgctctccttgctggcagggggggcggacctggtgggcattgcccggatgctgtcccagctggtggggaattccgtgctgatctgcgacaccatcaacggccgcaacgcccgcttccttaccaagcggggccaatccattgccagcctccgggggaaggaatccctgccccagcccacccaccggcccatccatgtgggggatgaggtctatggccagatcttcgtctaccctaccgactcccccatcacccaggcccacctagaaaccgtggagttgatcgcccgctccgtttccctagagatcgcccagacccgtaacaaccgggattccgccaaagccctggacgattattttgcccggctccttcgcaccgccccggtggaacctgccaaggaggcccatcgcagtcccagtccctggttggttttagaccatgtccatatggtggtgcgcattcgcatctccgagatcggcgacgcccacagcaggcctccagaacgggccttgcactttgaagaggtggaagatatgttccgggccctggatgtaaactgcctccatgtccaggatgggacggaacatctgctgctcttaaacgcgccgaaaggcaaaaaccgtctaggcgaggtggcccagctattagagcggatcatggcgggcctacagcgccacgccccagacctgcggttccaggcaggctatggcaacccgcggcctggcttcgagggcctgctgcaaagcgccaagcaagcgcaaaccgccctgcggctatgcgccagctcccaggacgaaaccagctgtatcctaggctttcatcagatcggcctgttccggctgatctacgccgacgacccggacgcggagatccaggcatacatccaggagaccatcggccccttgttggaccccaaggagacccggaacgtggagtttatcccggtgctggaagcctatttccaatgcggcggcaatctgaagaagctctctgagctcaccttcacccactacaacaccctggtctaccggctcaagcgggtcaaagagctcaccggcctggatccccgggtggcccaggagcgctttgccctggagaccgccatccagctctaccggctccatccccaggccgccggccaggaggacctatccagaaaccccggctaa

SEQ ID NO: 2105 - DNA, 1401 bp, Unknown
  Artificiall/Consensus sequence
atgcgcgaacctgtttttgtttcccaagaatcccttgcccaaagcagggccgccgcccttcggctgcgcgaagccctcaagggcaggttgctccgttattatatcgaatcctacggctgccagatgaacgaccacgatagcgaaaagctggcaggcatgctgtgtgaagcagggtttcaacctgccccttctaaggaggaggcagattttatcctgttcaatacctgctgcatccgggagcacgcggaaaagcgggtctttggcaacgtgggggccctgaaaaaacaaaaggacgagaacccttccctttgcattgccgtttgcggctgtatgatgcagcaaaaggatgtagccgcccggctttataagcgctttccctttgtggatatgatatttggcaccaatgagctccaccgctttcccatcctattggaagaagccctgtccggcaagcgggtgctttcggtgacccaaagcgatggggagatcgccgaggggcttcctgtcctgcgggagagccgcttttccaccaatgtgaccatcatgtatgggtgcgataatttttgcacctattgcatcgtcccctatgtgcgggggagggagcgctccaggcgcagcgatagcattttagaggaggtccagggcctggcgaaggccggctaccaggagatcaccttgttgggacaaaacgttaactcctatcagggggacgggggggccatggattttccggcgttgctacataagctccatccggtggaaggcatctctcggatccggtttatgacctcccatcctaaggacctgtcgcccgccctcatcgaggccatgggcagccttcctaaggtctgcaaccacatccatctgccggtccaatccggcagcaccaggatcttgcaagctatgaatcgccgctatacccgggagaaatacttggggctggtggacgccctgcgcaaacgggtggacggcatagagatcaccacggatttcatcgtagggttccctggggagacggaagcagattttcaggataccctgcgcctggtggaagaggtaggcttcagcgccgcctatacctttatgtattcgccccgggaaggcacggttgccgcccgtatggaggatcagatccctgaggaaatcaaaaaggagcgtttggcccggctcaacgaggcgatcgccgccaccttgcagcagcacaacgtccatttcctaggccaggagggggaggtgctggtggagggctatgaccggcgcggcacgcagatcatggcctttggcaagctcccatgctttaaaatggtgtacttcccaggagatgaaaccatgctgggccagcttcggcgggtccgcattaccgcaacccaggcaaattcgcttctaggcgagctactataa

SEQ ID NO: 2106 - DNA, 1068 bp, Unknown
  Artificiall/Consensus sequence
atggaggtgttgggttatatgccccaagagaattacgcaggcagcgaatataaaaaatacctttccaaactgcggagcctttgtgaagaattgccccccttttgcggggaatttttccgagggatcgagcacgaaacgctggtccgttcccgctatgcttacggggtggatctgcgcaatttctttacctatctgatccaacagcctggctttacgcaagcggatatccgttccattcccctttcggatctggataaagtagacgtaaccctgatcgaagggtatttaagctatgtttccttttatatagatgaagatgagaaagaaaaattaaacggagagcgtgcgaaaaaacgcaaattatccaccctacgttcgttttacaaatatttttgtaaaaaggagaaattgcataacaatccccctgccctggtggatctgccggtcattcgagagcgttccatcatccggctggagccggacgaagtggccaacctgctggatattgtcgaagctggcgaagggttgacggaggcgcaaaaaaaatatcatcatcgtacccaggcccgggatctggccattttgaccttgttccttggcacaggcatccgaatcagcgagctggttggcattgatatggacgatgtaaacttttccgccaatgaattttccgttgtgcgcaaaggcggaaaagaggatattctggtatttggcgaagaagcccgcaaagccctcttggactatatgctggaacgggaacgtatgaccccccagcctgggcacgaaaacgccctgtttctttcgctgcaaaaccgtcgcatcaccgtgcgggcggtggaaaatttggtgaaaaagtatgcccaactggcagcgcccttgaagaacatctccccccacaagctgcgcagcacctttggcaccaatctatatcgggaaaccggcgacatttatttggtggcggacgttttgggacataaagacgtaaataccacccgcaaacattatgcggctacctcccaggataatcgccgcattgcagcccatgtgatcaagctgcgggacgattga

SEQ ID NO: 2107 - DNA, 1485 bp, Unknown
  Artificiall/Consensus sequence
atgaatccgatggaatatgtaagtccagaaccctataagctttacatcaacgggcaatatgtggctgcggaaaagggcaacattgtggatgtgatcaaccctgccaacaaccaaccctttgccaaggtttaccggggcaccaaagaggattgcgaaaaagccattcaggccgcccgcaaggcatttgacgaagggccctggagcaaaatgtccgccaaagagcggagcaagctgctgcttaaggcggcgcgcattttagagcggcgggcggaggaattttccgtcatcgagaccctggaatgcggcaagaattacggcgcctgccgttactgggaagcgcctatggcagtggatgcctttgagttttttgcaggcaaagcccggcatctggacgggaaggtagtaccttccgagtatggcaccctgaattatgttacctggaatccctgcggcgtagtaggagagatcctgccctggaacgggcccttccttatgggctgccagaaggtaaacgccatcctagccgccggcaatacggtggtcattaagcctccgacctggggggtgttgtccatgctgcttatggccagcgtatatgaggaagccgggttccctgcaggcgtggtgaacgtggtgacgggttacggccccgaggtaggcaacaacctggtggaaagcgatctggtggacatggtctccatgacaggcggcaccgccaccggccgggagatcatcacccattccgccaagctggtcaaggacattgccctggagctgggcggcaagagccccaacatcttctttgaagatgtggatattgagcaggcggcccggtttgccgtatacggctttaccaaccacgcgggccagatctgcgtttccggcacccgggtgctggtgcagcgcagcatttaccagcggttcctggaggccatggtggccgctgcgggccggctggtgcctggcgatgggtttgaccccaacgcgaatttgaataccctgatctccaaagcccacgcggccaccgtttgggactatatcgagtccggcaagcgggagggcgcccggctgctatgcggcggcgtgccttatacggaaggcccgctggcccaggggaatttcgtgccggtcaccatctttacggatgtgactcccaacatgaccatcttccaagaggagatctttgggcctgttggctgcgtaaccccctttgataccgaggaagaggccatcgctctggccaacggcaccgcctacggcctggcgggcggcgtctttaccaaggacatcaaacgggccatccgggtggcggataaggtcaagagcggccagatctatgtcaacaattatttcagcaagggaatgatcgaatcccctggtacaggttggaaggaaagcggcttagggatcgcaggtatccacaaatacatgatttccaagactgttttcctagaaaccattgacgatgtcctgcctcccgtgtga

SEQ ID NO: 2108 - DNA, 1113 bp, Unknown
  Artificiall/Consensus sequence
ttggaaaataaggatcgcaaggaaacccccaaggaaaaggaaccgaaaaagagcccggaagcccggatagaggagctgatcgaaaccggcaaacaaaatggcgtcctgacctataaggaggttatggataccttaaacgagctggaactggacgcggagcagatcgagcggatctacgaccggctggaggccctcaacatctatgtggtggatgaggtggaggtgccccaggatatcaacgaggatattgcggagatcgaaaacgacatcgggggggaaggcatcgccatcgacgacccggttcgcatgtatcttaaggagatcggcaaggtccagcttttgtccgcccaggaggagatcgatttggccaaacgcatggcggaaggggaccaggaggccaaacagaagctggcggaagccaaccttcggttggtggtgtccgtggccaagcgttatgtgggccggggcatgctctttttggatctgatccaggaagggaatttgggcctgatcaaggcagtggagaaatttgattaccggaagggttacaaattttccacctatgccacctggtggatccggcaggccattacccgggccatcgctgaccaagcccgtaccatccgcatccccgtccacatggtggaaaccatcaataagctcatccgggtcaaccggcagcttttacaggattatggccgggaccctcgccccgatgagatcgcccgggagatgggcatctccgaggagaaggttcgggagatcatcaaggtagcccaggagcccgtttccttagagacccccatcggcgaggaggaggatagccatctgggggatttcatcccggatgacgacgcccccgccccggcggagcaggcggcgtttaccctgcttaaggagcagctgatggaggtgctggacaccctgaccccccgggaggaaaaagtactgcggctccgctttggcctggacgacggcaaggcccgcaccctggaggaagtgggccgggagttcaacgtgacccgggagcgcatccggcagatcgaggccaaggccctcaggaagctgcgccacccctcccggagtaagaagctcaaggattttttggaataa

SEQ ID NO: 2109 - DNA, 1491 bp, Unknown
  Artificiall/Consensus sequence
atggagcatgtcagcaaacggtttggcgacttctatgccaacaaggacatcgatttctccgtgcggcggggagaggtccacaccctgctgggggaaaacggcgctggcaaatccaccctgatgaacgtcctgatcgggctgtaccagcctacggagggcaccatttacctggatgggaaaaaggtgcgcatcgattccccggcccaggccgtgaagctgggcatcggcatggtgcatcagcacttcatgctggtggaggccatgacggtatttgaaaacatcatcctgggggatcggaataccaagggggtctttatcgaccgggaagcccgtaaaaaggagatccaagatctatccgcccggtatggattggatgtggaactggataagcccattacggaaatttccgtgggcgcccagcagcgcgtagaaattctcaaggccttatatcatggggcggagctgttgatcctggacgaaccctccgccgccttgacagacatagaggtggaaggcttgttcgccatcatgcgcaagctcaccggcgagggcaaaagcatcatcttcatcagccataagatgcgggaagtgttgcggatctccgaccggatcaccatcctgcgggcagggcaaacggtccgaacggtaaaccgggaggagaccaccggcgaggaactggccaacctgatgatcggccgggaactgaccccctcccattatgaaaagatcaccgcccccggggagccggtggtatccctggaaaaggtggattaccataaggaatccaaacacaacggcctttcaggggtatccctgagcgtaggccggggggagatcgtaggcatcgccggggtggatggcaatggccagagccagttggcccaggtggtgaccggggtgttgaccccggatgcagggcgggtggatctaaaagggtcccgggtggcccagtttacccccaatggctttattttggagagcgtctcccatatcccagaagatcgaaataaaatgggcctgatcggcgacatgtccgtgcaggagaacatcgtcctcaagtcgaccgataccccacaattctcttccgcccggggcttccggctgaaaaaacgggccattcgggattacgcagagcaaatgcgaaagaaatacgacatccgctgtacctctgtggagcaggaggctaggaacctttccggcggcaaccagcaaaaggtgattttagcccgggagttggagggccagccggatctgttggtggcggtgcatcctacccggggcctggatatcggtgcggcccggtttgtccacgataccatgatccaagcccgggaaaaaggctgcggggtgttgctgatctccgcagactttgacgagatcctggaggtttccgaccggatcgtggtgatgtttgaaggacaggtgatgggggtgttctccggcaaggagccgcccattcaagagatcagcctggccatggccggcaagtaa

SEQ ID NO: 2110 - DNA, 1506 bp, Unknown
  Artificiall/Consensus sequence
atgagcgaaatgcgtcatatcgaatataaaaagccgcggatcggcctgtacagcatgggactcaaggcgtattggacccagttccccggccttcgggagcgactggcggaatatggggagttcatcgcaaagcgcctggaagcctgcggcgcacaggtattcaactatggcctggtggattgcgagcaggcgggcagcgcagcaggggattatttttccaaggcggacgtggatctgatcttcagccattccgccacctattgtaccagcgccagcatccttccggtacatcagctttgcccggcgccggttgtagtattgaatttacagcctgcccctcggatcgattatgcccgcaccaccaccggagaatggttggcccattgcggcgcatgcccggcgccggaagtggccaatgcatttaaccgtgccggtatcccatatcgggtggtgaacgggctattggggttggactacaccccagagatctccctgacggaagaaaacaccgcggaccggccggaggcaaagcgggcctggaagcaaattgaagaatgggtgcaggccgccaaagtaaagcggaacctaaagggcgcccggtttggcttcctagggaatacctatgggggtatgttggacctgtattcggattttactatgttttccgcccaaaccggcgcccatttgcaggtgctggagatgtgcgacctggagcagcagctccagcaggtcaccgatgaagaggtggcggcaaaacgacaggagatcgaaggctttttcctgatcaccgacgaccaggcggcagaccccttggccagcaaacccacccaagcccagctggactggtccgccagggtggcttgcgcccaggagaagctggtgcaggcattccatctggacgcgctggcctactattaccatggggcgcctggcggccattatgaggatgtgcagggcggctttatcgtggggcactccctgttgacggcagccggtatcccctgcgcgggggaaggagacctgaaaacagccctggctatgaagatttgcgatatcctggggaagggcggcagcttctgtgaaatcgtggtgacggactacgaggatggggtgatcctattgggccatgatggccccttccatttggagatcgcccgtagcaagccgtttttgcggggcatgggcctataccatggcaagcagggcactggcgtatccgtggaggccaaggtcaaggccggccccatcaccaacctgaactgcacccagaccatcgatggtaagctgaagtttatcatcaccgaggcggagtccaccgacggccccattatgaccattggcaatacccagacgccggtccggttcaaacgggacccggacagctacatggacgcctggtttgctgaagcgcctacccatcattttgccatgagcgtgggccataatgcaagcctgctgaataaggtggcggatctgctaaggatcccagcggtgacactggagtag

SEQ ID NO: 2111 - DNA, 2268 bp, Unknown
  Artificiall/Consensus sequence
atgtatgcacaggtgatggtggatattgccaatgcaaatgtggataggctgtttacctatgcggtgccggaagacctacccatccaaaaagggcagcgggtattggttcccttcggggcgggaaataagcagaccgaggggtttatactggggctttcccaggaagaatacgtaggcccggttcggttaaagtccatcctgcgcaccttggaaccctaccctgtgttgggggaggatcagctggaactggccaaatgggtccagggggcctatgggtgccttttggttgaggcgttgcggctgatggtacctgcccagttgcggggaggacgggtgcgggaaaagcagatccgaatggtatatgtccccgagaccgtggatgtggaagcggctctagcctcctttcaaaagaaggacggcacgcttcgggcccccaaacagcatgaaatattggagctggtgagccactatgccgaggggatcagcgtgggggatatctatggattcatccccggcagcggcgcggcggtaaaggctctgctggacaaagggcttttgcaagaaaaaggctgtacggtctttcgttccccctatgggaacaagccgttggaacgggatgcgcctagacggctcaactcagcccaacaggcggcgtatatggcgattgtaaaaggcatgcaggatcagggcggcacctttttactccatggggtaacaggcagcggcaagacggaggtctatttgcaggccatcgccaaggccatagagacggggggaagggccattgtgctggtgccggaaatatccttgacgccccagaccgtaggccggttccgctcccggttcggtcagcggatcgccgtgctccacagccggctgtctccaggggaacggtttgatgaatggcgcaggatccggcttggccaggtggacgtggtgatcggcgcccgcagcgccatctttgcccctttggaaaatatacggctgatcgtgatcgatgaggagcacgaatccagctaccggagcgagatcaccccccgctacagcgcccaggaggtggcccgcaaacgctgccggcaatggggcgccaccctggtactgggtagcgccacccccagcgtgaccgcctatttgcaggcggtgaaaggacggtataccctgctttccatgccggaccgggtgcgagatctacctatgcctgccgtggagatcgcagacatgcgggcggaattcgctgctggcaataccagcattttcagcggtcccttgtaccggcgtttgcagcaatgcctggaagcgggggagcaggcaatcctatttttgaaccggcgggggtattccacctttgtttcctgccgagggtgcggatatgtcttcacctgcccggattgcgacgtttctatgacctaccacaagcaggagggcatgcttaaatgccattattgtggcaaaagcatcccagtacctagaatttgtccccaatgcaaaaagccttatattaaatattttggcgtgggaacggagcaggtgcagcaacagcttttagaagcgttccccggggtcaaggtgctgcgcatggatatggatactacccgggggaaaaatgcccacgatgccatcctaaccagctttgaacgaggggacgcccaagtactcatcggcacccaaatggtagccaaagggctggacatccccaacgtgaccctggtgggcgtcattgcggcggacgcggcgctgcatatcccggattaccgcagctacgagcggacatttcaactgctgacgcaagtatcaggcagggccggccgctcggataagccgggccacgtggtgatccagacctataccccagaccatccggccatccaattggccgctgcccatgactacgccgggttctatcaggtggagatcgcaaaacgccgggcattcctgtttccgccgtatgggattttcctgcgggctttgtttatgggggaggaagaagccgggctccaggtccgcgcccacgcctttgcccaaggattgcggcaggcagtggaacaggccatccagcaggcgggaggcgatccgagagccattttgttttgcggggacggcccagcgcctatccgccgccgggagggcttgtatcgataccaagccttgatgaaattggcccgtacggcccaggccggggcagccttgaaggcggcttatgcttttgcagcgccccaacggggagatgggttcggcacgctggagatcaacccatcggatatgttttaa

SEQ ID NO: 2112 - DNA, 1308 bp, Unknown
  Artificiall/Consensus sequence
atgaccaatccgcgaaggatcgctctagaagccttgctggatattacggatgccggcgcgtacgccaatttgcggttgaaggatgcgttggccggcttgccccagcgggaagcccattgggtcagcgcggtggtgtataccaccctggaccatctcctttacatcgaccatgtgctggccgcctttgcaaaaggccgggtccagcctgtgatccggggggtcctgcgcatgggggtagcccagctgttgtatatggatgtgccggataacgctgcctgcaacgagagcgtaaatctgtgcaagcaggtgggaaagcagaaactcgcaggctatgtaaacggcgtgctgcgggccatctgtcggaaccgagataatttgccgccgctgccggacgatccagccgatcggctgagtattcaatttagttggccccgatggctggtagaggaatatgtggcccagtacggggcggaatttaccgccgctctactggatgccaaggcccctggaatgaccttgcgggcccagtatccctatacaacggaagaacttcgcgcaagcttacaggcagcggacattccctttcatccaggcaagctcgtacctgaggcctgcgtattggagcggggggtggacgttgccaggcaagaaggattccgggccggccgttatactgtgcaaagcgaaagcgccatgctggtatgcaaactgctggcgccccaaaaggggatgcggctgctggatgcttgcgccgcaccaggaggcaagaccgcgtacctatcccatttgctggaaggggaagggcatatagaagcctgggagctgcatccccatcgaagtgcgctcatccaaaagaccctggagcggcttcatgtggaaggggttacggtacagatacgggacgccgcccaacaggacccggcaaaagctgaggcctttgacgctgttttggtggacgccccctgttccggcctgggggtattcggcaagccggatgcccggtatgcaaaaagcgatgccctcatcggcgctttggccggcatacaaaagcagattctggatgcctgcgccggttatgtccggccgggcgggaccttagtatacgcaacttgtaccatatcccgccgggaaaatgaaggccagatccgttcctttttggcgaaccatcgggagtttcagccgggaaatatggacgcgttgccaacatcgctacagaaacgggcaaaagatgggatggtacagcttttcccccatctggatcattcggagggattttttatggcaaggctggtgaaggccaatggatga

SEQ ID NO: 2113 - DNA, 1188 bp, Unknown
  Artificiall/Consensus sequence
atgatgaaatttaatgaaaagaacggagggtttgccatgcggcaatggatttccaaacgacaggcggccatcggccccaacaccatgatggcattgtttgccaacgcaaaaaagtatccagacgtgatcaacctgtccatcggggatccggatatacccaccccccaggccattttggacgccatgtaccaggatagttgcaaagggcacaccaagtataccccctccaagggggatccggagctgatccaggcggtttgcgatttttacaaagaggagcacggcctggcgttgggaccggaatggatcaccatcaccccggcggcctgttcaggcatgtatcaggtgatgcaggcggtgctggacccgggggatgaggtattgatcttttccccgtatttttcgccctacgcctcccagacccaggcggcgggcggggtaccggtgctggtgccctgtctggcggaggaggggttccagcctaacgcccagcgggcggcggcctatgtgacccccaaaaccaaggccatgatcgtcaacacccccaacaaccccaccggcgcctgctacacccgggagaccctggaagggctggcggcgctggccaaggcggcggacctattggtgattgcggacgacatctatacggacctgtgcttcacctcggaattcctccccatcatgaccctgccggggatgcaggaacgcacggtgaccttgggctcctgcagcaagaacttcgtgatgaccggcatgcgcatcggctgggtggccgcgcccccggaggtggcggaaggggtgcgctacgtgggggaaaatatcatctattgcgccccctctcccggccagcgagcggccctttacgccctacgccatcgggcggaactgcggccgctggtggggccggtgttccgggagcgggtatattatgcccgggaccggatccggcagctgccctttatgaccgattgcccggcccaagggagcttttatgtgttccccggcatcgggcccacgggattgagcagcatggaagcctgccaggtattcttggatgaagcccatgtgctcatgctgccgggctccgtgttcggccaggcgggggagggctatatgcgcatcgcctgcaccctggggctggatcagctgggggaggcctttgaccggctggaaaagctgtccttctag

SEQ ID NO: 2114 - DNA, 1227 bp, Unknown
  Artificiall/Consensus sequence
atgaagtccttgtggaggaccatagcatatgcggttgccggcgcgctgatcgtggcgttgctgtcgtctgctgccacggtgctggtgatgaaccggcaggcggaggatattattaccatgacggcggaggaatatgtggacatcagcaatctgttggccctcaacgagctggcggaggatatggagcagatggcctacggcggcgcgcccagccgggatatattgttccagggcgcggcccagggcatggtggataccttggaggacccctatgccaaatactataccgcagaggaatacgaagcgtatctggcctccatcaatggggagtattttggcattggcctgctgatcggccagccggatgaaaccggatgtatggtattggaggtatatgaaggcggccctggggaagcggcaggcattcaggcaggggataggattactgccgtcaatggggagccggtaggcggcctttccctagaggaggtcagcgccaagatcaacggcccatccggccaatcggagctgactttgcaacggggagaagagaccctgaccatccaggtcaccggggatacggtgaatataaaacgggtaagcagcgcattattcaatgaacggacgggatatattaagatcgacatgttctccggcagctgcgcggatgagtttacggaggccctcaaggatttaaagagccggaacatgcgctccctggtgatcgaccttcggaacaatccgggcggctccctggatgaggtggtaaagatctgcagcgccattttagaaaaagggcagatcatcgtcagcgtgggggaagaagggaacccggataacgaggtatataaggcgtcggggagctccgttggggtacctctggccattttggtcaacgagcattccgcctctgccagcgagatcatggctggggccgtgcaggataaccaggctggggtcattgtgggaaccaagacctttggcaagggagtggtgcaaaccaccatccgggtggaaaaaagcggcggttggctgaagctgaccacggacgcatacttcacccccaatggcagaaacatccacggagaaggcatcaccccggacatccagtgcgacctgccggattcccttaaaggccaggccctctccaccgtggaccaatccgaggatgctcagctgtgggcggccctggactatgtgcgggaacaggcggacgctggagaatga

SEQ ID NO: 2115 - DNA, 1164 bp, Unknown
  Artificiall/Consensus sequence
atgaacaaggggggtatttttatgggaaaacgcttgcttgccgccgcgcttgccatgttgtggctactgccgggcaaaatggcctgggcagatggggaagcggacctggagcttgtcggcgccaaagcggcggtgctgatggagcagggaagcggccaggtggtatatggggtccagggggatgaaaagctggaagtaggcggcctttctcgcttgcctgcgctattggcggtatgcgaagggatcgacgaaggcctattgggattggatatgacggtgaccataagccatgcggcggcggacatccatggcccaactgcttttttatccccaggggaggtcatagatgcggggtccctgctcaaggccggcatcatgattaccgccggggacgccatctatgccctgggggaagcggtgttcggcacggaggaagcttgcctaacgagaatccaggagcggctgctgggcctaaacattcaggcggaatacagggacataatggggacgggggtcaagctatcggcgcaggatctggccaccctaggaagggcgctgatggcaagcccgtcctttaccagctatagcggcctttttcttgatgagatcacccatccggacggcagggagacccagcttgccagctccaaccggttgatcaaatccatgcccggctgtaacggcgtggctaccggctcctccaatacggcgggatattgcggcgtgttcagcgtcaagcgcaacggggcgacctggctttgcgctataatcggcgcgccggattccggcgcccggtcatctgcggccaccacccttttggagcacggctttgcagcgtatgaggtaaaaactttagctcgggcggaatccgttttggtggatgcggtaccggtgcagggagcaaagggaaactgcgtggccttggtggcggctagcgacgccatactgctgttgccaaaaggtgtagatttcgagacgcaataccatttgccggaaatcctaaatgcccctgtctccagccaagaggctgtgggtagggtgacatatgtggatggcgacggggaggttctgtgccaggtcgacctattgccggcggaggatattgagcaggcccaggtgctggattatacggccatgctgctgcaaagatgggtgcatggctag

SEQ ID NO: 2116 - DNA, 1374 bp, Unknown
  Artificiall/Consensus sequence
atggatacgaatgtgaatgactggaaagaaaaacgtcgggcaaaggaaagccgggccagcttacttcggcggctgcgcacgcctgtattatgcgtggcatccataggcgcggtgactttccttgggattcctttgctgtttaacgtaattggccttacccctacggtggtggagatccccgaggctacgcccttgcctgagacgcccttggaaccggtggccgccctgtccgcgccagcagcggaaatgcaggctggggatagcgaagtccgttcccaagacgccggcagccagtaccgcaccctgcgggaaggggatacagatcccatggtcatggatatccagatccggctgatggagctggaatacttggatggcgaccagcccacggagctttttggcgagcagacggcggaagccatcaagcggttccagcgaatccacaatatgaccgagaccggcgttgcagacgagctgacccagtccatcctattttcccaagaggcggccacctatcatttggaggccggggattcgggcaacgatgtaaagcgcctgcaaaaccagctgtatgacctgggctattatggggaaaatggggaaaagcgcaacggatactttggcaccgctacccaggaagccctgatcgccttccagaccaagaacaagctggccaccaccggcatcgaggatcagcagacccgggatgtgctgtattcctccgacgccctgccaaaggtggaccccacgcctacgccgtcccccacgccgaagcccaccaagactcccaagccggaagccaccaaggcccccgtcaagacggagaaaccgcaagaggacgagcctgtcactgagcctggcgagatcccaccggagctttggatcccccaggagacggaggcgcctgtctctacgccggattccggcggcagttccggcgggaattggtccggttcggatattgcgggagacggcattccctctgcaggttccggtgtggaggccatgatcgccacggcggagagccggctgggctgcccctatgtatatgcggatgaaggccccaattccttcgactgctcgggcctggtatattattgcctgcgctccgcgggggtgcaggtgagccgtatgtcttccaaaaaccttgcccgggtggattcctggcagaccattcccgaccagggcagcctgatccggggcgacctggtattcttcaccaatagcgtgggcgaatcggatatcggccatgtgggcatctatatggggagcggcaagtatatccacgcctcttccagcgcagggaaagttatcatcagcagctggtcggattgggcgtcggaaaacttccagtgggccaagcgggtattctaa

SEQ ID NO: 2117 - DNA, 1722 bp, Unknown
  Artificiall/Consensus sequence
atgagaaaacaacgtaagggcggctgggccgccatcaaagaaatattcatcaattggggacggcggatcgccatttcccggcggcggttttcccggcggggcggcataggcggctttgtttcccgtacgggttcaggccttgcaaggggggaattgcgttctatcgccacggtttgcatcgcggtgctgatattgggcggctgcgtttggggcggtatcgccctggccggcaagaaggcgccggcggaagcgggcgccagcaaggccgccactgccgccctacgcaccagcggcaccgccttggcagcggaaagcgacgtggtctccttggaggaagatatggcccgcatgcaagcgggcgctacccccgcccccactgccacgcccatacccacgcctaccccgctattattttccaagggctatgaaggcccagaggtagcgaagatccaggcccggttgatggagctaggctatatggacaacgacgtgcccacggaaaaattcggctccatcaccaaggaagcagtggagctgttccagcggagccacggtctgaccattgacggatatgtgggccagcaaacctacgacctgctcatgagcgaccaagcgaaaaaatacatggtgagcattggcgtatccggtacggatgtggagcagctgcaaagccggttggtggaattagattatatgaaaaagaccaccggttattttggcgaagagaccgaagcagccatccgggatttccaggagcgtaaccacctgaccgtggacggtaaagtgggcgaagagacccgtgaaatgctctatagcgaagacgccattcccaaatccctttcctatggggaaaagagcgacgatgtgcttaagtatcaggaacggctgtacaagctgggatatttgaccacagagccggacggcacctttggcaaggatacggtggcggccaccaagctattccagcagatcaacggcttgatcgtggacggacacatcggtccctccacccgcaagctgcttatgagttccgatgccgaggccaatgccttgaccctgggcatgagcggcgatacggtgcaaaaggtccaatccaagctccgggagctggggtatttgggggccaaggccaccggctattatggctcggataccgaagaagctgtcaaagccttccaaaagcgtaacgacctgagcgtagatggaaaagcgggccgctataccatccaagccctgttctccggcgatgccaaagctgcggcttcggattatgtgccggtggaaggctccacttcctcctcggatagcgacgactccagctcttcctccagttcctcctccggctctacctccggcagcggcagcctcaacgcctttatctccgccgccaagagcaagctgggttcccgctatgtgcggggcggcaagggcccggataccttcgactgctccggcttcgtctactggtgcctacgccaggcaggggtcagccagaagtatttgaccagcagcggctggcgtagcgtttccaactaccagaaggtacgctccctcaccgacctgaagatgggcgatgtgatcgtgttcgacggccatgtggccattgccatgggtgacggcaccatgatcgacgcttccagcagcgagggcaaggtggttcaccgctcctgtctgggagattggagctacgataacttcatctgcgcttggcgtatcttctaa

SEQ ID NO: 2118 - DNA, 1281 bp, Unknown
  Artificiall/Consensus sequence
ttgaaattggaactcggatatatccatatccacgacattcagctggcagcagaatccaaagttgagaacggcgttctgtacgttgacgccgaagcggtgaagaagcttgtattggaagacgagcagatcgcatccgttgaagtcgacgtggcgcgccctggcgaaaacgtacggattacgcctgtaaaagacgtgatcgaaccccgagtaaaggtagaaggccctggcggcatgttccccggcgtgatctccaaggtggagaccgtgggcagcggcaagacccatgtgctcaagggcgcggcggtggttaccaccggcaagatcgtgggcttccaggaaggcataatcgatatgagcggcattggcgcccagtatacgcccttctccaagaccaacaacctggtgctggtgatccagcctgtggaaggccttaagcagcacgaccatgagcatgcggtgcgtatggctggcctgaaaaccgccgtgtacatcggcgagctggcccgcaacctcacccctgacgagaccgaaacctttgagaccctgccccttaaggaaggcatggacaagtatccggatctgccccgggttggctatgtgcagatgctgcagagccagggcttgctccatgatacctacgtatatggcgtagacgccaagaagacactatccactatcatctatcccaccgaggtcatggatggcgccatcatcagcggcaactgcgtgtctgcctgcgataagaaccccacctatgtccatcagaacaaccccatcgtccatgagctctttgcccggcacggcaaggacatcaacttcgccgccatggtcatcaccaacgagaacgtatacctggcggataaagagcgttcctccaactgggctgccaagctgtgcgagttcctgtgcctggatgcagtcatcatcaccgaggagggcttcggcaaccccgataccgacctgatcatgaactgccgcaagatcagcgaaaagggcattaagaccgttatcgttactgacgaatacgctggccgtgacggttcctcccagtccctggcagacgcccatgcttccgcggatgctttggtcactggcggcaatgccaaccaggtcatcaccctgcccaagatggataaggtcatcggcaccgaagagtacgttggcattatagccggcggctgggcggataacaagcacgaggatggcaccatcgacgtggagatccaggtcatcaccggcgccaccagcgaggtaggcttcaactacctgagcgctcgctaa

SEQ ID NO: 2119 - DNA, 585 bp, Unknown
  Artificiall/Consensus sequence
atgaaggaatggaaggcagttactgaacctctgggccgtttggctgcccggatgaagggggataagcggatcgaactggcggtgtatgtgttgctggccgccctggggatcttggtgtacacagcatcctgcgggaaagaggcggaggaaccagcccaggcgggcatggtggaagccccagcagaaaccgccgtggaagaacggctggaggagacattgtcctgcatacggggggcgggaaaggtacaggtgatgatcacctacgacaccggcgcccaggtggtgccggctatgcgtacagaggtacaaagcagtacccaagaaagcgcaggcacagagaccgccaccgtcaacgaaaaccgtacggaggtatccgcccccgccaccctcaatgacgaggcgttggtcctgacggaaaaggccccggcggtacggggggtgatcgtgatcgcggaaggggcggcggatatcgccgtaaagctgcggctacaaagcgcagtacagacggtactggggatcgatccaggatgtatcgaggtgtttgagatgagccggccggcttatgaagaaggaggagaaggatga

SEQ ID NO: 2120 - DNA, 2004 bp, Unknown
  Artificiall/Consensus sequence
atgaaaaaacgatttaaaaccattggcatgaagctagcggtactggtgaccctgttttcgctgatactctgtatcgccatcggggtatttagctatctggtatcctggcgggagtatacggatttttattcccagaaagcccaggagaccgctgctttagccgcaacgtttgtggatggagataaaatcggtacctacctggaaaccggggaaatcgacgactattacgaatccctacgtaccatattcaacaatatcaagcaggagcaaaacgtcctatacctatatatcttcaagccggatgaaaccagctttacatacattttggaagcgcagatccccacggatgatccggaaaacatttcgcaaatgggggatatctacgaataccaggaagcagagctggaaaacctgctgccggacgtggaggcaaagaaggcttccacggaaaagctcattgcatataacccagcctatggggcgggggttatggcctgggcgcctgtgttggatagccaggggaatgtggcggcctatgtggaggcggacctttccctgtacatggtgcttagcaaactgcgctcatacgtactcaatctgatcctaatctgctgtatcatcattttagcaggcggcgtagtgctcatcgccatgaaccggcgcatggtcgcccagcctatggcacagcttacccggaacgtgctggagtttgccagcggggaaagcctggcttatcccagcgatgcgatccagaccggggatgaaatgcaatccctgtcagaggcctttggcaagatggccaaggacattgataactataccaagaacctggcggcggtggcggcggataaggagcggatcgccacggagctaagccttgctacggacattcagatctccctgttgccccgtgcattccccgccttccccaaccgggatgagttcgatatctatgcccagctacagcctgcaaaagtggtaggcggagacttttatgatttcttcctgatcgaccagaaccatctgggggtggtaacaggcggcgtatccggcaaaggaattccggctgcgctgttcatggtggtggcaaagaccattatcaagaaccagctgatgacgggtatggacattgaagaagccatgagcgtgatcaatacccggctgtttgagagcaagacccccggggtggtagtgcaggcatttgtgggcgcattggatacccggaacgggaatttcagctatgtaaatgcaggccaggcagcgcctttgtatatgcgaaaagaccgcccgtttgcctatttggaagggcaacaaatgggggccttggccgaaacggagaacgtgcgttaccggaagatggaacttaccttccggcagggggataggctggtgctatgctccaatggagtatttgaggcccagaacccccaggggcaggaatttgggcgagagaaactgcgcaagaaccttaatgcccggcggagcaagctaaacgatctcaagacgttggtaaacgtaatttgcgacgatgtatccgcttacgaggaagcgccatatcatcaggatgacgtgacggttttggcgttggcctatcataagggagatcgggcccgggccgaaatatccgtgcgggccagagaggatggcttcccccaggcccaacggttcctacgccggcagctggaggaaaatggtttaggcggcgccttctatgcgaaaatgagcgtggccaccgaggaggctttctccatggcggtgcgcagcacaggcggccgtggtgagatcgtggttcgctgtgcggtggatgaaacccccgacggccagcaggtcacggtgacgatcctatacgccggcccgcaggcaaatcccctattggaacagaccggcgtacagcaagatgccctagcttttatccagcgcagcatggataccgtgtcctatcggtaccaggacggccgaaatgagattagcttgcaaaaaggagtgagcgttgagcgaatatag

SEQ ID NO: 2121 - DNA, 2394 bp, Unknown
  Artificiall/Consensus sequence
atgacacaaaggatctatgaaaacattcccgtggtggctctgcgggggctggtggtgctgcctggagagctgctgcattttgacgcgggccgggaaaagagcgtgaacgccctacgggaagccatgcggcgggacgacctgatcttcctgagcgcccagcgggacgcccgcaaggcggaaattaccccggaggatattttcgagaccggcaccctttgcaagctccggcagatgctcaccctgcctggggatagcaaccgggtatttgtagaggggttatgccgggcgacggcggtatccattgcggatggggacgcctttatgacggcggatatcgcctgcctggaagacaaggaccatgatccggcggaggcggaagccctgcaccggcggctgagcagcgccctggcggaatacgccaccatgagcacccggatgaattccgacgcattggccagcatagagagcaagaagatcccaggcccctacgcggacgcggtggccaatgcgatcatgcaaaaagcatccgaacgtcagcccttcctggaggagagcgacccggtggagcggatgaagtgggtgctgcggttcatgggtaaggagatcgagatcctgcgggcggaccggcgcatcgccaaggaggtccagacccagctggacaagaaccaaaaggaatattacctaagggagcagatcaaggccatccgcaaggagctgggggacacccaggccacagaggtggaggccatgcgggagcggctggaaaagaaggacatgcccccggagatccgggaaaaggtggagcgggagatcgaacgctatggggatctgccggcgggcagccatgagcagcctccccttcggacctatatcgagtgtatgctggagctgccctggaaggaggagacggaggacaatacggacttggccaacgccagggctgtgctggaggcggaccattacggcctgaccaaggtaaaggagcgaatcctggaatatttggctgtggccaaccttacaggcaaggtgaacggccagatcctatgctttgtgggaccgccaggggtggggaaaacctcggtgagcgcctccatcgcccgggcattgggccgcaagtttgtgcggatgagcctgggaggtatccgggatgaggcggagatccggggccaccggcgcacctatatcggggccatgcccggccgggtgatcagcgccatgcgccaggcgggcaccatcaatccagtgatcctctttgacgagatcgacaagctggccgccgattgccacggggacccctccgcagccatgctggaggtgctggacagcgcccagaatttcgccttccgggatcatttcctggagaccccttacgacctttccaaggtgtttttcatcaccaccgccaacgacgcctccgccatcccagcccccctgctggaccggatggaggtgatcgaggtgcccagctacctggatacggagaaggtgcagatcgccaagggatatctcttgcccaagcagatggaaaagcatgggctcaagcggagcatgctcttcctgccggaggaactgctgcccaagatcatacgggaatacaccgcggaagcgggggtgcggcagctggagcggaccttgggggccatttgtcgcaaggcggcctgcgagatcggcgaaggcaagcagcggatccgcatgacccgcacccgcctggtggaatacctgggccaacccaagcgccgggatcgggccgctgcccggccggatgcggtgggggtggccaacggcttagcctggaccagcgtaggcggcgagctgctggaggtggaggtggcggccatgcccggcagcggcaaggtggaaatgaccggccggttgggggatgtgatgcaggaaagcgtccgggcagccatgacctttgtgcgggcccatgggcatatgctgggcattgggaatacggtgttcaaggatatggacatccatgtccacgtgcccgaaggggcggtgccaaaggacggccccagcgccggcatcaccatggccacggccattgccagcgccctatccggcatcccggtgaaggccgacctggccatgaccggcgagatcagcctgcggggcaatgtattggccatcggcggcctaagggaaaagctgctggcagccgtgcgcaacggcattacccaggtggtgatccccttggagaacaaaggggatctggacgacgtgccccaggaggtaaaggacgccctgcacattatctatgtgaaaaacgccatggaggtgctccatgcggcgctaacccatatgccggcgccaaaggatagctataccccggtggccagccatccggctgctgctcaagggagcatggtgatgcgggatacggaccgataa

SEQ ID NO: 2122 - DNA, 1224 bp, Unknown
  Artificiall/Consensus sequence
cacatcccattagaaggaaaggagaagcgtatgaccaataccaccatcaataccctacagaccacccaactcaacaaaaccttttacgaccgtcagctcctggagagcgcccgcacccgctttgtccacgccaagtttggccagatgcgccccatcccccgcaatagcggcaagcgggtggaattccgccgctggaatctctttgatgccaacgccgccatgaaagccctggaggaaggcgtcacccccagcggccagtccctctcccagagcaatgtggaagccctggtcagccagtatggcgcctatgtggaggtttccgacctgctggatatgaccggctacgaccaggtcatcaccgagagcgcagagctgctgggcgagcagctgggcaccgtggtagagtgggtcacccgggacgccatgaacgccggcaacaacgtgcagcgggccggcggcaagaccacccgcgccgccctgactgccgatgacaaactcaccgtggatgagatccgcaaggcggtgcgtaccctcaagcgggccaaggcccgtcccttctgcgaggatgagcgcaagccccactttatctgcatctgctccccggacgccacctatgacctgcaaaacgacgccctctggcaggacgtatccaagtactccaacgccgaagccatctacagcggggagatcggccggctgttcggggtggtgttcgtggaatccaccgaggccaaggtgttccgccagagcgtgtggaataaggtttcggaagctacctcctccagcgcttccttcgtgctgaagaacgcccccaccgaagcggaggccgcctacctttcccgggaagataaccccatccgcatcggggaagccagctataccatcgccggcttcgacccctcctccaacaccgtcaccctcaaggagaccgcctccctggctgcggacgccatcgtctacagcgaggacgcaggcgccttggatccggagaccaaaaccgccatggacgtccactccaccctgatcttcggcaaggacgcctatggagtggtggatgtggcgggcagcggcgcccttcagatcatcatcaagccccatggcagcgccggtacccaggaccccctggatcagcgggccaccgtgggcgccaaggtggctgcctacaccgcggtcatcctcaacgagctgtggttgctgcggatcgagcacgcggtaagcgcctga

SEQ ID NO: 2123 - DNA, 1839 bp, Unknown
  Artificiall/Consensus sequence
atgaatcaggtgatccaagaaaaattaaaattgctgcccgatgcgccgggggtatacaggatgtatgacgccgccggacaggtgatctatgtgggtaaggcggtcaacctgaaaaaccgggtgcgccagtattttcaaaatggccctaagcccccaaaggtggcggccatggtggcacacatccaggattttgagtatatcctcaccgccaatgagaccgaggcgttgaccctggaaagcaacctgatcaaatccctacaaccccgctacaatgtgctgctgaaggacgataagcattttccctatgtgcggctggacatccggcaggatttccctcgctttgaggtggtgcgcaagatccaaaaggacggggcccgctattttgggccgtatctgtccgcgctaagcctgcgggatgccctgaatatgattcgggattcctttcccgtgcggcattgtaaaaaggatatccataaggccatcgcccggggggaacggccctgcctaatgtatcatctagggaaatgctgcgccccctgttccggcaaggtgagccgggcggaataccatgccctgctggagagcgtatgccgctttctggaagggcatacccagccgatcatcgaaaagctcacccaggacatggtccgggcgtcggaagccatggaatttgaacgggcggcccagctccgggatcagatccaggcggtacgcagcttgggggaaaagcagcaggccatttccaccgccggggccatgcgagacgtgttcgccctggcccgggacgatttggatgcggtggtatttgccctgttcgtgcggggagggaagatcgtaggcaccgagcggctgcgcatggcatgcggacaggagagcgggccggaggtgatgggggaattcctcaaacagtattatgcggaaggggtgcccattcccccggagatcgtggtgcacgagctgcctgaggatgcggcggccatagaggcatggcttacggaaaagcggggccataaagcggcgttgatttgtccccagcggggagaaaagcgcaagcaggcggacatggcctatcaaaacggcatggatgccatcgaaaaagcccgggaattggagcaccgggcctgggaaaagggagaaggcgccctggcggccctgtgcggggccatagggctggaggtgctgcccgtgcggatggagtgctacgacaactcccacatccagggccgggatacggtatctggcatggtggtgttccgtaacggccagcctgcgccaaaggaataccgccgcttccgcatcaaggaggaagcgggaggcaacgacctggtggccatggaggaggtattgacccgccggttccaacgggcccaggatggagacgaaaagtttggggagctgccggacctggtggtggtggacggcggcgcggagcagctgaaggtggccctggcggtgctggagcggtttggcctggatattccggccatcggcctggcggagcgcagcgagaccatcctgctgccggggaacccggaaccgttggtattatccaggcgggacccggccctgcatctgttgcagcggatccgggacgaggcccaccggtttgccatcacctatcaccggagcctaagggggaagaatgccttgatgagccagctggatcagatccaaggcatcggcccaaagcgcaagcgggccctgttcaaccacttcctgaccctggacgccatcaaacaggcggacgtggagaccctgcgccaggcgccagggatgaacctgccggcggcggagcaggtataccggcatttccatatggaaaatttttcggatgcgtga

SEQ ID NO: 2124 - DNA, 2205 bp, Unknown
  Artificiall/Consensus sequence
atggacttatccgttttgaataaagagcagcgccaggcagtggaatgcttggaaggtcccttgctggtattggcgggagcaggcagcgggaaaacccgggtgttgacgtatcggatcgccaacctgatggaacatggggtcaagccttggaatattttggcccttacctttaccaataaggcggcaaaggaaatgcaggagcgcaccagcgctttggtggatgcggacccgcgggatatgtggatcaccacctttcacgcctgctgcgtccgcatccttcgaagcgatatccaacgcttggggcgcgagcggaacttcgtcatatacgatacggatgatcaaatgtccctgatcggtagcgtattaaaaaatttgggcattagcgataaagacctgccaaaacgagatctaaaggactggttttccgaggcgaaaaatagatccctggagccggaaaaatatatcgcggatcatcctggattggaccaggcggtgtataaggtgtttaaaggctatcagcgcgggctgctggaggccaatgcgttggattttgacgacctattatgcatgacgctgcaactgtttgaggcatttcccgacgtactggaaaaatatcgcaaccggttccagtatgtgctggtggatgaataccaggataccaacctgccccaatataagctgatccagctgctttgtaagacccatcgcaatatctgtgtcgtgggcgatgacgatcagagcatctatggctggcgaggtgcggatatccgtaacattctggaatttgaaaaagactttgaaggcgctaaggtgattcggttggagcagaattaccgctccacgtcgatcattttggatgcggccaacgcggtaattggccacaataccgggcggaaatctaagcgcctttggacggaaaaaaccggcggggaacaaatcgaactgtacacagccgccaacgagcgagacgaatccgcatttctatgtaaaaagatcctggagggggttcgcgccggcaggcattatcgggacttcgccgtactctaccggatgaacgcccaaagccgggtgttggaatccaccctgatcaattatggcattcccaataaagtcctgggaggccagcggttctatgaacggcgggaaatcaaggacattatggcctatctgcggttgatctataatccggcggataatatggccctgcgccgcatcatcaatgtgccaaaacgggccatcggtgaggcgaccattggcgagctgtctgcagtggcggagcaacgggggacatatatgcttgcggtggctatggatgggcagggcctttccgatcgggtagcccaaaagctgcaaccattttcagagacgatggccgcctttatcgccctatgcgagaccatgcccctttccgcatttaccgagcagatgatcggcgccctggagtatgaagccttccttcgcgcggaagacaaaaagggagacctggaaaaccggatggacaacttgcgagagctaatcggcaatatacgggaagtggaacgggatgtgccggaaggggaaagcgcattgccggcttttttggaaaacgtggccttggtatccgatgtggatggattggatggcaatgcggatgccgttaacttaatgaccttgcatagcgccaaggggttggaattcccggtggtatttctgtgcggtatggaggaaaatatcttccctaccgcccgggccagaaatgctttgaaccagtctgctttggaagaagaaaggcgcctttgctatgttggcatgaccagggcagaagagaagttatatttgatccatgctaagcagcggatgctttttggagactatgcattcaataaaccttctcgttttttggaggaagtcccagctgccctcttgcagcaggaccggccgccccttcccccgagagaacaggcaaagcctagccaccatatacagacgccacggcccagttatgcccctgggtttggggtacggcctgcccccatggtagcgcctgctaagccccagcccaaaacatttcagctgcatcaacgggtcaaacatgcaaaatttggggaaggtaccatattagaaatgacggggagcggcaacgctatgactgtgaccatcgactttgacgacgcgggaataaaaaagtttgccgcagcttatgcgcccattacgccggcggattga

SEQ ID NO: 2125 - DNA, 1902 bp, Unknown
  Artificiall/Consensus sequence
atgaacaatgtgatcatcggcacggcgggccatgtggaccatgggaaaacctgcctgatcaacgccttgaccggcatcgatacggaccggttggaggaggaaaagcgccgaggcatcaccatcgaactggggtttgcctatttggatctaccggatggcagcaaggcggggatcatcgacgtgccgggccatgagaaattcatccgcaacatgctggcgggggcgggcggcatcgacctggccctactggtggtggcggcggacgagggggtcatgccccagacgaaggaacatttgggcatcctgtcccttttggatatccagcggggctgcgtggccctgaccaagatcgatatggtggacgcggactggctggagctggtcaccgaggatgtgcgggaacaactgaagggcacctgcttggaaggagcgcccatcctgccggtctcctcctatacgggggaggggatccaggccctaagggagaccctgtttgagatggtggccaccacccagggcaagcatacggagcggcccttccggctgccggcggaccgggtattttccatgcaggggtttgggacggtggccaccggcaccctgatcgaaggccggctccatgccggcgaagaggtgatgatctatcccgccggccggctggccaaggccaggggcctgcaagtccattcccagagcgtagaggaggcccaggcgggccagcgggtggctgtaaacctccagggggtgaagcgggaagaaatggagcggggagacgtattggccaagcccggcagcttgcaggtcaccatgatggtggatgtgcggctgcggatgctgccggaggtggagcgcaccatcaagagcggcagccggctgcatttttactgcggcgcaaaggagctcttgtgcaaggcggtgctgctggggggcgtggaggagctgctccccggggaaagctgctatgcccagctccgctttgaggaggccatcgctttgaaggcgggggaccattttgtggtgcggttttattcccccatcgagaccatcggcggcggccagatcctggaccccaagcctcataagcataagcagggggatatggaagtccctcaagtgttggatatgctgcaaaagggggatgaaaaaacccaagtggaagccttgctccgggaaaatagtccccggtacgtgcccctggcccagctgcggctccagaccaacctgaacgaggaagcctttacagcctgcacccaggcattggaggcggaggggaagctggtgaccgtgacggataagctgaagatccatacggggtattatcaggcactgaagcaaaaggcccaaggaatgctggaagcctttcataaggaaaaccccttgaaggccggcatgcgctgggaaaccttgcgggcggccctttttccccggctggagccgggggcgggggataagctattggagcggatgacgcaagacggcaccttggccgtggcgggccgctgcctggccctgcctaccttccaggtagcgtttaccccggagcaggaagccttaaaggaccggctctaccaggcctgcgcccaggaaccctttgccccgccggagcgcagcgggttgaccaaggagatgggccgggccaaggatttccaaaaggtgctggattacctgacagatgaaggggagctggtccccttggaaccggatctgctctttacccgcaaggcggtggaggaggcggaggggattttccggcggctggcggaggcggacggcacggttaccctggcccagttccgggatgggatcggcacctcccgcaaatacgccatggcgttgctggaatattgggacgtgactggtttgaccaaaaaggaaggggacgcccggcggctgcggcgataa

SEQ ID NO: 2126 - DNA, 1386 bp, Unknown
  Artificiall/Consensus sequence
atggaacaaattcaggaccgcagtgaattcctcgcttcggaaccgattgggagattgttgctaaggctggcggtccccgcagtaattgcccaactggtcaacgtcctgtataacatcatcgatcgggtctatatcgggcatatccccggcattggcaagttggccttaactggcgtaggcgtatgcctgcccatcatcttggtgatctccgcctttgcagcgctggtggccatggggggcgccccccaggccagcattcagatggggaagcgggacaacgaaaaggctgaggagatcctgggcaactgtacggcgctgatgcttctattcagcgttgtgctgatggcggtgatcttcctctggtgcaggcccctgctccttatgtttggcgccagtgaaaacaccatccaatatgcggaaccctatatgcgcatctatacctggggcaccccctttgtgcagctggccctggggcttaacgccttcatcagcgcccagggctttacccgcgccagcatgaactccgtgatcatcggcgcgctagccaatattatcctagaccccatcttcatcttcctgctggatatggggccccaaggcgctgccctggccacggtgatctcccaggccatctccgccctttggatggtgcggttccttaccagcgagcatacggtgctgcatatccggcggcaatacctgcggatcgattggtccatcattgccccttgcttagccctgggcctttctccctttattatgcaggtgacggaaagcgccatttccgtatgctttaattcctccctgctgcgctatgggggagatactgccgtaggcgccatgaccatcctaaacagcctaatgatgttctccatgatgccccttcggggcttgacccagggggcccagcctatcaccagctataattacggcgctaaaaatgcagcccgggtcaaagcctccttttccgtattgctgaaagcgtgcctagggtattccctgctctttgggatcagcatcctagccttcccagagctttttgccaagatgtttaccccggacccggaactgatcgcctataccgcctgggcggggaggatctactttgccgccaccgccatctttggcatccagttgtcttgccagcaaaccctggtttccatcggcaatgctaagaccagcaccttcctagccctgttccgcaaggtattggtgctgatccccctgatctatatcctgccggctttcttccaggacaaggccatggccgtatacctggcggagcctgtagcggattttttggccgtgtccctaaccagcatcctgtttgccaggaactttaaacgggcgctgaacgaaatggcccccaaccctagggccctgtaa

SEQ ID NO: 2127 - DNA, 2319 bp, Unknown
  Artificiall/Consensus sequence
atgaaacacaccaagcagatccttgcgctgcttctggctgtcgttctctgcattggcctgcttgccggctgcgccaagactgagacgaagcccgagaccgataccagcgcggacacgaccactccggaaacccccgaaactccggacgccaccgagactccggccgcagaagccaacgctgacggtaccatcgtcatcgctgagaccggcttcgaaggcaagttcagcccgttcttcgcagcttccgctcccgaccaggacgcgcacgctctgacgcagatcgctctgctgggcgctgaccgccgcggcgagatggtcctcaacggcatcgaaggcgagacccgcgagtacaacggcaatgactacacctactatggcccggccgactgcgttgtcaccgagaacgaagacggcactgttacctatgccatcaccctgcgtgacgacatcaccttctccgacggcaccccgatgaccatcgacgacgtcatcttcaacatgtacgtctacatggacccgacctatgacggctccactacgttctactccgtgccgatcgtcggcatcgacgagtaccgcggcggtatggatccccgtgtcaacgtcatcctcgctgctggtcccgacggctacaccgccaacgacctctacaccgaggagcagtacaatgctttctgggctgcgttccagactgcgggtgaaaagttcgcacagtccattgcggactacgttatggaaaactacggcgcggaagacttcgcgactgccgttgccatgtggggctatgaagctaccgacgccgctgacctgtggaacaagatcgtcgagacctacggctacgacatctccgacgacggcatcaacaaggaagttgctaccacttccatctccgacttcctcgctgaggagctcggcgacagctgggctgactacaccatcggtgtcaagaccggcgaatccgctgaccatgtcgaaggcattgtcaagaccggcgactacagcatgaccctgaccacttccgagctgtccaccactgcgatctatcagctccagatggagattgcgccgctgcactactacggtgatgtgagcctgttcgactacgacaacaactccttcggcttcccgaagggcgacctcagcaagatccgcgaggtcaccggcgctccgatgggtgctggcccgtacatcttcaacaactactctgacggcgtgttctatgtcgacgccaacccgaactactatctgggcgctccgaagaacggccacctcagcctgaaggaaacccaggaagctgacaagatcaccggcgtgcagtccggcgctctcgacatctccgacccgtccttctccctcgaagttgtcagccagatcgctgatatcaacggcgccgaaggcgacgacggccccgtcatcaccacccgtctcatggactaccgcggctatggctacgtggctctggcagccggcaacgtcaaggtcggcgacgaccccgcttccgaggcttccagggacctgcgtaaggccatcatgaccgtcatctccgcttaccgcgacgaaggcatcaactcctactacggtgagaccgcttccgtcatcaactacccgatctccaacacgtcctgggctgctccgcaggtcaccgacgacggctatcagatcgcttactccaccgacgtggaaggcaatgcaatctacactgccgacatgtccaccgagagcaagtatgaagctgctctgaacgctgctctgggctacttcgaggctgccggctacaccgtcgaggacggcaaggtcacggctgctccggaaggcgccaagatggaatacgccgtcaacattggcgcttccggcaacggcgaccacccgaccttccagacgctgaccaacgctgctgcggctctcaagaccatcggcttcacgctgaccgtcaacgatatggccaacgcttccgacctgttcgcgtcctatcagtccggcgaggctgagggctgggttgctgcatggcagtccaccaacgacccggatatgtaccagctgtatcattccaacggctccaccaactactacgagatcaacgacgctgatctggacgagctgatcatcgctgcccgccagaccaccgatcaggaagcccgtaaggccatgtacaaggaagctatggaaatcatccttgactggggcgtcgagctgccggtctaccagcgctccaacgcgaccatcttctcctccgagcgtctggtcgtcgattccatccccaaggatatgaccccgtactggaccttcttggctgagatcgatcggatccaggtcaagtaa

SEQ ID NO: 2128 - DNA, 1383 bp, Unknown
  Artificiall/Consensus sequence
atggaaaagctctgggccggacgcacagaaaccgaaactgccaagctggcggacgcgttcaactcctccatcgccgtcgatggacggatgtacaaggaggatatcacaggctcgatggcgcacgccgccatgctggccaaatgcggcattctgacacaggcagacgccgatcagatcatcgacggtcttgccggcattctggccgatctgcagtccggcgcgctggcgctcgatccgcaggccgaggatatccacatgtttgtcgaatccgtcctgacccagcgcattggggatgtcggcaaaaagctccacaccgcgcgctcccgcaacgatcaggtcgcgctcgatatccgcatgtatctgaagggcgaatgtgaccgcctgcacgccctgctgctggatgtcattcagtctctgcatgcgcaggccgcgcagcacaaggacaccatcatgcccggctatacacatctgcagcgggcgcagcccatcacgttcggccagcagctgctggcgtatgccatgatgctcatgcgtgactacggccgtatttccgacgcatatgcccgcatggacgcctcgcccatcggctgctgcgcgctggctggtacgacttatccgaccgaccgcgtctgggaagcgcagaagctcggcttctcctctacctgtgaaaacagcctcgacggcgtctccgaccgcgatttctgcgtggagctgatgagcgcctgcgcgctcatcatgatgcacctgtcgcgcctgtccgaggagctgatcctctggtcgagctgggagttccagttcatcgagctggacgacggcttcacgaccggctcttccatcatgccgcagaaaaagaacccggacatggcagagctttgccgcggcaaaacgggccgcgtctacggtgatctgatggcgctgctcaccacgctcaagggcatcccgcttgcctacaacaaggacatgcaggaggataaggaagccgtattcgactgcgtcgacacgacgaagctctgcctgcagatcatggcgccgatgctcgccaccatgcgcgccaagccggaaaacatgctgaaagccgcgcagaagggctttatcaatgcaaccgaccttgccgactatctgaccaagaagggcgttccgttccgcagcgcctacaagctttctggtcagctcgtcgcctactgcatccagcatgacacggtgctggagcagctgccgctggaggtctatcagagccattccgacgtcttcaaagacgatctttacgacgagatctcgctgaaaacctgcgttgcccgccgcatttccgccggcggcacaggacccgcctcggtgcaggcgcagctggagttggtcgaagccttccttgcaaatcatcattaa

SEQ ID NO: 2129 - DNA, 1752 bp, Unknown
  Artificiall/Consensus sequence
atgtgtgaagcatgcaaaaagacattttatatcaccacgccgatctattatccgtcagataagctgcacatcggccacacctactgcaccgttgcgaccgacgccatggcgcgctacaagcgcctgcagggctacgacgtcatgttcctgaccggcacggacgagcatggccagaaaattgaggacaaggccagggccgcgggcgtcacgccgcagcagttcgtcgacaatattgtcgccgggccgaagggcattctcgatctgtggaagctcatgaacatctccaacgaccgctttatccgcacgacggacgattatcatgtggagtccattcagaagatcttccgcaagatgtatgaaaacggcgatatctataagggcgaatacaagggcaaatactgcaccccctgcgagagcttctggaccgagagtcagctgaaggacggcaaatgccccgactgcggcggcgaggtccacgacgcgtcggaggaagcgtatttcttccgtctttccaaatatgccgctcgtgtgcgcgagcttctgacgacgactgacttcctgcagccgaagtcccgcgtcaacgagatggtcaacaacttcatcgatccgggtctggaggatctgtgcgtctcccgcaccagcttcacctggggcgtgccggtcgactttgatccgggccacgtcgtctatgtctgggtcgacgccctgttcaactacaccacggcgctcggcttcatgaacgaaaaatatcacgattacgacaaatactggccggcagatgttcattttgtcggcaaggagatcgtccgcttccattcgatcatctggccggccatgctcatgagcatgggcatgccgcttcccaagcacgtctacggccacggctggcttgtcatggacggcggcaaaatgtccaagtccaagggcaacgtcgtcgatccgtatattctggcggaaaagttcggcgttgatgcgctgcgcttcttcctgctgcgcacgttcccgttcggttccgacggcaacttctccaacgagctgctgatcaacaccatcaatattgatcttgccaacgacctcggcaacctcgtctcccgcacgacggcgatggtcgagaagtattttggcggcacgctgcccgaggcgcgcgaggccggcgaagccgacgaggcgcttatttcgatgctctccggcctgcgtgagcgctatgaggcgcagatggagaaattccagttccagaacgcgctcgacgagatcttcaagtgcatccagcgcgccaacaagtatatcgacgagacaatgccgtggtccctcgccaaggacgaagccaaccgcgcgcggcttgcttccgtcatgtataacctgctcgagtccatccgcatctgcgctacgctcctgctgccgttcatcccggcctcgtgcgaaaagatcttcgcgcagatcggtgcaggcgccgacgtcgtcacatgggacgctgcgaacgtctggggcaagctcccgcagatcgtgaccgtccacaagggcgaggccatcttcccgcgcatcgacgcgcccaaggcgctggccgaactggaggagctggaggccgcgcagaagcgcgccctgctgcccgccgtcgaggtcgagccgcagctggacgaaaaggtcgatttcgacaccttctgcagatccgacctgcgcgccgtcaaggtcaagacctgtgagcgcgtcaagaagtccgacaagctcctgcgcttcacgctcgacgacggcacg

SEQ ID NO: 2130 - DNA, 1278 bp, Unknown
  Artificiall/Consensus sequence
atgagtattgcatatcaggatctgacccctgcacagcttcgcgaggagtacgcggctgtcaaggcgcagtttgatgcgctgaaggcaaaaaatctgaagctcaatatggcccgcggcaagcccggcaaggaacagctggatcttgtctccgatatcctgacagtcctttccaagcccgaggactgcgtctcggacggcattgacgcccgcaactacggcgagctgtccggtcttccggccgccaagaagttctgggccgagatcctcggctgcaagccggaggaatgcttcatcggcggcaacgcgtcgctgacgctcatgtacgatctggtctccaagggctatacccacggcctgcgccactcggaaaagccgtggtgcaagctcgacacggtcaagtggctctgccccgcgccgggctatgaccgccatttcaagatcaccgagtccttcggcttcgaactcatcaccatccccatgaccccgactggcccggatatggacaaggtcgaagcggccgtcaaggacccggctgtcaagggtatgtggtgcgtgccaaagtattcgaaccccgacggaatcgtctattcgggcgagaccatccgccgcatcgcggccatgaagcccgctgcgcccgattttgcgctgatgtgggacaatgcctactgcatccacgagtttgacggcgatttcgtgccgttcgacgatatcctgacgctctgccgcgaggcaggcaacccggatatggtctatgagtttgcctccacgtccaaggtcacgctgcccggcgctggcgtctccgtcatggtcacgagcgaggacaatcaggcgtatttgcagaagctcatcggcatccagaccatctcctatgacaaggtcaacgccctgcgccacgtgcgctatctcaaggataaggcgcacacgctggagctcatgaagaagcacgcggcgatcctgaacccgaagttccagtgcgtcctgcgtcatctggacacgaccatcgcgccgctcggcatcgcgtcgtggcagcggccgaagggcggctatttcgtctcggtcaatacggcccccggtcttgcaaagcgcacactggcactgtgcaaggaggcgggtgtggtcatgaccggcgcgggcgcgacgttcccgtacggccgcgatccgcaggattccaacatccgtatcgctccgtccctgccgcccgtcgaggagctggagcaggcgatggacattttctgcaccagcctgcgtctggccgcgctggagcagaagctgcagtaa

SEQ ID NO: 2131 - DNA, 2127 bp, Unknown
  Artificiall/Consensus sequence
atgagtgactataaacccctgacctgcctgccggtgctcgcgctgcgcgggctggtcgtgttcccgggctgcgtgacgcactttgacgtgggccggagcaaatctgcccgcgctgtggaagaggccatgcgcgccgaccagatgatcttcctcatcgcccagcgcgacgtgcagtgcgacaagccgaaaaaggccgacctctattccatcggcactgtcgcctatgtccgtcaggtcctgcgcctgccgggcgacaatatgcgcattctcgttgagggcagataccgcgcgcagctgaccgaccttatccacgccgagccgtatttctttgcccgcgcgatggagctggacgagccgggctacaacgcggcgctgccgcgcacacaggcgctggtgcggcaggcgcaccagctgtttgagcagttcattgatcttgccgtcaaatccgggcaggagaatctgctgcagggttccgcgtcggatgaggcgggccatcttgccgatttcatcgcgcagaacgcgacgttcggctatgagcagaagcagaagatcctcgagacgctcccgccggtgcagcggctgcttctgtgcgtgcacgccatggccaaggagctggagatcctgcgcctggagggcgagatcagcgatcaggtgcagcagaacgtcaaccagaaccagcgcgactattacctgcgcgagcagatgcacgtgatccgcgaggagctgggcgaggacgacgactccgacgccgacagctaccgcgaaaaaattcaggccctgaagctgccagaggataccgaggaaaagctcctgcgcgaggtctcgcgcttcgcgcgccagcagtccggctccgccgaagcggccgtcctgcgcaactatctcgacaccattctcgagctgccgtggaacaaagagaccaaagagcggctggacgtccgggccgccgcgaagatcctcgacgaggatcattttggccttgagaccgtcaaaaagcgcattctcgagacgctggccgtgcgccagctggcgccggagcttccggggcagattctgtgtctggttggccctccgggcgttggcaagacctcggtcgcgatctccatcgcgcgcgcgctcaaccgcaagctggcgcggctttcgctcggcggtgtgcgcgatgaagcggagatccgcggccaccgtaagacctatatcggcgccatgcccggccgcatcatgacggcgcttattcaggccaagagcaaaaacgccctcctgctgctcgacgagatcgacaagctcggcagcgactataagggcgacccctcgtcggccctgctggaggtgctggattccgcgcaaaattccaccttccgtgaccactatatcgaggtgccgttcgatctctcccactgcatgttcatcacgacggccaacacgacggacaccatcccgcgggcgctgctcgaccggatggaggtcattgagcttggctcgtataccgacgaagagaagctccagatcgtcaagcgccacctgcttcccaagcagctggccaagcacggcctgaagcgcacgcaggtacgcgtctccgacgatgcgatccgtgagatcatctccggctacacgcgcgaatccggcgtccggaacctcgagcgccagatggcagccctctgccgcaagtgcgccatgcgcttcgtctcgccggagccgcccaagcggatcaccgtcaccggcggcaatcttgaggacttcctcggcgtgcgcaaatacctgccggaggcgaacatcacgaccgatcaggtcggtcttgtgaccggccttgcgtggacggctgtcggcggtacgacgctcgaggtcgaggtcaacgttgtcgatggtaccggcaagctggagctgactggcaatctcggcgacgtgatgaaggaatccgccttcgcggccatgagctatatccgctcgcgaacgaaggagctggggttgaccccagacttctataaaacgaaggatatccacgtccacttcccggagggcgccgtccccaaggacgggccgtccgccggcattacgatctgcacggcgatcgtctcggccctgaccggccgcgcggtgcgccgcgacgtggcgatgacgggtgagatctccatc

SEQ ID NO: 2132 - DNA, 2229 bp, Unknown
  Artificiall/Consensus sequence
atggcaaaaaagatcattcgcctgccccgcacaaaggagcagatccaggcaaataaggaaaagaatcaacgggccaaccggacgattctgcgccgcacattggttttgatgatcgtgtgtggcattgtcgtttttatcccgcttatcgccacgctctataatctcatgatcaccgagcacgattattatgaagagcgcgccatcaaaaaccagactcgctcgaccagcctctcggcctcgcgcggcgtgatctacgacgcgaacatgaacgtgctcgcgtcgtcgtcgaccgttgagacggtcttcatcgaccccaacgagatcgctgagcagatgaaaaagccggaaaacagcaaccttctcgaccagatcgcccgcggtctcggcgagattctggatgtcgagccgagcttcgtctatgagcaggcggccgacaagcagtaccgctataagatcatcaagcgcaagatccccgaggagctggctgacaaggtgcgcgcctttatcagcgaaaacgagatcaccggcgtctatctcgagaccgacctgcagcgctattaccccaattcctccctcgccgcgcaggccatcggctttgtctcgagcgacaataccggctccgagggcctcgaagcatattataacgacgagctgtccggtaccgccggcaaggtcgtcacctccaagggcaactacggctccgagatgctctatacatatgaaaaatactacgatgcatccgacggctgcagccttgttacgaccatcgacgcgaccgtacaggcgtatgtcgaaaagaacctgcaaaacgccatcgataaatacgacatcaaaaacggcgcgttctgcatcgttatggatgtgaacacgggcgagatcaaggccatggccacgctcggctcctacgaccccaacaattatctcgaaatttacgacgagtcggtcgacctcatgctggaaaacgagcatgacgcggccatctctctgccggaggcatccgacgcgtataaggcggcaatcgagcagtataacgccgacgtcgccgcggcccgccttgcccagtggcgcaaccgctgcgtgtccgacggctatgaacccggctcgaccttcaagctcatcacgctcgcgtccgccctcgattccggcgccatcacgctgaacgattcgttctactgcggtgggcaggaaaagtttgccggccgtgaccagatcctgaattgctggaaatctgccggccacggcgcacagacgaccgcgcaggccctcggaaactcctgcaacatcgccttcggccatatcggcatgcgcatgggcggcgatacgttctatgattatctcaaggccttcggcatcatggaaaagaccggcgtcgacctgccgggcgaaggcagaggcctgttctacgacaaaaagacgctgactgacacggcgacctacggcacgtcgtacctcatcacgtcctccttcggccagagcttccgcatcacacccatgcagctcgtgcgctccgtcgcggccatcgtcaacggcggctacgtgctgcagccctatgtggtcagcgaggtcctcgacgaaaacggcaataccgtgcagacgaacgaaaagactgtcctgcggcaggtcatcagccagcagacgtccgagaccatgcgcgacctcatggaaaaggtcgtgaccgaaggcacggcgtccgcggccaagacgcccggctaccgcgtcggcggcaagaccggtacatccgaaaagctggacgaatacgacgagaacggccagcaggtcaaggataagatcgtctccttcgtcggcgtcgcgccgatcgacgatccgaaatacgtcgtccttgtcgccctcgatacgccggcctattcccagaatagcgaaaaatacaccgtccacggcatgtacatttccggcggcctgatggccgcgccgacagtgcgcgatattttcctcgacatcctgccgtatctcggcgtggagccggactacagctccgaggatatccgcggcgtcaacttcaccgttcccgatgtgatcggcatgagcgagaccgaagcggccgcgctcctgtccgagaagaccatcacctaccgcacggtcggctccggcgcagtcgtaacggaccagctgcccgcagccggcaatcaggtgccgggcaattcggagatcattctatacttcggcgcagaaaagcagcagaccatggtcgaggtgccggactttatcggc

SEQ ID NO: 2133 - DNA, 1956 bp, Unknown
  Artificiall/Consensus sequence
ggcacgatctggctgtaccgccagacgagccgctattccagcgatggcagctcggatgagacaatctcggagctcatccagctcgacgcgcacggcacgctgctgcggaccatcacgccggtctcggacgatgcatccgacaattccgatggctggtactacaccatcagcgatattttctccgacgacaagggctatgtctacacctacgattatcagaccctcaacgtctacggccctgacggaacgtttatctgcggcaaaacgggcgacgagctgaacggtcaggtatgccagctttcttccagcgaggtcggcatgaccagtgtttcggcggatgataagagcgtgttcagacagctcgaccctgagacaaaggattggggcagggaaacgccggtctcttccgacgcatgggacctcttccccggtaacgatgtgtacgcctatttctacacgagaaacggcagcatctacggcgagcggaaggacaccggtaagacggagaaggtcgtcgactggatgagctgcgacatcgacagcagcttcatcggcagtgatagcattgcattcttgtctgacggccgcattgccgcagtcctgtcggactacaaccgtcaggacggctccggccagcagcaggtcgttgtgctgacgcgggtggacgcatccagcgtcaagcagaagaccgagctgacgctggcctgctttggtctggactacaatctgcgcagccagatcgtcaagttcaacaaaaataacagcgactaccgcattgtggtgaaggactattcggagcttgccacggaggacgattacacggcaggtttgacgaagctcaataccgagatcatttccggcaatgtgccggatctgatcatgaccaaccagctgccggtcgcccagtatgcggccaaggggctgctggaggatctgtggagctatattgacgccgatccggaatattcgcgcgacgcgctcatgctccagccgatcaatgcggcgcagacggatggccatctctatcagatgccgatcgactttggcgttgtgaccgcgatcggcctgaacaagatcgtcggcggctacacgagctggacgctggcggacgtcaatgacgccctttccaagctgcccgagggcgcgactgtgttcaacaagtactatacgcaggccgaaatgctgcagtactgcgtggcgatgaacgcgtccaacttcatgaactggcaggacggcacctgcaattttgactcggacgagttccgcgctcttctcgagtttgtcaagccgctgccggcggattacaactggcagtcggacgatgaggactatgagagcgactattcccgcgttcgcgacggcaagcagctgcttttcccgacctcgatctctgattttgacaatctctattatacctttgctgctctcaacaacgacgtggccttcatcggcttcccgcgcgaggacggcagcagcggcaactgctttatctcgcaggtctctctggcgatcacaacggcctgcaaggacaagagcgcagcgtggtccttcatccgctccgcactgtcggacgactatcagacgaatatgtgggcgttcccgatcgtgaaatcggcctttgaggcgcaggcggccaaggcaatggagcaggagtatgagacagacgccaacggcaatcaggtgctggacgagaacggcaatcccattcccatctcgaccggcggcatgagctacggcaacgagccgatgatcgagctgtacgccgtcacgcaggagcagtatgatgctgtcatggatgtcatcaatacgacaaccagctatctggactacgatacgaatgtgctggacacgatctcgcaggaggctgcggcctacttctccggcgataagatggtggaagaggtctccaagctcatccagaaccgcgtcagcctgtatatgcaggaacagaaataa

SEQ ID NO: 2134 - DNA, 2613 bp, Unknown
  Artificiall/Consensus sequence
atgagctttgtgcatctgcatgtccacagcgaatacagtctgcttgacggcgcgtgccgcatcggctccatgatggaccgcgtgcaggagatcggccagagcgccatcgcgctgaccgaccacggcgtcatgtacggcaccattgatttttaccgcgcggcgaaaaaggccgggatcaagcccatcatcggctgcgaggtctatgttgcgcgccgcacgcggcatgacaaggtgcatggcgtggacaaagagccgtaccatctggtgctcctgtgcgaaaatgagaccggctaccgcaatctcagctatatggtttcacttggctttaccgagggcttctataaccggccgcgcatcgatatggagctgcttcgcgagcatcatgagggtctgattgcgctctccgcgtgtctggccggacgtattccgcagtcgatcatgcaggatgatctgcaggcagccgagcaggccgcgcgggaatacaccgaaattttcgggccggagcatttctatctggaattgcaggatcacgggatcccggagcagcgcaccgtcaacgcccagatccggaagctggcggaaaagctggatcttccgctcgttgtgacgaacgacgcgcattatctgcgcaagtcggatgcaaagatgcaggacgtgcttctttgcatccagaccggcaagaccgtcgacgatccgaaccgcatgaaatttgagacggaggagttttacctcaagagcgaggaggaattgcgcgcgctgttcccggacgtgccggaggcgtttgacaataccgtcaagatcgcagagcgctgtaatgtggaatttaccttcggcaagtatttcctgccggagttcaagcttccggagggcgtcacgagcctgtcgtatctcaaaaaactctgccgtgagggctttgacgagctgtatgggacggagcatccggaatatctgcagcagctcgactatgagatcgacatgatcgagaaaatgggctttaccgactatttcctcatcgtgtgggactttgtccgttttgcaaaatcggcaggcatcccggtcggccccgggcgcggcagcgccgcaggctccatggtgacctactgcctgcatatcaccgagatcgaccccatgaaatacggcctgtatttcgagcgctttctcaatcccgcgcgcgtgaccatgccagatatcgacatggacttcggcgacacccggcggtcggaggtcgtcgactatgtccggcaaaagtacggcgaggatcacgtggcgcagatcgtgacgttcggcaccatggccgcgcgcggctctatccgcgacgtcggacgcgtgctgaatttcacctatgccgagaccgacgccgttgcaaagctcgtgccgacgacgctccatatcacgctcaaggacgcgctgaagcagtcgccgcagctgaagcagatgtatgacgccgacgcgcgcgtcaaggagctggtcgacaccgccatggcgttggagggcatgccgcgcaacacctcgacccacgcagcaggcgtggtcatcacgaagctgccggtctataactatgttccgctcgccaccaacgacggcacgatcgtcacggaatacacgatgacgacgctggaggagctggggcttctcaaaatggacttccttggcctgcgcaatatcaccgtcattgacgacgccatccgcgatatccgtaaaacggaacccgatttctccatggcacgcgtcaccgataatgatccgaaggtcatggacatgctcacgcagggcaggactgccggtgtgttccagatggagtcgaccggcatgacgggcgtgtgcatgggcctcaagccgcagtccattgaagatctctccatcatcgtcgccgcctaccggccgggcccgatggaatcgatcccgcggctcatcgcctgcaagcaggacccgtcgcttgtcaaatacaagcacccgatgctgaagcctatcctttccgtcacctacggctgcatcctctaccaggaacaggtcattgagatcttccgcaagcttgccgggtactcgctcggacaggcggacatggtgcgccgcgccatgagcaagaaaaaggtcaaggacatcgaaaaggagcgcggcgcgttcatccgcggcgatgcttcgcggaacatttccggctgcgtggccaacggcatcccagagactgtcgcggaagatatctataacgagatgtacgacttcgcaaactacgccttcaataaggcgcattccgtctgctatgccgtcattgcgtatcaaaccgcgtggttcaaatgctattatccgcgcgagtatatggcggcactcatgacctccgtcctcgacagctcggtcaagatctccgaatatatcaccgaatgccgcgccatgggcattgcgctcctgccgccggatatcaacgaatccaacgataattttaccgtcgtcccgggcggcatccgctttgggcttgccgcgatcaaaaatatcgggcgcggcttcattctcaaagtcatgggcgcacgcgagcagggtgggaaattcacgagccttgaggattttgcctcccgcatgtacgggacggatctcaataagcgtgcgctggaaaacctcatc

SEQ ID NO: 2135 - DNA, 1152 bp, Unknown
  Artificiall/Consensus sequence
atgaccatggaagaacagatcccgcagctgacgctgacgccgaaccttgacgccgagccgcagccggtggtacagaaggaagaagatctcatcacaaaggcacaggccgcgcccgaagcggggccggatctgtccgccctgtcggcggcggaggagaaggcagtcctggagtttgcacagcagatcgatctggaaaatgcacagcagattctggaatacggcgcttcggcgcagaagaatattgcggatttttccgagacggcgcttgccaaggtcaagacgagtgaccttggggagatcggcacgatgctctccggtcttctcgtggagctgaagacgatggacgagccggagaagaagggcatcgctggtctgttccgcaaggcgaaggtcaacgcggaagagatgaagagccgctacgccgcggcggaggtcaacgtcgaccgcatctccggggagcttgaaaagcacaaggtgacgctcatgaaggatgtggcggtgatggatcagatgtatgaccggaacctgcagtatttcaaggagctgaccatgtatattctggccggcaagcagaagctggccgaggcgcgcaacaccacgctgcgcgaacttcgcgacaaggcggaagcatcgaatctgccggaggacgcgcagacggccaacgactatgagaacaagtgcatccgctttgaaaagaagctgcacgatctggagctgacgcgcatgatctgcctgcagaccgcgccgcagatccgcatgatccagaataacgacacggcaatgatggagaagatccagacctccatcctcaacaccattccgctctggaaaaaccagatggtcctgacgctcggcatcgaggattcacgccgcgcgatgcaggcgcagcggcaggtcacggatatgacgaatgcgctgctgcagaaaaacgccgacatgctgcacatggcgtcggtcgagacggcgaaggaatccgagcgcggcatcgtcgacatggagacgctcaagcatacgaacgagcagctcatctccacgatcgacgaggtcctgcagatccagagcgacggcgcgaagaaacggcaggaggccgaaacggaactgcggcggctcgagggcgagctgaagcaaaagctgctgcagacgcgaagctaa

SEQ ID NO: 2136 - DNA, 1251 bp, Unknown
  Artificiall/Consensus sequence
atgaaaagtaagctttttgccatgatcgtttccgtccttgcggcgatgtgcctgtgggtctatgtcgtgaccgtcgtcaaccccgacggcgatatggtgatcggcaatatccccgtgacgttctccggcgcggaggtcctgcgcgaggatcacgggctggtcatcaccggcgattatcaggaatttgtctccgtgcatttctacggaaaaaataccgacctcaaaacgctcgaccagcataaggatgagatcaaggcggtcatcgacgtatccaaggtgcgcagtaccaaggaatacaccatgacctacgatattacgctcccgagcgccgtctcggcgtcgtccatcacgaaaatggacaagaacccctcctcgatcaccttccgcgtcgagcggcagatcaccaaatcggtcgaggtcaagggcgactttgcaaacgtcaagatcgccgagggctacatgctcgacagcacgagctttgactatgattccgtcaccgtggaggggccggagtctatcgtcagcaccatcgattccgcacaggtcacgctcgaccgcagcaatgtggacaagacgatcaccgagtcggtctcctatgtcctgctggacaagagcggcgaacaggtcgacccgacggagctgacgctcagcaccgacgccatcgaggtcacgatgaagatcgtcaaatataaggtcgtacccatcgaggtacagctgctctacggcgacggtctgcaggagcaggacgtcagctatgactacgagccgaaggccgtgacgctttccggcgattccgctgtgctggacggtctcaattccatccagctcgacccgatcgacctgtccatgctcacgagcaacgacgagacggtcacgcagaccatcctcatcccgaatgacgcgaagaacgtctccggcgaggaaaatgtctccgtccgcatcaccatcaccggtaagcagatcaagacgctgcggacgaccaacatcgtcttcatcggcgtcgacgagacgcagttcaaggcaacgagcctttcccagcaggtgcaggtcaccatccgcgctgacgcggcggacgcaaacaagatcaccgcgaacaacatccggatcgtggcggatatgagcgcctacacacagacagggacctatcaggtgcctgtgaccgtccgcatcgacggctaccagagcgccggcgcgatcggtcagtattccatcgccgtcaatctcgcggcggcggacacggaaacggaataa

SEQ ID NO: 2137 - DNA, 1656 bp, Unknown
  Artificiall/Consensus sequence
ttggcagaaaaattaaaaatcatccccctgggcggtctgaatgagatcggtaagaatatgaccgttctggaatatgggaaggatatcatcatcgttgactgcggtcttggattcccggacgaggatatgtacggcgttgatcttgtgatcgccgacatgacttatctggtcaagaacaaggacaagatccgcggcatgttccttacgcacggacatgaggatcacatcggcggcattccgtatgccatggagcagttcaactgccccatccatgctacgcgcctgacggccggcattgtagagctgaagctggaagagcatcacctacaggatacggtccatctgtttacgcacgaggccggcgaaaaggtcaaggccggctgcttcacggtggagtttatccacgtgaaccactctatcgcggacgcagtggcgtttgccatcaagacgccggtcggcaccgtcgtgatgacgggcgatttcaagatcgacgccacggcggaggatggcatgatcgatctggcccgcttcggcgcactcggcaaagagggcgtgcttgcacttctgtgcgattccaccaatgtggagaggcagggctacacaccgtcggaaaagacggtcgccgcgagctttgagcggcagttcatgggctgcaataagcgcatcatcgtgacgacctttgcgtctaatgcgttccgcttgcagagcctcattgcggtcgcaaagaaattcgggcgcaaggtcgccgtgaccggccgcagcatggagaatatcctgaaggtctccaccgagcttggttatctgaagatccccgccgggacgctcgtcgatatcaaccagatcaagcagatcccgaacaataagctcgtcatcgtctcgaccggctcgcagggtgaaaatatgtccgctctgtaccgcatggcgttctccggccaccggcaggtggagatcacggcgtctgaccgcgtgatcatctccgcttccgccatccccggcaacgagaaggcaatcggcaagatcatcaatgagttgtaccgcaagggtgcggacgtcatctatgacaagctcgaaggcctgcatgtctccggccacgcctgccaggaggagctgaagatcattcacggccttctgaagccccgcttcttcatcccggtacacggcgagcagcgccatctgcaggcgcattcgcgtctggcacagagcatgggcatggatcccaaaaacatctttatttccgacatcggcaaggtgctggagctgaccaaggggacctgcaagtggggcgggaccgtcccgtccggcaagatattggtcgacggtaccggtgtcggcgacgtcgggagcgtcgtgctgcgtgaccgcaagcatctggcgcaggacggcatgctcgtcgtcgtcgtcaatatctccagtgaagacggcagcgtcattaccgggccggatatcatcacgcgcggctttgtctatgtcaaggaatcggaaaatctgatggaagagctgcgggtcatcgccgcgcacgccatcgaccggtgcagccagaacgggcgcagcgactggagcgtcctcaaggccaatatcaagaatgatctttccggctatctgttcaagacgaccaagcgcaacccgatgatcctgccggtcattatggagatctga

SEQ ID NO: 2138 - DNA, 1428 bp, Unknown
  Artificiall/Consensus sequence
atggcggcaaaacagaagctttccggcagaaaaggagctgatcgaatgcagatcgtcatcgtgggcgacggaaaaatcggcagtgcactggctgagcagctttcccgcgaagggcacgagatcaccatcgttgaccgcagcggcgcgccgctgcagcagaccgtcgaggatcttgacattctgagcgtcgaaggcaacggcgcgacctacgccacccagatggaggccggcgtggacgaggctgatcttgtcatcgccgtcacggcgcaggacgagctgaatctgctgtgctgcctgatcgcaaagaagatcggcgcccggcacaccatcgcccgcgtgcgcaatcccgaatacgcgggcgagctttcgctcatctccgacgatctggggctgagcctgtccgtcaatccggagctgatctgcgcgaccgagatggcgcgtacgctccgcacgccgtcggccatcaagaccgacacgttcttcggcggcaaggtcgagcttctcaagttccagctcccggcggactcgccgctggccggcaagacgctcatggagctgcccgccgtcacaaaggcaaaggtcctcatctgcgcagtcgagcgcggtgagcaggagatccatatcccctccggccagttccgcctgcaggcgggcgaccgcatctcgttcgtcgcgtcctacggcggcgcgcagcagtttttccgccagatgaagctggcctccggccgcgtgcgcagcgccatgctcatcggcggcggacgcatcgcgtattatctcgcccggcagcttctcgaggccgggctggacgtcaaggtgatcgactccgaccagagccgctgcgcggagctttccatcgccctgcccaaggcagaaattctctgcggcgacggcacgaacgaagcgtttctgcgcgagtgcggcatcgagtccatcgacgccgtcgcggcccttacgggcatcgatgaggaaaacgtcctcattggcatgtacatccgcaagacctggccgaaggtcaaggtcatcaccaaggtcaaccgcacctcgttccagtcgatcatcgacagcatggatctcggcagcgtctttaacccccgcaattccgcctcgaacctcatctgccgctatgtccgcgccatgcagaactcggagggcagctcacagatcgagacgctctacaagctcgtcggcggcaaggccgaagcgctggagttccgcgtgtccggcagctcccggctctgcggcatcccgctgcagcagctgcagctgcgggaaaatctgctgatcggctgcatcggccgcggcggaaaaattctcatccccagtggtcaagacaccatcgagccgggcgacagcgtgatcgtcgtcacgtgcagcgcgggtctcggcaagctggaggacattctcgccagagggaccggccatgaataa

SEQ ID NO: 2139 - DNA, 1368 bp, Unknown
  Artificiall/Consensus sequence
gtcctgatctggatccttgccgtcctgcttctgctgtcgatggtcggctgtgccgccggcactgccaacaccacgaccgacaagtacgcaggtatggagcctgccgcggccgctgagtctgccgcagcagagacgaaggataccaccagtctgtccgatatcatccgtgttccgttcggatatctgctcgactggctgtataccgttaccaataactacggtctggcgctcatcctgttctccctgatcgtcaagctggtgcttttgcccatgtcggtcaagagcaagaagagcatgctcaagatgtcccgcctgtcgccgcaggtcaaggcgctcgaagccaaatacggtgacgacaagcagaaatatcagctggctgtccagcagatgtacaaggaagagggcgtctcgatgggcggcggctgtttgtggtcgtttatcccgctcatcattctgctgcccctctactacgtcatccgtgagccgatcacctacatgatgcacaactcccgctcgatctccgaggcgatcgtcgccttcatgcaggccagcggcgtcaatctcggcaagaacgcatactatgcgcagcttgccgccgcgggtcacatcggcgagttcatggatgagctgaaggcgctggccgtcacggcgaacgcccatctgcaggccatgaacttccagttcctcggcatcgatctgtccggcatcccctcgttccgcttctgggagtgcgagggctggggcgagatcggcctgttcctgatcccggtcgtctccgctgcgctgcaggcagtttccatgctcatcagccagaagatgaacaatcaggtcgcgaccaacgccgacggcgaacaggacgcagaggctgccaagaccgccaaccagaccaacatgaccatgatgctcatgatgccgcttatgtccctctggatcggcttctcgatgccggccgcgatctcgatctactggatcgcgcaggccgtgttcggtgcgatccaggactacatcctgacgaagcactaccgcaaggtctatgaggaagaggacgccatcaagcaggagcaggcagccaagcgccgcgccgaagaggcggaaaaggagcgcgtgcgcgccctgcgccgtgagcagaatcccgacggcattaccgacaacgtcagcaaaaagaagatccggcagcaggaaaaggaagctgccgaaaaggccgccagagaatacgaggcaaagaagaacccagtctctgagaacccggaaaagaagccgctctccggcgatccggagcgcccatacagccgtggccgtgcctatgatccttctcactacggtaaaaagcgttctgccggcgctgaggcggaacagacgaaggagtaa

SEQ ID NO: 2140 - DNA, 1626 bp, Unknown
  Artificiall/Consensus sequence
ttgttgagagcaggctttccgcgtagttctccaaaaacgctgcccgccgcagcgtttttgcaaaaaggcggagcgaattccctgacagaaaggatgacatgcttggaaaacgcaatcgaactgagaaacataaccaagcgctttggccaggtcgtagcaaacaaatcgatctgtctggagctgcataagggcgaaatcctgtccctgctcggcgaaaacggcagcggcaagaccacccttatgaacatgctgtccggtatctactatccggacgaagggcagatttttgtagacggcaaggaagtggagattcgctcgccgaaagacgcatttgatctgcacatcggcatgatccaccagcacttcaagctcgtcgacgtgtttacggccgctgagaatatcattcttggtctgccgggcgacaagggcaagatggacaaggccgccgtcagcaaagccgtccgcgagatcgccgaccgctacggcttcgacatcgaccccaaccagaagatctacgagatgtccgtttcgcagaagcagaccgtcgagatcgtcaaggtgctttatcgcggcgccgatattctgatcctcgacgagccgaccgccgttctgaccccgcaggagacggaaaagctcttcaccgtcatgcgcaacatgaaaaaggatggcaaggccatcatcatcatcacccacaagctgcacgaggtgcttgccgtgtccgaccgcgtggccgttctgcgcaagggagaatacatcggcgacaccgagaccgccacagcttcgcagcagtcgctgaccgacatgatggtcggccgtgccgtgagcctgaatattgaccgtccggtcaacgaaaaccaaaccgagcgcctgaaggtcgagcacctgaccgtcaagaacaaggaaggcgtcaagatgctcgacgacgtgaccttcaccgccatgggcggtgagattctcggcatcgcgggcatcgccggctctggtcagaaggagctgctggagtccatctccggcctgcagaagctcgaagagggcagcaaaattacatacatcgagccggacggctccgaatgcctgctcaacggcatggatccgctggatatcatccgcaagggcctgcttctgtccttcgtcccggaggaccggttcggcatgggtcttgtcggtggcatgaacatcatccagaacatcatgctccgcacctaccgccgcggcaagggtccgctcaccgaccgcaaattcccgcgcgacctgtcgcagaagatcgtcgacaatctcgaggtcgtcacgcccgacatcggccgcacgccgatccgccgtctgtccggcggcaacgtccagaaggtgcttgtcggccgtgagatcgcgcagaaccccgccgttctcatgacggcctacgccgtccgcggtctggacatcaacacatcctacgtcatttacaacctgctgaccgagcagaagatgaagggcgtcgccgtaatttacgtcggcgaggacttggatgttctgcttgagctgtgcgaccggatcctggtcctgtgcggcggcaaagtttccggcatcgtggacggccgcaagaccaccaaggatgccgtcggcctgatgatgacaaagattggaggttaa

SEQ ID NO: 2141 - DNA, 1356 bp, Unknown
  Artificiall/Consensus sequence
atggcatttgaaggcttaaccgaaaagctctcgaacgcattcaaaaagctgcgcggcaagggccgtctgtccgaggccgacgtcaaggaatccatgcgcgagatccgtctcgccctgctggaggccgacgtcaactacaaggtcgtcaaggacttcatcaaaaaaaccaccgaacgctgcgtcggcacggacgttcttgagagtctgacgcccgcacagatgattgtcaagatcgtcaacgaagagctgaccaatctgatgggcagcgaaaaccagaagctgaagctcgcctcccagccgcccacggtcgttatgctggtcggcctgcagggcgcgggcaagaccaccaacggtgcaaagctcgccgggcttttcaaaaagcagaacaagaacccgctgctcgccgcctgtgacatctaccgtccggccgccatcaagcagctgcaggtcgtaggcgcgcagctcgatatccccgtctttgagatgggtcagacgaacccggtcgacattgcaaaggccgccgtcgcccacgccgtccggcacggcaacgacatggtcttcctcgatacggcaggccgcctgcacgttgatgaagcgctcatggacgagctgaaggccatcaaagcggctgtgaagcctgatgagatcctgctcgtggtcgacgccatgaccggtcaggacgccgtcagcgccgccaagacgttcgacgagtacctcgacattaccggcgtcatgctctccaagctcgacggcgacgcaagaggcggcgcggcgctgtccatcaaggccgtgaccggcaagcccatcaagttcatcggcaccggcgaaaagctcgaccagatcgagccgttccatcccggccgcatggcctcccgcattctcggcatgggcgacatgctcacgctcatcgaaaaggccgaagccgcgttcgacgcgaagaaggccgccgagctggagcagaagctccgctccaacaaattcacgctctcggatttctacgatcagctcacccagctcaagggcatgggttcgctcgacgagatcgccggcatgatgcccggcatgaacgcgggcgcgctcaagggcgcgcagatcgacgaaaaggccatggtccgcaccgaggccatcatccagtcgatgacgccgtatgagcgcgagaatccttccgtcctcaactccagccgcaagcgccgcatcgcgctcggctccggcgtcaaggtcgaggatatcaaccgtcttctcaagcagtttgagatgatgaatcagatgatgaagcagttctccggccctggcgcttcgcgcaagatgaagcgcatgagcaagatgggcggcttcccgggtctgcccggcatgtaa

SEQ ID NO: 2142 - DNA, 1833 bp, Unknown
  Artificiall/Consensus sequence
atgtgtggtatcgttggatacgtaggaaagcagcaggcggctccgatcctgctggagggtctgtcgcgcctggaataccgcggatacgattccgccggcatctgcgtggaacaggacggccgtctggagatcgaaaaggccaagggccgtctgcagaacctcattgcaaaaacggataacggtgcttccctgcccggcacgctcggcatcggccatacccgctgggcgacccacggcgagccgaatgacatcaactcccacccgcaggtctctcagaacggccgcatcgccgtagtccataacggcatcattgaaaactatctggagatccgcgaatttctcgaggaaaaaggcgtcgtctttacctcgcagaccgacaccgaggtcgttgcgcagctgatggagtactgcatgcagctgccggaggtgcagacggtctcggacgcactgtacatggtcctgcatcggatcgagggcgcttacgcgctcggcattctttccgccgacgacccggcgcacatctatgccgcgcgcaaggacgcgccgctgctgctgggcttcggcgagggtgagaatttcatcgcctccgacgtgacggcactcgtcaaatacacccgtgacatcgtgtacatggacgacggcgaggttgccgtcctcggctgcgacggcattcaggtctacaatgcgatggagctgcccattgaaaaggagcatcatcacatcgactgggagatctcggccgcggaaaagggcggatacgaacacttcatgctcaaggagatcatggaggagccggaggcgctgcgccgcgccatcctgccccgcatcaaggacggcaaagtcgtttttgagggcctgcagctggatatccgccagtatcactccatcaagatcatcgcctgcggctcttcgtcgcacgtgggcatggtcggcaaatataaccttgaaaagctgacgcggatcccgaccgaggtcgtgctggcctccgagttccgctactgcgaccccatcatcgacaacaagacgctcgtcatcgtcatcagccagtccggcgaaacgcttgacaccatggccgccctgcgcgaggccaaggcgctcggcgcgcggagcctgtccatcgtcaacgtcgtcggcagctccatcgcccgcgagtcggacgacgtcctgtacacttgggccggcccggagatcgccgtggcgacgaccaaggcctttgtcacgcagatggcaatcatcgatctgttcgccgtctggctggccgcacagctgggacggctgagcgaggaagaggaagcccgcctcacggcagccattgccgctctgcccgcacaggtcgagcagatcctctccagccgcgagcggatccagtattacgcgtcgcagtattttaaccacgattccgtgttcttcatcggccggaatctggactatgcactcggcatggagggttctttgaagctcaaggagatctcctacatccactccgaagcgtacgcgtccggcgaactgaagcacgggacgatctcgctgatcgagccgggtacgctcgtcgtggcactgggaacctattccccgctctttgacaaagctatgagcaacgtcatcgaggtcaaggcccgcggggcgagcgtcctcgcgctgaccacggagcagaaccgtgaggagatggaaaagcgcgtcgacggcatcctgaccatcccggacacggagctgtcgctcctgccgcttctgggcgtggtgccgctgcagctgttcgcgtactatgtcgcgctgcagcgcggctgcgacatcgataagccccgcaacctcgccaagagcgtcaccgttgaataa

SEQ ID NO: 2143 - DNA, 1614 bp, Unknown
  Artificiall/Consensus sequence
atgaaacgaaagctgcttgcgctgacggcgcttattctggcgctggcgcttctttgcggctgctcgtcggtgaacgcgggcgaactcatgaagcagctcttccccgccaaggacgagagcgtcgccagccagcagaccggcgatatcagcagcatctccaatgagccggagggaacggccgtcgtaacggaaacgtacacgcagatcgagtccttcggcctcgcctatcagccggactacggcctgcagccgtataactgccagagtctcaataaccgcatcattttctcgttcctgtacgagccgctgttctccgtgacaagcgattatgaggccgtgcccatcctcgcggagggctataccgtgacggacgacggcaaaacgacgaccattacgctccgcaccggcgtcacgttccacgacggcagcgccatgacggcgcaggacgccgcctattccatttcctccgccgcaggctccgactattacggctcacgcctgcgctttatcacggccaccgacacgccggacgaccggacgctcgtcatcaccacgagtgaatcctatgagtgtctgccgctcctgctggatatccccgtcatcaagtccggcacggcggagcagcccgtcccgcccggcaccggcccgtatcagttcgcgcagacgaagctgacgcgctacgccggctggtggcaggagtccgcgccgctcgtcgattttgacgagattgcactgaccgaggcctccacctccgccgatgtgcgcgacaattttgaataccagaaggtcaacatggtgctgaccgaccccaattcctccgcctttgccggcttccacaacgactatgagctttggaacgcggacacgaccatcatgcagtacatcggctacaacatgaactcgactgtcttctccaactatggtctgcgcggtgcgattccctacgccatcgaccgcgaggcgctggtcgagcaggtcttcggcggctttgccgcggcgtccacgctgccctgcgcacccaattcccggtattacgacgtcaagctcgccaacagctttgcctatgaccccggcgcgtattatgaccagctggccagcgcatcggtcgaggacgcgaccggcgacggcattctggatctctatgtcccctccaagggctattccgtcccggtcgagggtacgatgatcgtctgctcctcgagctacatccgcgtgcaggctgccaacgaggtcgccaggatgctcaactcgctcggcttcaatatcacggtcaaatccatggagtattccgagtataagcaggcgctgctgctggggaacttcgatctttactacggcgaggtccggctgtcaccgaactttgacctctcgccgttcttcggcgcgaccggcacgctcaactacggaagcctgtccgacagcacgatgatgaacctgtgcagcatggcgctggtcaacagcggcaacacctacagtctctacaagcgcgtctgcgagcgcggctatctcacgccgatcctcttcaaaagctacgcgctctacaccacgcgcggcgccgtcaccgaaccgacgcactacatcgactggttcctgccggtcacagacccatcctga

SEQ ID NO: 2144 - DNA, 1509 bp, Unknown
  Artificiall/Consensus sequence
atgagcgcatcccgcgaaaagaacaagcgcaaggaacagacagcctccccggagactgccaaggaaacgaagaaaggcatgggcaagggccttaagacgactttgatcgccgtatgcgctgttctgatcgtctgcatcgtcgttttcttctatatgctgaccagcggcttctttgccggccacaccaccgccgccaccgttggctcccacaacctcagcccggccatggtcaactacttctacaagagcgcctacaccagcctgcagaatacctacggcacctatatggactacatcatcgactccgatacgccgctcgacgagcagtattatgacgagtccgccggtacgacctgggccgacatgctgaccgagcagggcatgaccacggctgccgaggcctacgccctctatgacgaggccatggccagcggctacatgctctccgagaccgatcagaccaccatcgacacgcaggtctccacgctcggtctgtacgccgccacctacggtaccaccaccgacgcctatatcgccgctgtctacggcacgggctgcaatgagaagaacttccgcgagtatctgaaggtcgtcaccgttgccgagagctatgcacagcagatccgcagcagcttcacctacagcgatgcggatatcgccgacgagtatgccgccaaccccaacagctatgacagcgtcacttaccgccagttcctcgtctccgaccccatgttccagacctcgtctgaggacgttgaggcaggcgcggctgagctgaccgaggacgagctgaccgcgaagaaggaagagatggcctccaggatggctgaagacgccaagggcgacgagcaggccttcatcgacgcggcctacgacaacgccaaggaatccgacaaggacacctacgcagaggacagcgccacgctgcgcgagggtgcgttctacacctccgttgacagctccatcgccgactggctgttcgacagcgcccgcaccgagggcgacacgacctatatcgtctccgacagcggcgtgtactatgtcctgtactacatctcccgcagcacgaacgagtatcagctgccgaacgtgcgccacatcctgatctccgtcagcgacaccacggatgaggccgcgatggaagaagcccgcaccaaggccgagagcattctgaccgagtatgaggccggcgagcatactgccgacgcattcggcgcactggccaaggaatacactgacgactccaacggcgacgaaggcggtctgtacaccaacatcaccccgggccagatggtcaccgagttcaacgactggtgctttgacgagagccgtcagcccggcgacaccggcatcgttgagacgagctacggcgtccacgtcatgtacttcgacagcttcggctccctgtaccgcgacgtgctggtcgaaaacgccctgcgcagcgccgattatacggcatggcacgacgaagtcaccagtgacagcagctacacgctcattcccttcggc

SEQ ID NO: 2145 - DNA, 1248 bp, Unknown
  Artificiall/Consensus sequence
ttgaaggaacatgaagaccggaagtatatcaaagttggactgaccgcgctggctgttatttttatcagcattctgctcgtcgtgatttttacgaatctgccgggctttttcgccatgctgcaggcgctgggcgccattctggagccgctgatcttcggcgtggtgatcgcgttcctgctgaacccgatcgtccggttctttgatacccggctcatcccgctgctggaaaagcatacaaaatggaagccggccgccatccggcacctgagccgcgcgtccggcgtcgtggtggccctcattgtcgcggcgctcattctctacgcgttcttctccatgctcctgccgcagctgtatgacagcgtcgtcgggatcgtgagccacgcggaggattattacaagagcatcgaccgctgggtcacgaatattctcgaggataacccggatctgcgcggctatgtcgatacggcgctgggcaagatctacgatttcgtcaacaactggatcacgacgaccttcctgcaggatgtgcagaaaatgctgaccacgctgacaagctcggtcgtctcgatcgtcaagagcctcatgaatctgctgatcggccttgtggcctccgtctatattctctggtcaaaggatacgttccacgcgcaggccaagaagatcaccgttgccctgttcccggagaagcatgcagaccatctgttttatcttgggcgcaatatttaccgggtgttcaacggctttgtcatcggcaagatcgtcgattcggcgatcatcggcgcgctgtgctactttgggctgctggcgctcaagatgccgtatccggctcttgtggccacggtcatcggcgtgacgaacgtcatcccgttcttcggccccatcatcggccttgtgccgtgcgcgttcctcattctgctggtcaatccgctgcaggcgttctattttgtgatcttcatcctcgttctgcagcagatcgacggcaacgtcatcgggccgaagatcctcggcaataccgtcggcatctccggcttctgggtcctcgcctcgatcacgatcgcggcaagcctctttggcttcgccgggatgatcctcggcgtgccggtcttcgccatcatctatctgctcatttccgactccgtcaacaataagctccgcaaaaagcagctgacgaccgataccgatgcctactgcggcatcgacaccgtcgccgatctgccgcaggaaggaccggcggagcaggacacataa

SEQ ID NO: 2146 - DNA, 1227 bp, Unknown
  Artificiall/Consensus sequence
gttttccctatgaccgtcattgaccgctttctgaagcttgtttcctaccccacgacctcggatgaagcatccgagacctgcccgtcgacggcgcggcagctgaagcttgcgcaggagcttgtccgccagatgcaggacataggcatttccgacgcccacgtcgacgccgacggctatgtctacggcaccatccccgcgaactgtgagaaaaagcttcccgtctacggtctcatcgcccacatggatacgtctccggacgcgccgggtgagaatatccatgcccgcatcacggaggcctatgacggcggagatgttgtcctgaacgaagcgctcggcatcgtcctgtccccgaaggactatccgcagctgaaaaatgccgtcggcaagcacctgatcgtcaccgacggcacgacgctgctcggcgcggacgacaaggccggcgtggcagagattctctcggcggcgcagctgctgctctcgtccgacaggccgcacgggaccgtcaggctcgcctttaccccggatgaggagatcggccgcggtgcagaccggtttgatgtggccgggttcggcgcggattacgcctacacggtcgacggcggcgggatcggcgagctggaatacgagaatttcaacgccgcgagcgcgaagatcgtcatccacggcaagtccatccaccccggctccgccaaggggcagatggtgaatgcctcgctcgtcgccatggagctgcacagtcttctgcccgcgctggaaacgccctactataccgaaggctacgagggcttctatcacctgaccggcatgcagggcgagaccgaacaggcggagctgcaatatatcatccgcgaccatgaccgggcaaaatttgaagcgcgcaagcgcgtcatggagaccgtctgcgcggaaatcaaccgccgctacggcgcgggtacggccacgctgacgctgcgcgacagctattataatatgaaggaaaagatcgagccgtgcatgttcctcattgacaacgccgcagacgcgatgcggcagctcggcatcacgccgaagattgtccccatccgcggcggcacggacggcgcgcggctctccttcgagggtctgccctgcccgaacctctgcaccggcggcgaaaacttccacggccgcttcgaatacatccctgccgaagacatggaagccatcaccaacctgctggctgcgatgctctggcgtctggcagaataa

SEQ ID NO: 2147 - DNA, 1722 bp, Unknown
  Artificiall/Consensus sequence
gtcctcctgccgacgacgttcccgaacgtcctcgtctcggccaatatgggcatcgctgtcggtatggcgtcgaatatctgctcgttcaatctcgccgaggtctgccggacggctgtcgcccttatcaaggacccggacgccgagcttctcgatacacttcccgcgccggatttccccacgggcggcgagatcctctatgaccccgcccagatgctccagatctacgagacgggccgcggctcgttccgcctccgggcaaaatggcgctacgtcaaagaggggaacatgatcgagatctacgagatcccctacacgacggccaccgagatcattctggacaaggtcgccgagctgatcaaggccaacaaggtccgcgagatcagcgacatgcgcgacgagaccgacctgaacggcctgaagctcaccatcgacctcaagcgcggcgttgacccggacaagctcatgcagaagctgttcaagacgaccacgctgcaggactcgttcggctgcaacttcaatatcctcatcgccggtcagccgcgcgtcatgggcgtgcgcgaaattttgcaggagtggacggcatggcgcacggaatgcgtccgccgccggctctattaccagatgaacaaaaagaaggacaagctgcacctcctcaaaggtcttggtaagatccttctcgatatcgacaaggccatcgccatcatccgcgagaccgagctggacgccgaggtcgtgccgaacctcatgatcggcttcggcatcgatcaggtgcaggccgaatacgtggcggagatccgcctgcgcaacatcaataaagagtttatcctgaatcgtctgaaggaaacggatgcgctggagcgggagatcgccgacctcgaggcgacgctcggctctgaaaagaaggtcaaatcgctcatctgcaaggagctggagcaggtcgcccagaaatacggtcagccgcgcaaaacgacgctcgtctatgaccacgagctgcagcagatcgaggacgacgagccggagaacgactacccggtcaccgtcttcgcctcgcgcgagggctatttcaaaaagatcaccgcccagtccttgcgcatgtccggtgagcagaagttcaaggagggcgacagcctgctgcttacgtgcccggcgcagaacgtggacgagatgctggtcttcaccgaccgctgtcaggtctataaatgccgcctgtccgactttgccgacagcaaggcctcggtacttggcgactatctgcccggcaagctcggcttcgacgagggcgagagcttccttaccgttatcttccccggcaaatacgaggggaacctgcttttcgtctttgaaaacggcaaggcggcgaagatcgccatgagctgctatgacaccaaatccaaccgcaagcgcctgacgggcgcatactcggacaagagtccgctgaaagccatcattgacctgccggaggagaagcagctcgccctgttcgcgaccgacggccgcgcgctcatcttctcgacggcacagctggccatcaagacgacgcgctctgcgcagggtgtggctgtcatgagcctcaagcgcaaggcggtcgtgcagacggccatggagctggaaaagacctcgatcaccaacgtcggccgctattcggcacggacgcttccggccgccggcgcactgatccgcgaagaggattccggcgaaacacagatgaagcttgatatttaa

SEQ ID NO: 2148 - DNA, 1965 bp, Unknown
  Artificiall/Consensus sequence
agcgctgcaacgttggatctgccgctgaccgggtatggcctccggtaccggtttggcctgttcaagcagtcgtttgtacacggctgccagcgggagaacgcagacgactggacgaaatacggtgacccgtggagccaccgccgcgacaaactggcggtcaaggtgaaatttgctgaccagacggtcaactgcgtgccgtatgatatgcccgttatcggctatcagacgaataccgtcgggacgcttcgcctgtggcagtgcgaggcggaggaagaactgaacttcgacgctttcaacgcgcaggactatgtcaaggcgctggaaaagaaaaacaaggcggaggatatcacccgcgtgctctatccgaacgactccacgtgggaaggcaagcgcctgcgcatcaagcagcagtatgtgctgtccagcgcgtcgctgcaggacattctgcgtgattaccgcgaggcgcacggcacggattattaccgcctgccggagttcgctgctgtccagctcaatgacacgcatcctgccatgtccattccggagctgatccggcttctgatggcggaaggactggattttgacgctgcgttcgagctcacgcgccgcgtattcgcctataccaaccatacggtcatgggcgaggcgctggaaaagtgggatttggagctgctgcgttccgtcgtgccggaggtctgtgagatcatcgagcgtatcgacgcgcggctcaagcaggggcatccgcattcgaacctctttatcgtcaaggacgggcaggcgcatatggcgaatctgtcggtctacgtgtccaccgcggtcaacggcgttgcggagatccattcgcagatcctgaaggatgacctgtttaaggactggtatgccgtctatcccgagcgcttccagaacaagacgaacggcatcacgccgcgccgctggctgggcctctccaacccggagctgtgcggtctgctcgacagcaagatcggcagcgggtatctcaaggacctcgacaagctggccggtctcagggatcagatcgatgaaatgaccgtcaagcagttcaacgccatcaagctcgagaaaaagcgtcagctctgccgcgtgatcgaggagcaggagggcgttgcgctcgacccgacattcatcttcgacgtgcaggtcaagcgcctgcatgagtataagcggcagcttctcaacgcgctgggcatcatggatctgtacctgtccatcaaggatggcagcatccgtgactttacgccgacggcattcattttcggtgcgaaggcagctcccggctaccgccgcgcgaaagcaatcattcattatgtcaaccgaatcgccgaccttatcaacaatgaccctgcgatgaacggcgtgatgaaggtcgtcttcgtgcagaactacaattgctcctatgctgagcatatcatccccgccgccgatatctccgagcagatctcgcctgccggtacggaagcgtccggcaccggcaacatgaagctgatgctgaacggcgcagtgacgctcggtacgctggacggcgcgaatgtggagatcgccgagcaggccggccgcgagaacgagtatatcttcggcgcgacggtcgaggagatcaacatggtgaagcccagctacaacgcgcgcagcttctatgaagcgaatccgaatctgcgccgcgcggtcgacacactgatcgacggcactgtcccgacggatgaggagcagcatgagctgtacacgtccctgctcgaaggcgccagctggcacaagccagatcagtatttcctgttctatgactttgacagctacaaaaaggcgcgtctggcagccaatcgggattacaacgaccgcatcgccttcggacgcaaatgcctgctgaacgtcgctgccgcggggaaattctcctcggaccgcacgatccgccagtatgcggatgagatctggcatatcaagcccgtaaaataa

SEQ ID NO: 2149 - DNA, 1026 bp, Unknown
  Artificiall/Consensus sequence
gtggcaaaggaaaaacagatcatttccaacgagtttgagcccgttgcatacgatccgcagtacattctgatggtcaatcacctgaagaagtacttcccgatcaagggcggccttctgtcccagaccgtcggccatgtcaaggctgtcgacggcgtcacgttcaatctcaaacgcggctgcacgatgggccttgtcggtgaatccggctgtggcaaatcgacgaccggccgtgccatcctccgcctgtgcggcgaaaaaaccggcggccaggtgctcttcaacggcaaggaggtctatgacctgtccgacgccgagatgcgcacgctgcgcccgaagatgcagatcatcttccaggacccgttctccagcctttcaccccgtctgcccgtcggtgagatcatcggcgaggccgtgcgtgagcataatctcgtcccgaagaacgagtttgacgattatatcgatcagatcatggacaactgcggcctgcagccgtaccacaagacgcgttatccgcacgaattttccggcggccagcgccagaggatctgcattgcccgcgcgctggccatgaatccggagttcgtcgtctgcgacgagccggtctccgcgctggacgtgtccattcaggcgcagatcatcaacctgctgaaggagctgcaggaaaagtacaagctgacatatctgttcatctcgcacgacctgtccgtcgtcgagcatatctccgataccgttggcgtcatgtatctcggcaatctggtcgaatacggcaacacgcaggacatctttgaccgtccgctgcatccgtataccaaggcgctgttctcggccatccccatcccggatccgaccgtcaagcgcgagcggatcgtcctgcagggttcgatcccgtccccggccaatccgccctccggctgcaagttccacaccagatgcccgtatgccaccgagcgctgcaagtgtgaagcgccgaagcagcgcgaggtcgaaccgggtcactatgtggtctgccaccagtatgacaaatga

SEQ ID NO: 2150 - DNA, 1041 bp, Unknown
  Artificiall/Consensus sequence
atggcgctttccgaacggaaaaagaagatcctgcgtgcgatcgtagatctttacatccgcacggcagagccggtcgcgtcgaagacgatcgcgcagatgccggacatggatttttcctccgccaccatccgcaacgaaatggccgagctgaccacgctcgggtatctggagcagccgcatacgtcggccggccggatcccctcgcctgccggctaccggctgtatgtcgacgagctgatgcaggactatcgcctgtccaccgatgaaacgaaatccatcaatcaggcgatggagatgaagatgcaggaggtcgacaaggtcgtctcgcaggtcggcaagctcgtctcgcagatgaccaatctcccggcctacgccatggcggcgcgcgccggcggtctgagcgtcaagcgctttgatctcattctagcggacgcgggcagcttcattctggtggtcatgctgagcgacaattccgtccgcaacaagctcatccggctcccggtcgagctgaccgagacggatctgaagctcctcggggccgttttgaacgcaagcgtagccgagctgacagccgagcagatcacgccggagcttctttcccgcgtgacaagaagcgcaggcgcggcggcaagcctcgtgccgatcgtcatggatttccttaccgagatcctgcacgcggaacacagcgaggtctatatgaccggtcaggccaagctccttggccagccggagtaccacgacatcgaaaaggcgcagaaaatgctgacgaccctcgatgaggatgtggtctccaaccttcccgcggcgctctcctccgacagccggacgcagatcctggtcgggccggagaacgtgtcgaaggagctgaaggacaccagcgtcgtcatgacgaggtttgacatcggcgacggcatgcagggtctgatcggcgtggtcggccccacaagaatggattacgcgcagatcaccgctcggctcagctactttgctgagaatctgagccgcatgttccagaagaaccagacgccggcactcgaaggg

SEQ ID NO: 2151 - DNA, 1428 bp, Unknown
  Artificiall/Consensus sequence
atgtgtgaaaaggagcgtttgaatatgtccgaatttaactatgattccaactatgaacccattcagcaccagcagtcctattcctacgaatgcagcggcggcccgcagccggcttcgcagccggaacccgcgccgcagaaaaagtccggcaaggccggcaaggtcgtcgccctgcttctggcgtgcgcgctggtcggcggcggctctggctggggtgcagccgcactggcacagaaaaacagcagcgcagccgctgctccgacagccgcttcgtctgacgcgtccgtcatgctcgagggccagcgccagaccgctgcgctgcaggttgcttccgtcgataccagcaaacttctgacggccagcgaggtctacgcgcagaacgtcaactccaccgtcggcatcacgacctccatcactaccaactacttcggctaccagaccacggccgcggccgcaggctccggcttcatcctgacgcaggacggctacatcctcacgaattaccacgtcgtcgaatcgtccgactccatcaaggtcacgacctatgacggcacgagctacgacgcacagctcatcggctatgacgagagcaacgacatcgctgttctgaaggtcgacgcaaacgatctgaccccggtcgtcctgggcgactccgattccgtcagcgttggcgacagcgtcgtcgccatcggcaacccgctgggcgagctgacgttctccctgaccgccggtgcgatcagcgcgctcgatcgtcctgtgacgctctcctccggcacgaccatgaacctcatgcagaccgactgcgccatcaactccggcaactccggcggcgcgctcttcaatatgtacggcgaggtcatcggcattaccaacgccaagtattccagctcctcgtccagctcggaagcgtccatcgataacatcggctttgccatccccatcaatcaggtgcgttcgatcgtcgagtcgatcatccagaacggttatatcgtcaagccgtatatcggcgtgagcgtctccgacgtctcctccgagagccagagctacggcctgccgcagggcgcggctgtccgctccgtcgtggaaaacagcccggctgcagaagccggtctgcaggaaaatgacatcatcaccgccgccaatggcgaggccatcaccggcagcaacgatcttgtaaagctcgtcaaggccgcttccgcaggcgatacgctggagctgaccgtctatcgtcagggccagaccgttaccgtcacgctgaccgtcggcgagcagaagcaggacgccctgcccgcgcagaccaccgacaatacccagtccgacagccaaaacccgtatggccagtacgaccagtacggcagccagaacggcgaccagtatggccaacagtacggcggctcgttccccttcggcttcagcttcggcggctaa

SEQ ID NO: 2152 - DNA, 1752 bp, Unknown
  Artificiall/Consensus sequence
atggcaaatcagcagctgacaggacttgactacaaaattcaggagatggcgggccgtatccgcgagcttcgtgagatctccggcttcacgccggccgagatggccgggaagaccggcgtcagcatcgaggaatatctcctctgcgaggcgggcggaagcaatctgacgttcgcgtttctctaccggtgcgcgctggcctttggcgtcgacgtgaccgaccttatcgagggccagagtccgaagctccgctcctacacgcttacgcgcgcaggcaaggggcagaagatcgagcaggcacacgagatgatctactacaacatggcatcggacttccagaaccggatcgccgatcccctgtttgtggaaaacaagtattccgaccgcgcgttccactccgatatcgagctgaccagccacatcgggcaggaatgcgatctcatcatcaagggctgcatgaaggtgcaggtcggcgagcatatcgagatcctgcacgagggcgactgcatctactatgacagctccatcccgcacggcatggttgcggccaacggcgaagattgtctgttctatgcgatcgtcctgcgtccgcaggaggaagcggcgctgcaggcgccgtccgaccggcttcccgccgcgcaggagcgcaccgccgaccggaagccccgcgtggccgagcgcttcatccggacgacggagaacgaaaacggccttgtgcagtccatcgccttccgggacgaagaccggttcaacttcgcctttgacatcgtcgacacgctcggccgggaaaagcccgaaaagctggcgatgctccacattgcggaggacggcaccgaacgccgattcaccttccgggatatgaaagaggcctccagccgggcggccaactattttacctccctcggcatcaggcgcggcgaccgcgtcatgctggtgctcaagcggcactaccagttctggttcgcgatcctcggtcttcacaagatcggcgcgatcgccatcccggcgacgaaccagctggtcgagcacgacttctcctaccgcttcggcgccgccggcgtcagtgccatcgtctgtaccgcggacggcgacacggcgcatcaggtggagctggccgaacgggattacgcgaagccgctcatcaagatcatggttggcggcacgcgggacggctggcatgatttcaacgcggaatccgagctgttctcccgccactttgagcgccggccggacagcccctgcggcaatgatccgatgcttatgttcttcacgtccggcacttccggttatccgaagatcgcggcgcacagctacaaatacccactgggccactatatcaccgcgaaatactggcaccgcgtgaacccggacggcctgcacctgacgatctccgacaccggctgggccaagtcactttggggcaagctctacggccagtggctctgtgaagccgccgtgttcgtctatgactttacccgcttcgacgcggcaaagatcctgccgctgtttgcaaactatcacattaccaccttctgcgcgccgccgaccatgtaccgcatgctcatcaagcaggatctgtcgcagtacgatctgtcctccatcgagcatgcctccatcgccggcgaggcgctgaaccccgaggtcttccgccagtttgaaaaggcgaccggccttcgcatcatggagggcttcggccagtcggaatcgacgctcatcatcggcaatcttgcaggcgacagccacaagatcggctcc

SEQ ID NO: 2153 - DNA, 1242 bp, Unknown
  Artificiall/Consensus sequence
atgagtgaagaaattatttgcaaaattgataatattgtaaagcagtttccgggcactactgcgctggatcacgtcagctttaatgttaagcggggtgaagttcacgcgattgtcggcgaaaacggtgcaggcaaatcgacgctgatgaacattctgtccggcgtatttcctccgacagaaggcaccgttacgtttaatggcaaggagtgccatttctccagccccagtgaggcggagcaggccggcattgccatgatccatcaggaactttccctgtcccccaccatgacggctgcggaaaacgtctacatgaaccgtatgccggtcaacaagctcggacttgtcaactataagaagatgtatgcggactgcgccgcgcttctggaaaagctgggcgtctcctacatctccccgaaggcaaaggtccgcaacctgagcgtttccgagcagcagctgcttgagatctgtaaggcggtctcctgcaacgcgcagatgctcatcatggatgagccgacgtcctctctgaccgataccgaggtcaaattcctgctgaacatcgtcaatcagctgcgggaagagggcatctcgatcctgtatatttcccataaactcgaagaaatccttaccatcgccgataccatcaccgtcctgcgtgacggccagcatatcgcgacggagccggccgccggcatgaccgaacagcatatggtcagtctgatggtcggccgtgaatacgaaggctcacataaaagaaatttcgttaccgattactccggcaaaacgccgatcctctctgtccggaacctctatgatatggcaggcaaggtcaagaacgtgtccttcgacctgtatccgggcgaagtccttggcctgacgggccttgtcggcgcgggccgcagcgagacgctgcagtgcatcttcggcgccaacatgcgcaagagcggccagatcttcatcaacggtgaagaagtcaacatcaaaaactgtgatgacgccatcaagcacggcatcggcatgatccccgagggtagaaagatccagggcctgttcctgaagatgactgtccgtgaaaatatcctgctggtctatcagcgctgcatggccaagggcggcatcctcaacacgaagaagctgctgggcgatgcggaggaatactccaagaagctgaacgtcaagaccgcatccatcgacgcgcccatcaccagcctctccggcggcaaccagcagaagaccatcattgcc

SEQ ID NO: 2154 - DNA, 2184 bp, Unknown
  Artificiall/Consensus sequence
atgaagaaacttgttgcacttcttctggctgtgtgcatgctgcttggtctgatgaccacggtattcgcagccgacgaaaaatccaacgacattgtaatcctgcacaccaatgatgttcactgcggcgtgaacgatggtcttggctatgccggtgtcgcggcatacaaggctgacatggaacagacgcacaactttgtcacgcttgttgactgcggcgacgcggtgcagggcgcgccaatcggcttgctgtcggcgggctcctatctggtcgacatcatgaacgaagtcggctatgattttgcaaccttcggcaatcatgaatttgattacaagcttccccgtctggccgagctgactaagctggccaaatatcagtatctgtcctgcaacttcaagtacatcggcaagggtacgagtgacgtcgcctacaagccgtattcgatcgtggactacggcgggacaaaggttgccttcatcggtatcaccacaccggaaagcttcgagaagtccacgcccgcctacttccaggatgataacggcaacttcatttacagtttttctgaggacaaggatggttctgccctgtataagactgtccagacgactgtcgatgccgcaaaggccgaaggcgcaaagtacgtcattgccattgctcacctcggcatggagggtacgacagactattggacctccgaagcggtcatccagaataccaccggcatcgacgccatgctcgacggccattcccacgaggaatacagcaagaccgttacaaacaaggacggtgacaacgtcgtgttggcgcagaccaagaccaagctcgccaacctcggcaagctgaccatctcctccgacggcaagatcacctctgaaatgatctccgccaaggattacacaacgaaggacgaacacattaccgagtttatcactggcattaccgacaagttctctgccgagcttgccaaggttgtcggcaagagcgaggttgatctgcctgactctgacgaaaacggcaagcgtctggtccgtaattctgagactgcactcggcgatcttgcagctgatgctttccgcatcatgatggatgccgacatcggcattatgaacggcggcggtctgcgtgccgcaattcctgcgggagaaatcaccctcggaacgctgttcaaggtattcccgtggggcaacctgccctgcaaggttgccgtgaccggccagaccattctggatatgctggagcttggcgcaagcaagtatccgaaggagaacggcggtttcctgtccgtttccggcctcaagtacaccatcgcctacggcgtagcaccctcgattgaaacgaccgatcagggcgagttcgttaaagtcgccggtgcgcgccgcgtgaccaacgttcaggtactcaataaggcgaccggcaaatatgagccgatcaacaccaagaagatctataccctcggcggtatcgattatacgatcgtctatggcggcgacggcttctcgatgttcaaggatgcaaaggtcatcacccccgcagacgcaaagatgaccgaatccaaggtgatcctatcctacattgagactaagctcggcggcgcgatcggcgatgaatatgccaaaccgcaaggccggatctcctacgtccgctatacagatgttgcagataccgcgtggtatgcggaggctgtcaactacgtttccgatgaggaactcatgaacggtgtcggtaccggctttgatccggacggcacgctgacgcgcggcatgcttgtcacggtcctgtaccgcatggcaggctcccccgctgtttccggcaatgtcagtgagaagttcaaggactgcaccgacggcagctggtacgctgacgctgtcctgtgggcaagcgaaaagaagatcgtcgacggctacgaagacggcaccttcctgcccaccaaggccatcaaccgtcaggaaatggccaaggtcctctatggctatgacaagaccatgggcaagaacgcagagggcatcaccgagaagctcacctacaccgatctcgacacgatctctgactgggcactcgagtccgttacctactgcaccgcggccaagtatctggccggttccaacggcgcattcagcccgaagggcaccgcgacccgcgccatgggtgccaaggttctcatgaacatgaccaaggaagctgcataa

SEQ ID NO: 2155 - DNA, 1050 bp, Unknown
  Artificiall/Consensus sequence
ttgcagcgccctgcgcaactcttttccggtaaaccggaatcttcaggaaaaattcatgtttcccgcgccgcagatgtgctatacttactttataaaagatacgaaagaaaaggaggcattggcttgaaccagacaggaaggatcctggaagaagtcaaaaaagcggtatgcggcaaggaccgcgtacttgtctgggtattgactgtcctgcttgcaagagggcatgttttattggaggatatccctggcgtcggcaagacgaccatggcgttagccttttcccgcgcgctgggtctggattacggccgggtgcagtttacgccggacgttctgccgtccgatatcaccggctattccgtctatcagaaggagaccggcaaattgatctatcagccgggcgcagttctctgcaatctatttctggcagacgagctgaaccgtgcgacctcgcgtacacagtccgcgctgctcgaggccatggaagagggccaggtcacggtcgacggcgtcagccatccgatcccgcagccgttcattgtcttcgccacgcagaaccccaccggcgccgccggcacgcagctgctgccggattcgcagatggaccggttcaccatccgcctgtccatcggctacccggagcctgcggacgagcgcaacatggtgcttgcccggcagggcgtcaatccgctgcagacggtcaatcccgttctgtcccggcaggagctgattgccatgcaggacgaggccgccgccgtttacatcaagcctgagcttgtcgactatatcgtttccctgattggcgccacgcgccagcatccgctgatcctgcgcggcgccagcccgcgcgcgacgctctcactcacggcgatggccaaggccgtcgcctatgtgcagaagcgggactatgtcgttccgaaggacattcaggtaaccttcccgcagaccatcgcgcaccgcctgctcctcgcgccggaggccgacgcccgtcaggtcggcgcgcagcagatcctcgaggagatcctgcggcaggtccctgcgccaagattgtaa

SEQ ID NO: 2156 - DNA, 804 bp, Unknown
  Artificiall/Consensus sequence
atgttatttgaaacaatgggaaacgagcagaacccggtggttttgttctttcacgccatgggcgtgacgggcgcgagcagcgagccggtggcaagattcctgcaggcaaactatttctgcatcctgccgacctccaccgtctattgcgccgggcagcggtatcaaagccgggcagacgagatccggcagctggagcagtttctgcacgagcggcatatcacctgcctctccatggtcgtcgcttcgtccatcggcacggatctggcgacagcgtttctggcgcagacagagatccctgtcgagcatgcgtttttcgacggcggacagttcgcgcagatcccaaagggcacccgccgcctgatgatccccttcttatacctcgccatcaaaagccttgcctggtcaaacgggaaaacactcaaaaagatcctctggtgcgacgacgagagcatcaagccctattttatcgccgcaggccgcgcgcttgactaccgctcgctttcccggcagatgatggacagcctgctggacgcgccgtttcccgccctgccggaggcgctgcagaaaaacagcttctgggaatttggcagcgccgaggagcatttcaaataccgcgatgcggtcatgcgcgcctatccccatggcagcttcccggtcttcgaggggcataatcacatgcagtaccagatccgcgacccggagggcttcgcgcacatgctccggagcatcgtggagcggggaacgctgccggagcttccctttttacagacagaaatccaacatggaaaggacacaaacggatga

SEQ ID NO: 2157 - DNA, 906 bp, Unknown
  Artificiall/Consensus sequence
atggcggagactacgctcacggtatcctccgaagcgctgcagcggctgcttgccgccgccaacggcgacgcggcgcttctgtatctctatctcgcgtctgaccgtccgctggaggaagcggcgcaggcgcttcgcatgagccaggcgcggtatgacctcgcctgtgcgacgctgcagcagctgggcctctggccgcaggagccgcagcgccatctggacgcggcgcaggcgccggtctacaccgagcaggatgttatccgcgagagccgcaccagtcgcgagtttgaagccatcacgggcgagacgcagcggcggctgggacgcgtgctgagcaatgaagagttgaagatcctgctgtcgatctatcgctatctcggcctgccgggcgaggtgatctccattctggtcaattactgcatccagcgccagcgctcgcgcggtattacgcggatgccgtcgctgcggtcgatcgaaaaggaagcgtattactgggccgaccacggcatcgacaccatggagcaggccgccgtctatatgcagaaccagctgctgcgtcagtcgcagctggggaagatcaaggagctgctcggcatcacgggccgccggctgacgaacggcgaggaaaaatatatcctcacgtggatcggctggggcttcggcgaaagggagatcgggctggcctatgaaaagacctgccttgccacgggcgggcttaaatggccgtactgcaattccatcctgcgtagctggcacgagcagggctttaccacgctcgcgcagatcgaagcgggcgaccgcgcaccggacaaggggaaatacagccgcggcgtgcagcagcacaacgacgaactcagtgacctgcagattgctgccattgaccggatgctgaacgataaggaggattga

SEQ ID NO: 2158 - DNA, 1239 bp, Unknown
  Artificiall/Consensus sequence
cagaacgaatatcattcgctggccgggcaggggaagaagatccgcgtcctgctgcagagcagcgcgcagaccagcccgggcctgatcgccatggtgaaggattttacgatcaaaacggggatcgaggcagagtttatcgagaaaaaatacggcgaagtcctcgatacgatcgaaagcagcaacggcgagatcgatgtattcagcacagaccttgtctggacgccggagctgaacgcctgcggtctcgtggagccgctggaggagtatctggcggcggacggcgcgtcgaccggggattttcaggacaatatcctgcgcgaatactgcttctacaagggcaatttgtacgcgatgccgtacagctacacggcgcagatcctgctgtaccggcgcgatttgttcgattcgctgaaaaacaagcgccagtattacgagatctacaaaaaagagctgcgcgtgccgcagacgtggcaggaatacaacgacgtggcgcgctttttcacccgggcctacaatccggagtcggagacccgctacggcacgacgcttggcggcaacgagtataacggcgctgcctgcgagctgctgccgcggatctggggcatggccggcggaagcaccgacggcgactggctgcacccgacgtccgaccggttccgcgaggcgttcaaaaactacgtcgaatgcttcaaatatgcccagccggacgcgctggactgctggtggaacgaggaagagcagctgtttgccagcggcgacgcggctatgatggtcgtcttctccgagcatatcgcgagcctctgggaccgtggaaagaacaagatcgccggcaagatcggccacagtacgatcccgggcgaatattccctgctcggcggctggtccatggcgatccacagcaaaagccggcacaagcaggaggcgtatgagttcgtcaaatggagctgctccggcgaaatggccatgccgaacgccgccatggggcggatcctgccgtacaaggccatccgggaaagcgcggagctgtcgcgctcgtacccgtggctgggcgacgcgttcaacgcgtttgaacacatcggacgcagatacctgccgagcggcaaggatgcggtcaacggacagatgcgcgaactggaacgtatcataggccgcgccgtacgaatggccgtctctggtggacagagcgtgggcgatgtcctgcaaatcacggaaaaaaatatcaagaacattctcaaataa

SEQ ID NO: 2159 - DNA, 1086 bp, Unknown
  Artificiall/Consensus sequence
atgaaaaaaatgggactttcctcttccgctccctggctcaagtattacggtgatgtaccccatcatctgacgtatccgcagaagaccatctaccagatggtgcaggctgccgctgaccgcaatccgaagctgtacgcctatgagttcatgggcaagaaaacgacctatgcgcagttcatgcagaagatcgacgctgccgcgcaggcgttcctcgccatgggcatccagaagggcgaccgcgtgaccatctgcatgccgaactgcccgcaggcgctgcaggcgttctatggtctgaatcggatcggcgcagtctcgaacatgatccatccgctgtccgcagctggcgagatcaaattctatctcaacttctcccactccaagtgcatcctgacgctcgatcagttctatgccaagatcgcgcccatcatgccggagctggacgatccggactgcaagctgctggttgcaaagatcgaggacgagctgttcccgcatctggctgtcggctatgcgctcacggctggacgcaagtatcccaagcccccgaagaagggcaattacatctggtggtccgagttcctgcgcgtgggcaaaaagcgcagtcttccccttccgaaggagttcggcaaggcttccgacggcgcttccatcctctactccggcggcacaaccggcacgaccaagggcatcctcctgtccaacatgaacttcaatgcccttggcctgcagaccattgcggcctcgggcttctcccccatcgacggcatgaagatgctctccgtcatgcctgtgttccatggctttggtcttggcatcggcatccatacggcgctcatcggcggcgcatgctgcattcttgttccgaagttcaacgtcaacacctatgcagagctgctcatcaagaagcagcccaacatcatcccgggcgtcccgacgctgtttgaggcgctgctgcgcgcggagaagctcgaaaatgccgatctcagctgcctgaagggcgtcttctccggcggcgacagcatgtccatcgagctgaaaaagaaggttgacggcttcctcaaggcccacaacgcctccgtgcaggtg

SEQ ID NO: 2160 - DNA, 1107 bp, Unknown
  Artificiall/Consensus sequence
atacacctgccggggaagctcgtctatgtgctctttgccatctgggcgtcgggtgcggcgggcgtgctgggatggaaagttctctcccacctgcgcttccgccgtcgggtcttaaaggatgccgtgtcggtcacggacgaggaaacgctcgctgtctggcaggcggagctggcgcgcgcgtgggtgaaaaagacgaaatggaagctcgtccgctcgcagtcgctgacgacgcccctgtccatcggcctgtttgaccgcacgacatgcgtggtgctgcctgcgcgcagctattcgccgcaggagctttcccttgtgctgcggcatgagatcatccatatctgccgtggcgatccgtcgtccaagtttttcatggccttctgcacggcgatgtgctggttcaacccgctcatgtgggtcgccatgcgcaagagtgccgacgattttgaactgagctgcgacgagaccgtccttctggatgagccgcagcctgtccggcgggaatacgcggagctgcttcttaacaccgcgggcgacgagcgcgggttcaccacctgcctgtccgccacggcgagcgcgctgcgttaccggctcaagaacgtgatggcgccggggaaaaagcgcacgggcgcgatcctcgtcgggctgacgttcgccgtgctggccctctgcaccggccatatggcgctcgcctatgacgcccagccgggcacagagcggatctttgacaatcagccgcttgaagcgttccacctgcaatatcttgacccgtgggacgatccgcgcggcgcaaacgactacgcctgcgtggacgaaggcgcgttcaaaacctatctcgcgtccttggagctggagacctatacggaaaagctggacgtttacagcgacggacgtgggctgagcatggattttaacacaccggagggtattctggtggtctaccttgccgatcagtctatccgtgtcacgcgcatatggctggagaacgcgccgacggagagctattacctgtcctgcccggtcgactgggactatctggacacgatcctcgtcccgcgtccgacgctgtgggtgtattttgacgaatacggcgccagccgccgcgtctcg

SEQ ID NO: 2161 - DNA, 657 bp, Unknown
  Artificiall/Consensus sequence
ttggacgcgaaattactggaaatgcttgaacagatcgcaaaggcgatcgcagcacaattcggcagcaactgcgaggtggtcatccacgagctttccggcaaaagcgcctattcctcgatcgtcgcgatcgaaaacggtcatgtaacgggccgcaaggtaggcgacggaccgtcgcatgtggtgctggaacaactgggacacgaggatgacggcgcaaaggatcagcttgcttatctgacgcgcacaaaggatggaaagatcttaaagtcctcctctgtgtatattcgggatgaggccggaaaggtcgcagggatcctcggcatcaactatgatatctccatgatgcagatgtttgaaaattccctgcatgactttatctcggcggaccatcaggtgcggcgcgaaccggagcggatcaccctcaatgtggcggatctgcttgatgatctgatccggcaggcggatgaactggtcggcaaaccggtcgcgctgatgacaaaagacgacaaggtcaaggcgatccgctacctgagtaattccggcgctcttctgattaccaaatccggcgacaaaattgcaagacactttggcatctccaagtacacactctattcgtatttagataacagtaaaacaggaggaacaaacgacttatga

SEQ ID NO: 2162 - DNA, 1410 bp, Unknown
  Artificiall/Consensus sequence
atgaaactgactgattatctgggcgacaagcccttctggaacgtcacggtcaagctggctgtgccggtcgcgctgcagaacgtgctgaccagctcgttccagctggtcgacacgatgatggtctcccggctgggagacgtcacgctctccgccgtcggcatggcttcgcagtggggctggctgtcgagccttctgtgcttcggcctgtgttctggcatgagcgtgttcatctcgcagtactggggcatcagggactacaagggcatccgccgcgtcacgggtcagggtctgatcatcgcgctactgctgacgctgagcttcctgtccgtcgcactggccgcgccggagtgggtgcttgggcttttcaataaagacccatccgtcgtggaagccgggtgcaattatctgcgcatcgtctgcttctcctatccggcggtcgcgctgacgctgctcatgtccaacgtcctgcgcggcacggggcgcgtcaatctgccgctctatgtctcgatcttcacgaccatcgcgaacgcctttgccgattacggcctgatcttcggcgcgttcggcctgccggagctcggtgtgcagggtgcggccatcgcgacctgcatctcctcgtggctcggccccatcctgcttctgatcttctcggccatcgagaaaaacctgctggtcggcccggtcaaggagctgctggccttcaatctcaagcaggtcggagagttcctgacccgcgcgatgcccgtcatgctgaacgagggcctgtgggccatcggcatgctgatgctcaaccgtatctacgccaacatgggctatgaatattatgccggcatgaccatcttcaagaccttctccgaactggccttcgccttcttcgtcggcctcggcaacgcctgcgtcatcatggtcggcaagtcgatcggacagggcaagatcgaacgcggcgtcacagacgcgcgccggttctccgtcctggtgccgatgatggggcttctgatcggcgtcacgatggtgcttctgcgccatccgctcgtcgcgctgttcgccacgggcgataacctctccgccacgaccatctccacggcctacgccgtgacgatcttctgttcgctggaatactggttccgcaacatctcgtatgtgcaggtcgtcggtgcgttccgctccggcggcgatacgctgaccggcatgctgttcgacctttgcagcctctggttcgtctcgatcccgctcgcgctgctcgcgtcgcgggtgctgcatttttcctttatcggcgtcgtcatgtgcgcgtatctcggcgaggatatcccgaaaagcattctgtgcctgttccatttcaaaagcatgcgctggctcaagcccgtcacggaggagggccgcgcgggtctcaaggattaccgcggagcataa

SEQ ID NO: 2163 - DNA, 1047 bp, Unknown
  Artificiall/Consensus sequence
atgaagctttatggcaaggaactgaccaagcgcgagctgctgcagtatgtcggcgacgtttcgcagatcgcagacgcgcgcgagggcgttatgacggccggtaagtccgacggtgtacgcaccatcgacgtcaagaccggcagcggtctggaatttacggtcctgccgacccgcggcatggacatttcgtgggccagctatcagggcaaggcactgagctttgtcagcaaggccggtgtcggccatccggcgtacttcgaaaaggacggcttcggcttcctgcggaacttcttctgcggcctgctcaccacctgcggcctgacctacttcggcgcgccctgcgtggataacggcgaagagcttggcctgcacggccgcatcagcaacatcccggccaagaacgtctgtgtcgagaaattctgggacggcgacgactatatcatccgcatccgcggccaggtggtcgagagcagcatgttccacgaaaatctcgtcctgaaccgcaccatcgagacgaagatgggttcccgcagcgtcaaaattaccgaccacattgaaaacatgggctttgacgagcagccgttcatgctgctctaccactgcaacttcggctatccgatcgtctcggagaaccccgttctcatcgagccggacggcgtcaaggtcgttgcgcgcgacgccgaaggcgacgtgcccacgcatgccgagttccagaagccgacgcacgactataacgaacaggtcttctaccacgatatcccgaaggtgcagggcgacgagtcgttcgccagtctctacaatcaggagctgaagctcggcacctacgtcaagttcaaccgcagccagttctcgaagttcggccagtggaagatgatgggcgagggcgactatgtggtcggtctggagcctgccaacgccatccccgagggccgcgacgtcgtcagaaagcgcggcgaactggaaatgatccagccgggcgaggtccggacgtttgagtttgagatcggcgtgatcgataccccggaggatctgaagcatattttctga

SEQ ID NO: 2164 - DNA, 2235 bp, Unknown
  Artificiall/Consensus sequence
gccgcgcagctgcgcgcgctgggctatccggaagggccgcatgcgcggtttctgctgtgtgagctgctgcaggacgcgctggccgcctttgacggcccggtctatttcattctcgacgatgtgtacctgctgcagagcggcgatctgccgggcgttctgtcgtttctggccgagcggctgccgccgggcgtgcatatgatccttgtgtcgcggaaccatatcttctccgaatccgcccggctgcggctgggaagcggccttctggagatcgtggcggacgatctgcggctgacgcagccggagctggagctgtacgccgcctgctgtgggcttcccttgccgcagacgcaggcgcggacgctctgcgccgtgagcgagggctggatcgccatgatctacctgtgcttccgcgcctacgtgcagacgcacgaatggcggttcgacacgcacaacatctacaccctcatcgagcaggtcatgttcgacccgctcgacgagcgccgcaggcgctttcttttatacaactgcgtcaccgaggaatttacgcgcgcgcaggcggccttcgtctggcaggaggcggacgcagacgttctgctgcacgatctgacgcacaacaacgcctttattgtctccggcgcgggcggcgtctaccgctatcaccacatgctgcggcagctgctgcgccggaaattcgagctgcttgacccggcggtgcagaaccgggtgcttgcccgggtcgggctgtggtttttgcaggcaaaagattatctgccggcggcggagtttttccgccgtgcgggcgagtggccgggtgtgctgcgcgccgcggcgctcgactgcggcaaatcgctcggcggcgaacaccggcagatgctcctcgactggtgccggaactgcccgccggagatcctgcagcagaacccggacgccgtctgcgtgctgatgcgcaagctgttctccttcggccagatcccagagatgctgcgcctgcggggtctgcttctggaggggctgcagaacgaagcggcctacacgccgcagcagcgggacaattatctcggcgaatgcgatcttgtgatgagctttctggcctataacgacatcggcgccatgagcgccctgcaccgcagcgccagcacgcgcatgacgcgcacgacgcgctgcatcgatcttgacggcacatggacgttcggctcgccgtcgatcctcatgatgttccaccgcacgtccggcggcgcggacgcggaaaacgcgcagatgcgcgaatgcatgccctgttattaccggatcacagacggccacggcagcggcgcggaatgcagcatgcaggccgagacggagcttctgcgcggccagctgaccgacgcggagatcagctgccatctggccgccgccgcggccgcgtcccgcgggcagtacagcattctcctgaccgtcgaatttgtgcgcatgcgcatggcgcttctgcgcgcagatcaggctgccgcagaggacatgctctgcgcgctgcgccggacgctgaagcagcagcggcaatttatcgtcctgcgctctctggagctgtgtcaggcgtggctggacgcgcagtccggctgcggcgacccgtctggccgctggttcatgacgccggaagccgacgcgtcgttcctcggcccgatgctccccatgctgcgcacggtgcagaacgaagttctgctcgcgtccggggcgtggacgaagctcctttcccgcgctgatcggtgcgccgcgatcaatgcgcagctgcacgctttgctggccgatagttacctccatatccaccttgcctgcgccaacgcgcggctcggccggacgcaggacgcccggcaggagctggacacggcgctctcgctcgcgctgccggatgcgttctatctgccgttcgccgagcatgcggacgatctcggcgcgctgctcccggaggcgctgcagtctcgcggcgagacagccgccgcagacgcggtcgcgcgcctgtgcgccatcaagaccgccgcgcccgcgccgcaggactacggtctgaccagccgtgagcttgagattgcgcggctcgccgccgcgcgcaggacgaacaccgagatcgcccagacgctccatctttcggaatccacagtcaaaaatcacctcaaacgcatcttcgataaactgggccttgacggcggcgcgcggggcaagcgcgtgctgctcgcgtccctccttccgcctaaagatagcccctga

SEQ ID NO: 2165 - DNA, 1206 bp, Unknown
  Artificiall/Consensus sequence
ggccgccggttccctgacgcggcgccgtgcgacagaagaaaggggaatgcgaagaagatggccgaaacgattctcagaatgaccggcattcagaaatacttcccgggggtacacgcgctggataacgcccagctcgaggtacgcgaaggggaggtcatggcgcttgtcggcgaaaacggcgcaggcaagtcgacgctcatgaaggttttgaccggcatctatccgagcgacggcggtacgatcgagttcttcggcgagcaggtgcatctgcatggcccgcgcgacgcgcaggcgctcggcatctgcatcgtgcatcaggagctgaacctgatgcagcacctgacggtggcggagaatatttttatcggccgcgagccgatgaagggcctgttcgtcgacaaggcgaagcagaacgccctgacgcaagcgctgtttgacaagctgcacctcgagctggatccgaaggcgacggtcaagacgctctcggtcgccaagcagcagatggtggagatcacaaaggcgctgtcgcacgacaatacccgcctgctgatcctcgacgagccgtccgccgttctgacggatacggagatcgatgatctgttcctcttcatccgccagctcaagaagaccggcgtcggcatcatctacatctctcaccgcatggacgaactcaagcgcatcaccgaccgcatcaccgtcatgcgcgacggacagtatgtggcgacgctcgacacgcccactgcggagatctccgaggtcatccgcctcatggtcggacgcaccatctatgaagagccgaaaacaaagtccatgtgtccgccggacgcacccgttgtgctggaggcggaacacctcaattcactggacgtcaaggacgtttcattccggctgcacaagggcgagatcctcggctttgccggtctcgtcggcgcagggcggaccgagacgatgcgccttgtctgcggcgcggatccgatggactccggtacgatccgcgtcaacggcacggacgtgaagatccgcagcccgaaggacgccgtccattacggcatcggttatctctccgaggaccgcaagcgctacggcctgtgcctgggcctgtctgtgacggacaacacggtcctgcccagccttgagcagctgttcaaaggtgcgttcgtcaacgataaaaaggcggaccgccacgcgcaggactatgtggaaaag

SEQ ID NO: 2166 - DNA, 861 bp, Unknown
  Artificiall/Consensus sequence
atgaagaagacctccacgttccacgcggaaaagcgcgcgcacaccatcctgacggtgttctttgccgttttggctgttgcatacctgtatccgatcctccttgttctgatcaactcgttcaagacgaacgcggccatcaacctcaacaccttcgcgctgccaaacagcgagacgttcatgggctggcagaactatatcaagggcatgaccttcggtaactatccgttctaccggtcggtggaatatagcgtggtcatcacgattctgtcggttgcgctgatccttgtgtgcacgtccatggcggcgtggtatatttcccgcgtgggcagcgttttcagcaagatcgtctatatgctctgcgtgttctccatgatcgtcccgttccagatggtcatgtttacgctgtcaaagaccgccgatacgctcaagctcaacatgccgtggacgatcccggtgatttatctcggctttggcgcgggccttgccgtcttcatgttctccggctttgtcaaatccatcccgcttgagatcgaagaagcagccgccattgatgggtgcgggccggtgcggacgttcttctcggtcgttctgccgatgctcaagccgacgctcgtctctgtcggcgtgctcgagatcatgtgggtctggaacgactatctcctgccgtatctggtgcttgaccgcacccagtatatgaccatccccatccacatccagtacctcaagggcagctatggcacggttgatatgggcgcgacgatggcgctcatcctgctggcaatcatccccgtcgtcatcttctatctctgctgccagaagtatatcatcaagggcgttgcagccggcgcagtcaagggataa

SEQ ID NO: 2167 - DNA, 1494 bp, Unknown
  Artificiall/Consensus sequence
ctgggcgcgattctcggcacgtccatcacgggctggatcatctgtctgtccgacatcggctcgacgggcggctggctcgacctgttttccacggccacgctgacgggcgtcatttcggtgatcggcatcgtgctccgcatggcgagcaaggatcaggccaaaaagcacattgcggatatcctgatgggctttgccattttgatgtatggcatgtcaacgatgtccgcggcggtttctccgctgcgcgacgacccgacgtttatccgcattcttaccaccttctccaacccgttcctcggcatcctgttcggcacgctctttacgtgcgtgctgcagtctgcgtcggcggccgtcggtattctgcaggcgctcgcctcgactggcatcattgatttttccattgcgctgccgatcatcatgggcattgccatcggcgcggccatgccggtgctgctctccgccatcggcgcgacggtcgacggcaagcggacggccatggtctatcttgtagctgaggtcacgggcgttattctgtttgcggcgatctattatacgctggccgcgttcatccgcttcccatttaccgaccggatcatgaccagcgtctccattgcgtttgtcaatacggtgttccggtttatcaaggtggtcggcctgctgccgtttacgaagcagatcgagaaggtcgtcaacttcctcgtgccggacaagccgcagcagcaaccggccgaaccggagaccatgcgtctggaagagcgattcatccagcatcccgccctcgccatcgaacagagccgcctgacgatcaacgccatggctgaagaggccaaacgcaactttatagaagcggtcgcgctgctgcacggttattcggatgaacgatatcacctggtcgaggatctggaaaaatccgttgaccgatatgaggataagctcggcagctatcttgtcaaggtgacggagcgcgagctgacggccaagcagaatgaggatgtgtccaagtatctgcatacgatctccgattttgagcggatctccgaccatgcactgaacatcgccgagggcgcgaaggagctgaacgagaaaaatctttcgttctccgatgctgcggcacatgagcttgaggtgatggaggcggcgctgacggagatcctgtccgtcacgatccgcgcgttcgtcaataacgatctgcagctggccgcccgcgtggagccgctcgaggaactgatcgacaatctctgcgacgaaatgaagctccaccacgtcgaccgcctgcagaagggcctgtgtacgctggtgcagggcttcgtgttcaacgacctgctgacgaactatgagcgcgtggcggaccactgttccaatatcgcggtcgccatgatcgagctggaatcggattcgttcgatacgcatgaatatctgagcagcatcaaggaaatgaaatccgagacatttgaacgctactatgaagaatacagccggatctaccagctgtaa

SEQ ID NO: 2168 - DNA, 918 bp, Unknown
  Artificiall/Consensus sequence
atgatctcttttcacaaggcggaggccgccgatcgcgcgtgggcgcatgaaatcctgaaaaactgtgaatatcccggcgcggaatacgcgttcagctgcatgtatctttggtcggagtatttcggcgagcttggccgggccggcgatcgcctgacccagcacgcgagctggcgcggccgcgaggtctatctctaccccgccggcaccggcgatctgcgtgaggcgatcgaagccatccgcgccgacgcggcggagcgcggcaatcccctgcgcctgcgcagtctgacgaacgaaacgaagcaggaactggagacgctctatccggggaagtttgaatttacggcctgccgcaattcctatgactatatctataccgtggaggagctttccgagctgcacggcaagaagctgcagtccaagcgcaaccactgcaaccggtttgaggatgagttccccgactggttcgccgcacccatcacggacgagaatctgccgcagtgccacgagatgctgcgcatctggtacgagacgcacgagcctgctgtgaatgcgcaggagctggatcagctgcagctggaaaagacggcgctgcagctggccttcgaccactttgacgagctggaaatggacggcctgctcctgtccgacggcgagcgtatcattgcgttctccatgggcagccgcatgaaccgcgactactatgacgtcggctttgaaaaggccttcccggacgtgaatggcgcctatgccatgatcaaccgggagttttcccgcatgatcgcagagaaataccccgaggtgcagttcctcaaccgcgaggacgacatgggttccgagggccttcgccgcgcgaaggagtcgtaccagccgacggtgttgctggaaaaatacgttgctgactggaaggagtctgtctga

SEQ ID NO: 2169 - DNA, 1347 bp, Unknown
  Artificiall/Consensus sequence
atgaacaagaaaagaagaaagcaaggcctgtggctgcgcagaaatctgccgatgctggtcgcgatcgcggcgcttgtgctgctggttctgatcatcgtgctggtcgccaagggctgctccaaggcaccggctgacccggtgcaggccaaggccttctcgacggagacgacgctggatctgccgatcacggcggaactcaataacggcgattttgtctcctacggcggctatcagttcaccacaaaaaagtcgctcagcgccatgagcaagctcatcgccaaaaataacgacggcgtcaccgccacaaactacgtcaacagctacggcacctgcgccgttttcaccaaagccaacgaagccggcggcacggacacctggtgcctgtacgccaaggatccgcagaacaccaaggagagctggtatatcttcatgggcgagcatcgcgagctttcgctgccgtccggcacgctggatatgctcctgccgctgcacctgatcaccgatgcggccctgcgcgacagcatgtttgcgacgctgcagaccgatacggtctatacctgcggtcttgaaaagctgaacgaagggcagacgctcgcgtccatgttccggaccttctatgagacgtccggcctctataccgtcacgaccagcgacaagggcttcacgcttgtgccgcgcggcggctcgcagcagctgatcttccagttcgacgagaacgggacgagcggccagttcctcatcaccgtcccgcaggacaccgaaccccagcccacgaccagcgtggttgtcacctatgacaaggacgatcccgtttccctgccggaggaagcggctgtgacgctgtcctccgctctgatgcaggccaactataagaagactggcaagacggcggattataaatacagcgtcgatctggacggtcaggtctatgaggtcgcattgacctggaaggacaacacgtggaacggctcggtccgttataacagtcaggtcgccatcctgaacgccagaagcagctgcacggtcgccgctgtcttcgcggccaacggtctcggcggcacgccagagcgcgacacggccaagtggccgaccgatgtgcaggatctcacggtcaacccgatgagcgactgcatggcgacgaccaacgacgtcaacgttcgcaccgcgccttcgatcgacagtcaggtgcttatgaccatgccgaccgacagcgccctcgccgtgatcggcctgacggacgacggcgaatggtacgagatctggtacaacgaggtctgcgcctacatgaacgccaaatacgtcaaacccgtcgccagcgctgctgcgcctgcaacgacggaggaatga

SEQ ID NO: 2170 - DNA, 987 bp, Unknown
  Artificiall/Consensus sequence
atggaacaaaaagcaaagactgccgcaaagggcggcggacttaagaaactgctgaagcagcaggaagttatcgtaattttactgatcattctggtgtcgattttcctttcaatcagacgcccggattccttcccgacatcgctgaacatcttcaacgtcctgaagcaggcgtctcagtacgcggtcctcgccattggtatgggcttcgtcatcatctgcggcaacatcgatatctccgttggcgccatcatcgccaccagcatctgcacggcagcctatgtcaatgagaagctgggcgtgatcaaccctctgttcgtgctgctcatcatcttcgcggtcggcgcactgttcggcctcatcaacggtcttctggtcgcaaaggctggcctgccggccttcatcgccacgatgggcatgctgagtgtcggcgacggcatttcgctgcttctgtccaacggcacgccgatcaagtacggcacgtcctggatctccctcttcggcggcagctacgtcggccctgttcccgtgcaggtcatcgtcatgatcgtcatgatcgtgcttgcgtggctgtttgcacaatacaccgtcaccggccgcaacatctacgcagtcggcaataacccccgcgcagcaaagctcaccggcatcaacaccgacggcatcatcatcatgtgctacatcatctgcggctgcatgtgttctctcgtcggcctcatgatgatgggccagctgaagcaggcaggcccgtcctacggctccggctacgaacttgacgccatcgcggcttccgtcatcggcggcatctccatggccggcggcgaaggcaacatctacggcgtcgccctcggcgcgatcctgatggcccttctgcggaacctgtttgttcagatcgccgtccccggctactggcagaccgttgttctgggcgtcgttatcatcgcatccgtcgccatcgactgcgtccgcaaaaagcgcgaagctcgctga

SEQ ID NO: 2171 - DNA, 2292 bp, Unknown
  Artificiall/Consensus sequence
cgggaagccgataaatattacgttgcccgcgcggtggacaccgccctcaatcaggcggaagagatcgcaaagcagatgaaggacgaatacgtctctgtggagcatctgttcctgtctttgattgagaacgccgacccgacgctcaaaaacctgttccgcccgtacgggatcacgaaggaagcgtgtctgcaggcgctgcagtcggtgcgcggcaaccagcgcgtgacctccgacacgccggaggatacgtatgaagccctcgccaaatacggcaccgatcttgtcaagcgcgcacgggagcagaagatggatccggtcatcggccgtgacgacgagatccggaacgtcatccgcatcctgtcccggaaaacgaagaataaccccgtcctcatcggcgaaccgggcgtcggcaagacggccatcgtcgagggacttgcgcagcggatcgtcgccaatgaggtcccgaagtcgctgcaggacaagacgatcttctcgctcgatatgggcgcgctgattgccggcgcaaagtaccgcggtgaatttgaagagcgtctgaaggccgtgctggccgaggtcaaaaagtccgaaggccgcatcatcctgttcatcgacgagctgcacaccatcgtaggtgccggcaagaccgaaggctcgatggacgcgggcaacctcctgaagccgatgctggccagaggcgagctgcactgcatcggcgcgaccacgctggacgaataccgacagtatatcgaaaaggatcccgcactcgagcgccggttccagaccgtcctcgtgcaggagccaaccgtcgaggataccatcgccatcctgcgtggtctggaatcccgctatgaggtcttccacggcgtcaagatcaccgacaacgcgatcatcgccgccgccacgctcagtaaccgctacattaccgaccgtttcctccctgacaaggccatcgacctcatcgacgaggcctgcgccatgatccgcaccgagatggactccatgccgacggagctggacgtcatcaaccgcaagatcatccagatgcagatcgaggaagccgccctcaagaatgaggacgacgagctgtcgaaggcgagactcgccgagctgcagaaggagcttgccgagcagcgcgagaccttcaactccatgaaggccaaatgggaaaatgaaaagaacgccatcggccgcgtccagcagctgcgcgagcgtatcgagcagatcaaccgcgacattgaagccgccgaacagagctatgaccttgaaaaggccgcgaagctcaaatacggcgatctgcccgaggcaaaaaagcagctcgagcaggaggaaaagctggcgcagaacggcaaggaaacgagcctgcttcgcaacaaggtcacggaggaagagatcgccaagatcatcgagcgctggacgggcatcccgaccgcacgcctgatggagggcgagcgcgacaagctgctgcatctggaggacacgctccacaagcgtgtcgtcgggcaggatgaggctgtgcgtgtcgtctccgaagccatccagcgcagccgcgccggcattcaggatccgaaccggccgctcggctcgttcctgttcctcggccccacgggcgtcggcaagacggaactggccaagacactggccgaagcgctgtttgacgacgaaaagaatctggtgcgtatcgatatgtcggagtacatggagaaattctccgtgtcgcgcctcattggcgcgcctcccggatacgtgggctatgaagagggcggccagctgaccgaggctgtccggcgcagaccgtattccgtcattctgtttgacgagatcgaaaaggcgcatccggatgtgttcaacatcctcctgcaggtccttgacgacggtcgaatcaccgattcgcagggccgcaccgtggatttcaaaaacaccatcatcatcctgacctcgaacctcggctcgcaggccatcctcgacggcatcacgccggagggcgagatctcggaggatgcgaagaacgaggtgcagacgctcctgcgccgcaatttccgcccggagttcctcaaccggctcgatgagatcgtgttctacaagcccctgtcgaaggagaatatcacaggcatcatcgacctgcagattgccgcgctcaacaagcgccttgccgacaagcagctcacgtgcgagttgaccccggcggccaagagcttcgtcatcgacgcggcctatgacccgcagttcggcgcaagaccgctacgccggtatctgcagcacacggtcgagacgctgctcgcccagcgcatcctg

(The sequence listing continues in the following parts.)

What is claimed is:

1. A method of reducing or delaying growth of a skin cancer tumor in a subject in need thereof, comprising administering to the subject a composition comprising an isolated or purified population of bacteria belonging to the family Ruminococcaceae.

2. The method of claim 1, wherein the skin cancer is selected from basal-cell skin cancer, squamous-cell skin cancer, melanoma, dermatofibrosarcoma protuberans, Merkel cell carcinoma, Kaposi's sarcoma, keratoacanthoma, spindle cell tumors, sebaceous carcinomas, microcystic adnexal carcinoma, Paget's disease of the breast, atypical fibroxanthoma, leiomyosarcoma, or angiosarcoma.

3. The method of claim 1, wherein the method further comprises administering an additional anticancer treatment.

4. The method of claim 1, wherein the population of bacteria comprises the bacteria *Faecalibacterium prausnitzii*.

5. The method of claim 3, wherein the anticancer treatment is surgical therapy, chemotherapy, radiation therapy, hormonal therapy, immunotherapy, small molecule therapy, receptor kinase inhibitor therapy, anti-angiogenic therapy, cytokine therapy, cryotherapy or a biological therapy.

6. The method of claim 5, wherein the biological therapy is a monoclonal antibody, siRNA, miRNA, antisense oligonucleotide, ribozyme or gene therapy.

7. The method of claim 3, wherein the anticancer treatment is administered intratumorally, intraarterially, intravenously, intravascularly, intrapleuraly, intraperitoneally, intratracheally, intrathecally, intramuscularly, endoscopically, intralesionally, percutaneously, subcutaneously, regionally, stereotactically, orally or by direct injection or perfusion.

8. The method of claim 1, wherein administration of the composition results in an increase of $CD8^+$ T lymphocytes in the tumor.

9. The method of claim 8, wherein the T lymphocytes are cytotoxic T lymphocytes.

10. The method of claim 1, wherein administration of the composition results in an increase of effector $CD4^+$, $CD8^+$ T lymphocytes, monocytes and/or myeloid dendritic cells in the systemic circulation or the peripheral blood of the subject.

11. The method of claim 1, wherein administration of the composition results in a decrease of B cells, regulatory T cells and/or myeloid derived suppressor cells in the systemic circulation or the peripheral blood of the subject.

12. The method of claim 1, wherein administration of the composition to the subject results in an increase in CD3, CD8, PD1, FoxP3, Granzyme B and/or PD-L1 expression in a tumor immune infiltrate.

13. The method of claim 1, wherein administration of the composition to the subject results in a decrease in RORγT expression in a tumor immune infiltrate.

14. The method of claim 1, wherein administration of the composition to the subject results in an increase in $CD45^+$, $CD3^+/CD20^+/CD56^+$, $CD68^+$ and/or $HLA-DR^+$ cells in the tumor.

15. The method of claim 1, wherein administration of the composition to the subject results in an increase in the level of innate effector cells in the subject.

16. The method of claim 15, wherein the innate effector cells are $CD45^+CD11b^+Ly6G^+$ cells.

17. The method of claim 1, wherein administration of the composition to the subject results in a decrease of the level of suppressive myeloid cells in the subject.

18. The method of claim 17, wherein suppressive myeloid cells are $CD45^+CD11b^+CD11c^+$ cells.

19. The method of claim 1, wherein the method further comprises administering an immune checkpoint inhibitor.

* * * * *